(12) United States Patent
Van Sinderen et al.

(10) Patent No.: US 9,771,624 B2
(45) Date of Patent: Sep. 26, 2017

(54) BIFIDOBACTERIUM LONGUM

(75) Inventors: Douwe Van Sinderen, Carrigrohane (IE); Jun Xu, Mason, OH (US); Wenzhu (Steven) Zhao, Mason, OH (US); Raymond A. Grant, Fairfield, OH (US); Song Yuli, Mason, OH (US); Charles Bascom, Hamilton, MA (US); Duane Larry Charbonneau, Mason, OH (US); Liam O'Mahony, Rathcormac (IE)

(73) Assignee: The Procter & Gamble Company, Cincinnati, OH (US)

( * ) Notice: Subject to any disclaimer, the term of this patent is extended or adjusted under 35 U.S.C. 154(b) by 0 days.

(21) Appl. No.: 12/616,752

(22) Filed: Nov. 11, 2009

(65) Prior Publication Data
US 2010/0183559 A1 Jul. 22, 2010

Related U.S. Application Data

(60) Provisional application No. 61/113,513, filed on Nov. 11, 2008, provisional application No. 61/149,980, filed on Feb. 4, 2009.

(51) Int. Cl.
| | |
|---|---|
| *A01N 63/00* | (2006.01) |
| *A61K 39/02* | (2006.01) |
| *C12R 1/01* | (2006.01) |
| *A23C 9/123* | (2006.01) |
| *A23C 19/032* | (2006.01) |
| *A23C 19/06* | (2006.01) |
| *A23L 2/38* | (2006.01) |
| *A61K 35/745* | (2015.01) |
| *C12P 19/04* | (2006.01) |
| *A23L 33/135* | (2016.01) |

(52) U.S. Cl.
CPC .............. *C12R 1/01* (2013.01); *A23C 9/1234* (2013.01); *A23C 19/0323* (2013.01); *A23C 19/062* (2013.01); *A23L 2/382* (2013.01); *A23L 33/135* (2016.08); *A61K 35/745* (2013.01); *C12P 19/04* (2013.01); *A23Y 2300/55* (2013.01)

(58) Field of Classification Search
CPC ... A23L 1/3014; A23L 1/296; A23V 2002/00; A61K 35/747; A23K 1/009
USPC ................... 424/93.4, 234.1, 252.1
See application file for complete search history.

(56) References Cited

U.S. PATENT DOCUMENTS

| | | | |
|---|---|---|---|
| 7,183,101 B2* | 2/2007 | Arigoni et al. ............ | 435/252.9 |
| 2001/0049115 A1 | 12/2001 | Collins et al. | |
| 2009/0274661 A1 | 11/2009 | Mercenier et al. | |
| 2011/0177034 A1 | 7/2011 | Kildsgaard et al. | |

OTHER PUBLICATIONS

O'Mahony L et al., Gastroenterology. Mar. 2005;128(3):541-51. Lactobacillus and bifidobacterium in irritable bowel syndrome: symptom responses and relationship to cytokine profiles.*
Vitali et al International Journal of Antimicrobial Agents 31 (2008) 555-560 Molecular and phenotypic traits of in-vitro-selected mutants of Bifidobacterium resistant to rifaximin.*
Rudinger (in Peptide Hormones, Parsons (ed.), University Park Press: Baltimore, MD, pp. 1-7, 1976.*
Guo et al, Protein tolerance to random amino acid change, PNAS, 2004, vol. 101 (25), pp. 9205-9210.*
Voet et al., Biochemistry John Wiley and Sons, 1990, p. 126-129.*
Sheil et al Gastroenterology, (Apr. 2007) vol. 132, No. 4, Suppl. 2, pp. A209. Modulation of the commensal flora by probiotic feeding delays the onset and decreases the severity of disease in the collagen-induced arthritis (CIA) model in a strain-dependent manner.*
Shilling Physiology, (Apr. 2006) vol. 290, No. 4, pp. G839-G845. Refs: 31 Differential cytokine response from dendritic cells to commensal and pathogenic bacteria in different lymphoid compartments in humans.*
Ngo, in The Protein Folding Problem and Tertiary Structure Prediction, Merz et al. (eds.), Birkhauser Boston: Boston, MA, pp. 433 and 492-495, 1994.*
Carvalho et al., Survival of freeze-dried Lactobacillus plantarum and Lactobacillus rhamnosus during storage in the presence of protectants Biotechnology Letters 24: 1587-1591, 2002.*
Definition of capsule from Webster's Seventh New Collegiate Dictionary, G. C. Merriam Co. pp. 1-12; downloaded on Dec. 28, 2016.*
Definition of tablet from Webster's Seventh New Collegiate Dictionary, G. C. Merriam Co. pp. 1-12; downloaded on Dec. 28, 2016.*
Altschul, et al., Basic Local Alignment Search Tool, J Mol Biol. vol. 215 pp. 403-410 (1990).
McCarthy, et al., Double blind, placebo controlled trial of two probiotic strains in interleukin 10 knockout mice and mechanistic link with cytokine balance, Gut vol. 52(7) pp. 975-980 (Jul. 6, 2003).
Ouwehand, et al., Bifidobacterium microbiota and parameters of immune functionin in elderly subjects, FEMS Immunol Med Microbiol vol. 53 pp. 18-25 (2008).
Riley, M., Functions of the Gene Products of *Escherichia coli*, Microbiological Reviews, vol. 57(4) pp. 862-952 (Dec. 1993).

* cited by examiner

*Primary Examiner* — Maria Leavitt
(74) *Attorney, Agent, or Firm* — Amanda Herman; Amanda T. Barry

(57) ABSTRACT

The multiple embodiments described herein comprise the genome of a probiotic *Bifidobacterium longum* bifidobacteria strain and genes encoded by the genome. Various novel *Bifidobacterium longum* are described.

9 Claims, 8 Drawing Sheets

BIFIDOBACTERIUM LONGUM

CROSS-REFERENCES TO RELATED APPLICATIONS

The present application claims the benefit of U.S. Provisional Application No. 61/113,513 filed Nov. 11, 2008, and U.S. Provisional Application No. 61/149,980 filed Feb. 4, 2009 the complete contents of both of which are incorporated herein by reference.

FIELD OF THE INVENTION

The invention relates to the genome of a probiotic bifidobacteria strain and genes encoded by the genome. *Bifidobacteria* are one of several predominant culturable bacteria present in human colonic microflora.

BACKGROUND OF THE INVENTION

*Bifidobacteria* are considered to be probiotics as they are living organisms which exert healthy effects beyond basic nutrition when ingested in sufficient numbers. A high level of ingested bifidobacteria must reach their site of action in order to exert a probiotic effect. A minimum level of approximately $10^6$-$10^7$ viable bifidobacteria per gram intestinal contents has been suggested (Bouhnik, Y., Lait 1993). There are reports in the literature which show that in vivo studies completed in adults and in infants indicate that some strains of bifidobacteria are capable of surviving passage through the gastrointestinal tract. Significant differences have been observed between the abilities of different bifidobacteria strains to tolerate acid and bile salts, indicating that survival is an important criterion for the selection of potential probiotic strains.

Ingestion of bifidobacteria can improve gastrointestinal transit and may prevent or assist in the treatment of illnesses which may be caused by deficient or compromised microflora such as gastrointestinal tract (GIT) infections, constipation, irritable bowel syndrome (IBS), inflammatory bowel disease (IBD)—Crohn's disease and ulcerative colitis, food allergies, antibiotic-induced diarrhoea, cardiovascular disease, and certain cancers (e.g. colorectal cancer).

Because of their perceived health-promoting activities, bifidobacteria have in recent years enjoyed an increased amount of scientific scrutiny, which included the full genomic sequencing of a number of strains (reviewed by Liu et al., 2005). These genomic sequences will provide the genetic platforms that allow the study of the molecular mechanisms by which these micro organisms interact with their human host and elicit their probiotic function.

SUMMARY OF THE INVENTION

The invention provides an isolated and purified *Bifidobacterium longum* strain, excluding *Bifidobacterium longum* strain 35624 (NCIMB 41003), wherein the strain:
  a) expresses an exopolysaccharide; and
  b) comprises at least two nucleic acid sequences selected from the group comprising SEQ ID NO. 93 to SEQ ID No. 113 or nucleic acid sequences with at least 85% sequence homology thereto.

A *Bifidobacterium longum* strain according to the invention may include any 2 or more such as BI00778, BI00793; BI00778,BI00794; BI00778,BI00795 or any three or more such as BI00793,BI00794,BI00798; BI00794,BI00795, BI00796; BI00796,BI00797,BI00798 or any four or more such as BI00778,BI00779,BI00780,BI00794; BI00778, BI00779,BI00785,BI00786; BI00790,BI00791,BI00794, BI00798 or any five or more such as BI00783,BI00786, BI00790,BI00794,BI00798; BI00780,BI00782,BI00785, BI00786,BI00790; BI00778,BI00779,BI00787,BI00789, BI00798 or any six or more such as BI00778,BI00779, BI00780,BI00781,BI00782,BI00794; BI00782,BI00784, BI00785,BI00788,BI00792,BI00797; BI00781,BI00782, BI00783,BI00791,BI00796,BI00797 or any seven or more such as BI00779,BI00783,BI00784,BI00787,BI00791, BI00792,BI00797; BI00780,BI00789,BI00790,BI00793, BI00794,BI00797,BI00798; BI00783,BI00784,BI00786, BI00788,BI00789,BI00793,BI00796 or any eight or more such as BI00779,BI00782,BI00783,BI00784,BI00785, BI00794,BI00797,BI00798; BI00780,BI00787,BI00788, BI00789,BI00790,BI00793,BI00794,BI00795; BI00783, BI00784,BI00785,BI00786,BI00787,BI00793,BI00795, BI00798 or any nine or more such as BI00778,BI00780, BI00782,BI00784,BI00785,BI00787,BI00793,BI00795, BI00796; BI00779,BI00781,BI00782,BI00784,BI00786, BI00787,BI00793,BI00795,BI00797; BI00782,BI00783, BI00785,BI00786,BI00787,BI00789,BI00792,BI00796, BI00797 or any ten or more such as BI00778,BI00781, BI00784,BI00785,BI00786,BI00789,BI00790,BI00792, BI00793,BI00798; BI00779,BI00781,BI00784,BI00786, BI00787,BI00788,BI00791,BI00794,BI00795,BI00796; BI00782,BI00784,BI00785,BI00786,BI00790,BI00792, BI00794,BI00796,BI00797,BI00798 or any eleven or more such as BI00778,BI00781,BI00785,BI00787,BI00788, BI00790,BI00791,BI00792,BI00794,BI00795,BI00798; BI00779,BI00782,BI00785,BI00786,BI00789,BI00790, BI00793,BI00794,BI00795,BI00796, BI00797; BI00781, BI00783,BI00785,BI00787,BI00788,BI00789,BI00790, BI00793,BI00794,BI00795,BI00796 or any twelve or more such as BI00778,BI00781,BI00782,BI00783,BI00784, BI00785,BI00790,BI00791,BI00792,BI00795,BI00796, BI00797; BI00779,BI00785,BI00787,BI00788,BI00789, BI00790,BI00791,BI00792,BI00794,BI00796,BI00797, BI00798; BI00786,BI00787,BI00788,BI00789,BI00790, BI00791,BI00792,BI00793,BI00795,BI00796,BI00797, BI00798 or any thirteen or more such as BI00778,BI00779, BI00780,BI00782,BI00784,BI00789,BI00790,BI00791, BI00792,BI00793, BI00794,BI00795,BI00798; BI00778, BI00781,BI00782,BI00783,BI00786,BI00787,BI00789, BI00790,BI00791,BI00792,BI00795,BI00796,BI00798; BI00780,BI00781,BI00782,BI00783,BI00785,BI00786, BI00788,BI00790,BI00791,BI00792,BI00793,BI00797, BI00798 or any fourteen or more such as BI00778,BI00779, BI00780,BI00782,BI00783,BI00784,BI00785,BI00787, BI00789,BI00791,BI00793,BI00794,BI00795,BI00797; BI00778,BI00780,BI00781,BI00782,BI00784,BI00785, BI00786,BI00788,BI00789,BI00792,BI00793 ,BI00794, BI00796,BI00797; BI00779,BI00780,BI00781,BI00782, BI00783,BI00784,BI00785,BI00787,BI00790,BI00791, BI00794,BI00796,BI00797,BI00798 or any fifteen or more such as BI00778,BI00779,BI00780,BI00781,BI00782, BI00783,BI00784,BI00785,BI00786,BI00787,BI00788, BI00789,BI00790,BI00792,BI00798; BI00778,BI00780, BI00781,BI00782,BI00785,BI00787,BI00788,BI00789, BI00790,BI00791,BI00793,BI00794,BI00795,BI00796, BI00798; BI00780,BI00782,BI00783,BI00784,BI00785, BI00786,BI00787,BI00789,BI00790,BI00791,BI00793, BI00795,BI00796,BI00797,BI00798 or any sixteen or more such as BI00778,BI00779,BI00780,BI00781,BI00782, BI00784,BI00785,BI00787,BI00789,BI00790,BI00791, BI00792,BI00793,BI00795,BI00797,BI00798; BI00778, BI00779,BI00781,BI00783,BI00784,BI00785,BI00787, BI00788,BI00789,BI00790, BI00791,BI00792,BI00794, BI00795,BI00797,BI00798; BI00780,BI00781,BI00782, BI00783,BI00784,BI00785,BI00787,BI00788,BI00789, BI00790,BI00792,BI00793,BI00795,BI00796,BI00797, BI00798 or any seventeen or more such as BI00778, BI00779,BI00780,BI00781,BI00782,BI00784,BI00785, BI00787,BI00788,BI00789,BI00790,BI00793,BI00794, BI00795,BI00796,BI00797,BI00798; BI00778,BI00780, BI00781,BI00782,BI00783,BI00785,BI00786,BI00787, BI00789,BI00790,BI00791,BI00792,BI00793,BI00794, BI00795,BI00796,BI00797; BI00779,BI00780,BI00782, BI00783,BI00784,BI00785,BI00787,BI00788,BI00789, BI00790,BI00791,BI00792,BI00793,BI00794,BI00795, BI00797,BI00798 or any eighteen or more such as BI00778, BI00779,BI00780,BI00781,BI00782,BI00783,BI00784, BI00785,BI00787,BI00788,BI00789,BI00791,BI00792, BI00793,BI00794,BI00795,BI00796,BI00798; BI00778, BI00779,BI00781,BI00782,BI00783,BI00784,BI00785, BI00786,BI00787,BI00788,BI00789,BI00790,BI00792, BI00794,BI00795,BI00796,BI00797,BI00798; BI00779, BI00781,BI00782,BI00783,BI00784,BI00785,BI00786, BI00787,BI00788,BI00789, BI00790,BI00791,BI00792, BI00793,BI00794,BI00795,BI00796,BI00797 or any nineteen or more such as BI00778,BI00779,BI00780, BI00781,BI00782,BI00783,BI00784,BI00785,BI00786, BI00787,BI00788,BI00789,BI00790,BI00791,BI00792, BI00794,BI00795,BI00796,BI00797; BI00778,BI00779, BI00780,BI00782,BI00783,BI00784,BI00785,BI00786, BI00787,BI00788, BI00789,BI00790,BI00791,BI00792, BI00793,BI00794,BI00795,BI00796,BI00797; BI00779, BI00780,BI00781,BI00782,BI00784,BI00785,BI00786, BI00787,BI00788,BI00789,BI00790,BI00791,BI00792, BI00793,BI00794,BI00795,BI00796,BI00797,BI00798 or any twenty or more such as BI00778,BI00779,BI00780, BI00781,BI00782,BI00783,BI00784,BI00785,BI00786, BI00787,BI00788,BI00789,BI00790,BI00791,BI00792, BI00793,BI00794,BI00795,BI00797,BI00798; BI00778, BI00779,BI00780,BI00781,BI00782,BI00783,BI00784, BI00785,BI00786,BI00787,BI00789,BI00790,BI00791, BI00792,BI00793,BI00794,BI00795,BI00796,BI00797, BI00798; BI00778,BI00779,BI00780,BI00782,BI00783, BI00784,BI00785,BI00786,BI00787,BI00788,BI00789, BI00790,BI00791,BI00792,BI00793,BI00794,BI00795, BI00796,BI00797,BI00798 or all twenty one of the nucleic acid sequences selected from the group comprising SEQ ID No. 93 to SEQ ID No. 113 or sequences homologous thereto.

The strain may comprise at least three nucleic acid sequences selected from the group comprising SEQ ID NO. 93 to SEQ ID No. 113 or nucleic acid sequences with at least 85% sequence homology thereto. The strain may comprise at least four nucleic acid sequences selected from the group comprising SEQ ID NO. 93 to SEQ ID No. 113 or nucleic acid sequences with at least 85% sequence homology thereto. The strain may comprise at least five nucleic acid sequences selected from the group comprising SEQ ID NO. 93 to SEQ ID No. 113 or nucleic acid sequences with at least 85% sequence homology thereto. The strain may comprise at least six nucleic acid sequences selected from the group comprising SEQ ID NO. 93 to SEQ ID No. 113 or nucleic acid sequences with at least 85% sequence homology thereto. The strain may comprise at least seven nucleic acid sequences selected from the group comprising SEQ ID NO. 93 to SEQ ID No. 113 or nucleic acid sequences with at least 85% sequence homology thereto. The strain may comprise at least eight nucleic acid sequences selected from the group comprising SEQ ID NO. 93 to SEQ ID No. 113 or nucleic acid sequences with at least 85% sequence homology thereto. The strain may comprise at least nine nucleic acid sequences selected from the group comprising SEQ ID NO. 93 to SEQ ID No. 113 or nucleic acid sequences with at least 85% sequence homology thereto. The strain may comprise at least ten nucleic acid sequences selected from the group comprising SEQ ID NO. 93 to SEQ ID No. 113 or nucleic acid sequences with at least 85% sequence homology thereto. The strain may comprise at least twelve nucleic acid sequences selected from the group comprising SEQ ID NO. 93 to SEQ ID No. 113 or nucleic acid sequences with at least 85% sequence homology thereto. The strain may comprise at least three nucleic acid sequences selected from the group comprising SEQ ID NO. 93 to SEQ ID No. 113 or nucleic acid sequences with at least 85% sequence homology thereto. The strain may comprise at least thirteen nucleic acid sequences selected from the group comprising SEQ ID NO. 93 to SEQ ID No. 113 or nucleic acid sequences with at least 85% sequence homology thereto. The strain may comprise at least fourteen nucleic acid sequences selected from the group comprising SEQ ID NO. 93 to SEQ ID No. 113 or nucleic acid sequences with at least 85% sequence homology thereto. The strain may comprise at least fifteen nucleic acid sequences selected from the group comprising SEQ ID NO. 93 to SEQ ID No. 113 or nucleic acid sequences with at least 85% sequence homology thereto. The strain may comprise at least sixteen nucleic acid sequences selected from the group comprising SEQ ID NO. 93 to SEQ ID No. 113 or nucleic acid sequences with at least 85% sequence homology thereto. The strain may comprise at least seventeen nucleic acid sequences selected from the group comprising SEQ ID NO. 93 to SEQ ID No. 113 or nucleic acid sequences with at least 85% sequence homology thereto. The strain may comprise at least eighteen nucleic acid sequences selected from the group comprising SEQ ID NO. 93 to SEQ ID No. 113 or nucleic acid sequences with at least 85% sequence homology thereto. The strain may comprise at least nineteen nucleic acid sequences selected from the group comprising SEQ ID NO. 93 to SEQ ID No. 113 or nucleic acid sequences with at least 85% sequence homology thereto. The strain may comprise at least twenty nucleic acid sequences selected from the group comprising SEQ ID NO. 93 to SEQ ID No. 113 or nucleic acid sequences with at least 85% sequence homology thereto. The strain may comprise all twenty one nucleic acid sequences selected from the group comprising SEQ ID NO. 93 to SEQ ID No. 113 or nucleic acid sequences with at least 85% sequence homology thereto.

The strain may not comprise the nucleic acid sequence of SEQ ID No. 112.

The strain may comprise at least one nucleic acid sequence selected from the group comprising SEQ ID No. 114 to SEQ ID No. 132 or nucleic acid sequences with at least 85% sequence homology thereto.

The strain may comprise at least two nucleic acid sequences selected from the group comprising SEQ ID No. 114 to SEQ ID No. 132 or nucleic acid sequences with at least 85% sequence homology thereto. The strain may comprise at least three nucleic acid sequences selected from the group comprising SEQ ID No. 114 to SEQ ID No. 132 or nucleic acid sequences with at least 85% sequence homology thereto. The strain may comprise at least four nucleic acid sequences selected from the group comprising SEQ ID No. 114 to SEQ ID No. 132 or nucleic acid sequences with at least 85% sequence homology thereto. The strain may comprise at least five nucleic acid sequences selected from the group comprising SEQ ID No. 114 to SEQ ID No. 132 or nucleic acid sequences with at least 85% sequence homology thereto. The strain may comprise at least six nucleic acid sequences selected from the group comprising SEQ ID No. 114 to SEQ ID No. 132 or nucleic acid sequences with at least 85% sequence homology thereto. The strain may comprise at least seven nucleic acid sequences selected from the group comprising SEQ ID No. 114 to SEQ ID No. 132 or nucleic acid sequences with at least 85% sequence homology thereto. The strain may comprise at least eight nucleic acid sequences selected from the group comprising SEQ ID No. 114 to SEQ ID No. 132 or nucleic acid sequences with at least 85% sequence homology thereto. The strain may comprise at least nine nucleic acid sequences selected from the group comprising SEQ ID No. 114 to SEQ ID No. 132 or nucleic acid sequences with at least 85% sequence homology thereto. The strain may comprise at least ten nucleic acid sequences selected from the group comprising SEQ ID No. 114 to SEQ ID No. 132 or nucleic acid sequences with at least 85% sequence homology thereto. The strain may comprise at least eleven nucleic acid sequences selected from the group comprising SEQ ID No. 114 to SEQ ID No. 132 or nucleic acid sequences with at least 85% sequence homology thereto. The strain may comprise at least twelve nucleic acid sequences selected from the group comprising SEQ ID No. 114 to SEQ ID No. 132 or nucleic acid sequences with at least 85% sequence homology thereto. The strain may comprise at least thirteen nucleic acid sequences selected from the group comprising SEQ ID No. 114 to SEQ ID No. 132 or nucleic acid sequences with at least 85% sequence homology thereto. The strain may comprise at least fourteen nucleic acid sequences selected from the group comprising SEQ ID No. 114 to SEQ ID No. 132 or nucleic acid sequences with at least 85% sequence homology thereto. The strain may comprise at least fifteen nucleic acid sequences selected from the group comprising SEQ ID No. 114 to SEQ ID No. 132 or nucleic acid sequences with at least 85% sequence homology thereto. The strain may comprise at least sixteen nucleic acid sequence selected from the group comprising SEQ ID No. 114 to SEQ ID No. 132 or nucleic acid sequences with at least 85% sequence homology thereto. The strain may comprise at least seventeen nucleic acid sequences selected from the group comprising SEQ ID No. 114 to SEQ ID No. 132 or nucleic acid sequences with at least 85% sequence homology thereto. The strain may comprise at least eigteens nucleic acid sequence selected from the group comprising SEQ ID No. 114 to SEQ ID No. 132 or nucleic acid sequences with at least 85% sequence homology thereto. The strain may comprise all ninteen nucleic acid sequences selected from the group comprising SEQ ID No. 114 to SEQ ID No. 132 or nucleic acid sequences with at least 85% sequence homology thereto The strain may comprise a single nucleic acid sequence selected from the group comprising SEQ ID No. 114 to SEQ ID No. 132 or nucleic acid sequences with at least sequence homology thereto. The strain may comprise a nucleic acid sequence of SEQ ID No. 132 or a nucleic acid sequence with at least sequence homology thereto.

The strain may comprise two nucleic acid sequences selected from the group comprising SEQ ID No. 114 to SEQ ID No. 132 or nucleic acid sequences with at least 85% sequence homology thereto. The strain may comprise the nucleic acid sequences of SEQ ID No. 131 and SEQ ID No. 132 or nucleic acid sequences with at least 85% sequence homology thereto.

The invention also provides an isolated and purified *Bifidobacterium longum* strain wherein the strain:

a) expresses an exopolysaccharide; and
b) comprises at least two nucleic acid sequences selected from the group comprising SEQ ID NO. 93 to SEQ ID No. 113 or nucleic acid sequences with at least 85% sequence homology thereto; and
c) comprises a nucleic acid sequence of SEQ ID No. 132 or a nucleic acid sequence with at least 85% sequence homology thereto; and/or
d) comprises a nucleic acid sequence of SEQ ID No. 131 or a nucleic acid sequence with at least 85% sequence homology thereto.

In one embodiment, $1\times10^7$ CFU/ml of the strain may induce an [IL10]: [IL12] ratio of at least 10 in a peripheral blood mononuclear cell (PMBC) co-incubation assay. The strain may be in the form of a bacterial broth. The strain may be in the form of a freeze-dried powder.

The invention further provides an isolated and purified *Bifidobacterium longum* strain wherein the strain:

a) expresses an exopolysaccharide; and
b) comprises at least two nucleic acid sequences selected from the group comprising SEQ ID NO. 93 to SEQ ID No. 113 or nucleic acid sequences with at least 85% sequence homology thereto; and
c) comprises a nucleic acid sequence of SEQ ID No. 132 or a nucleic acid sequence with at least 85% sequence homology thereto; and/or a nucleic acid sequence of SEQ ID No. 131 or a nucleic acid sequence with at least 85% sequence homology thereto; and
d) induces an [IL10]: [IL12] ratio of at least 10 in a peripheral blood mononuclear cell (PMBC) co-incubation assay at a concentration of $1\times10^7$ CFU/ml bacteria.

The invention also provides an isolated strain of *Bifidobacterium longum* BL1207 (PTA-9608).

The invention further provides an isolated strain of *Bifidobacterium longum* AH121A (NCIMB 41675).

The invention further still provides an isolated strain of *Bifidobacterium longum* AH1714 (NCIMB 41676).

The isolated strain may be in the form of viable cells. The isolated strain may be in the form of non-viable cells.

The invention also provides a formulation comprising an isolated strain of *Bifidobacterium longum* as described herein. The formulation may comprise an ingestable carrier. The ingestable carrier may be a pharmaceutically acceptable carrier such as a capsule, tablet or powder. The ingestable carrier may be a food product such as acidified milk, yoghurt, frozen yoghurt, milk powder, milk concentrate, cheese spreads, dressings or beverages. The formulation may comprise a strain that is present at more than $10^6$ cfu per gram of ingestable carrier.

The invention further provides a composition comprising an isolated strain of *Bifidobacterium longum* as described herein and a pharmaceutically acceptable carrier.

The invention also provides for the use of a *Bifidobacterium longum* strain as described herein as a probiotic strain.

The invention also provides a method for identifying an exopolysaccharide expressing *Bifidobacterium longum* strain comprising the steps of:

a) obtaining a sample comprising bacteria;
b) extracting nucleic acid from the sample;
c) amplifying the extracted nucleic acid in the presence of at least two primers derived from a nucleic acid sequence selected from the group comprising: SEQ ID No. 2, SEQ ID No. 3, SEQ ID No. 10 to SEQ ID No. 12, SEQ ID No. 93 to SEQ ID No. 132 or a nucleic acid sequence with at least 85% sequence homology thereto;
d) identifying a bacterial strain that expresses an exopolysaccharide.

The primer may comprise at least 10 consecutive bases from a nucleic acid sequence selected from the group comprising: SEQ ID No. 2, SEQ ID No. 3, SEQ ID No. 10 to SEQ ID No. 12 and SEQ ID No. 93 to SEQ ID No. 132.

The primer may comprise a nucleic acid sequence selected from the group comprising: SEQ ID No. 10 to SEQ ID No. 12, SEQ ID No. 13 to SEQ ID No. 92 or a nucleic acid sequence with at least 85% sequence homology thereto.

The step of identifying a bacterial strain that expresses an exopolysaccharide may comprise growing the bacterial strain on a Congo red agar plate.

The sample is a mammalian sample. The sample may be a human derived sample. The sample may be a fecal sample.

The invention also provides for a *Bifidobacterium longum* strain identified by described herein. The *Bifidobacterium longum* strain may be in the form of viable cells. The *Bifidobacterium longum* strain may be in the form of non-viable cells.

The invention further provides for a formulation comprising a *Bifidobacterium longum* strain as described herein. The formulation may comprise an ingestable carrier. The ingestable carrier may be a pharmaceutically acceptable carrier such as a capsule, tablet or powder. The ingestable carrier may be a food product such as acidified milk, yoghurt, frozen yoghurt, milk powder, milk concentrate, cheese spreads, dressings or beverages. The strain may be present at more than $10^6$ cfu per gram of ingestable carrier in the formulation.

The invention also provides a composition comprising a *Bifidobacterium longum* strain as described herein and a pharmaceutically acceptable carrier.

In one embodiment of the invention there is a method for identifying exopolysaccharide secreting bacterial strains comprising the steps of:
- obtaining a sample comprising bacteria;
- extracting DNA from the sample;
- amplifying the extracted DNA in the presence of at least one DNA primer derived from the DNA sequence of SEQ ID No. 2 and/or SEQ ID No. 3; and
- identifying a bacterial strain that expresses an exopolysaccharide.

The extracted DNA may be amplified by real time PCR. The DNA may be amplified in the presence of at least one primer of the nucleic acid sequence of SEQ ID No. 10, SEQ ID No. 11 or SEQ ID No. 12.

The sample may be a human derived sample such as a fecal sample.

In another embodiment, the invention also provides for a bacterial strain identified by the method described herein.

In another embodiment, the invention further provides for the use of a bacterial strain identified by the method described herein as a probiotic bacteria.

In yet another embodiment, the invention also provides a formulation comprising a bacterial strain identified by the method described herein.

In another embodiment, the invention further provides a composition comprising a bacterial strain identified by the method described herein and a pharmaceutically acceptable carrier.

In another embodiment, the invention also provides an isolated bifidobacterial longum strain BL1207 (PTA-9608).

In yet another embodiment, the invention further provides a formulation comprising an isolated bifidobacterial longum strain BL1207 (PTA-9608).

In another embodiment, the invention also provides a composition comprising an isolated bifidobacterial longum strain BL1207 (PTA-9608) and a pharmaceutically acceptable carrier.

In another embodiment, the invention further provides a DNA array/chip comprising at least one polynucleotide derived from the nucleic acid sequence of SEQ ID NO. 1, SEQ ID No. 2, or SEQ ID No. 3.

In one embodiment, the invention also provides a computer readable medium comprising a nucleic acid sequence of SEQ ID NO. 1, SEQ ID No. 2, or SEQ ID No. 3 or parts thereof.

A *Bifidobacterium longum* strain in accordance with an embodiment of the invention may express or produce EPS at a yield of between about 10 mg/L to about 1000 mg/L of bacterial culture.

There are a number of strains of *Bifidobacteria* which are already deposited under the Budapest Treaty. These include the strain deposited at the NCIMB under the number 41003, the genome of which is presented herein. As this is a known strain, this strain is specifically disclaimed for the claims to the strains per se. In so far as the following strains may fall within the scope of the patent claims at the relevant date(s), the following claims are also disclaimed: ATCC BAA-999, CNCM I-1227, CNCM I-1228, CNCM I-2168, CNCM I-2170, CNCM I-2618, CNCM I-3446, CNCM I-3853, CNCM I-3854, CNCM I-3855, NCIMB 41290, NCIMB 41291, NCIMB 41382, NCIMB 41387, NTCC 2705.

BRIEF DESCRIPTION OF THE DRAWINGS

The invention will be more clearly understood from the following description thereof given by way of example only with reference to the accompanying drawings in which.

DETAILED DESCRIPTION OF THE INVENTION

Figure 1:
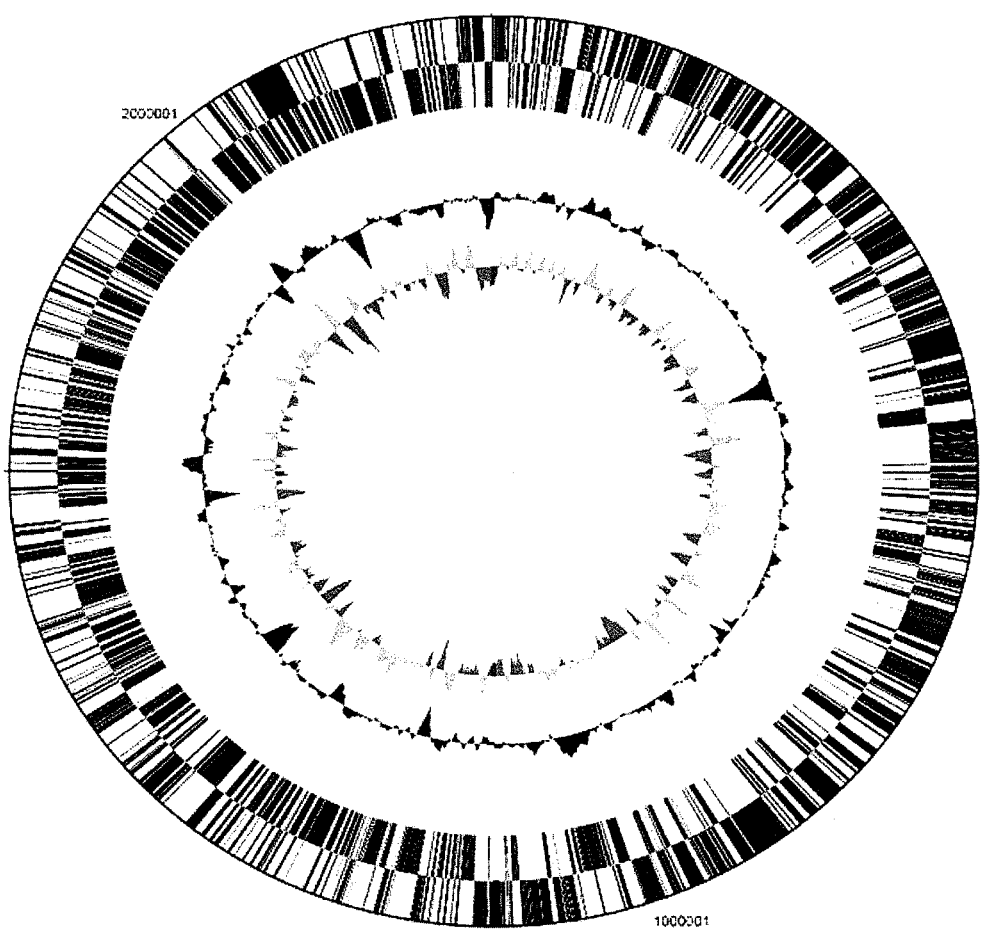
FIG. 1 is a Genome atlas of *Bifidobacterium longum* biotype infantis UCC 35624. The numbers on the genome (1, 1000001, 200001) refer to base pair position. 1 refers to the adenine nucleotide of the ATG start codon of the gene encoding the predicted replication protein. The outer circle (two strands, black and white) refers to the gene density within the chromosome. The second circle (middle circle—black) refers to the GC content and the innermost circle refers to the GC skew.
Figure 2:
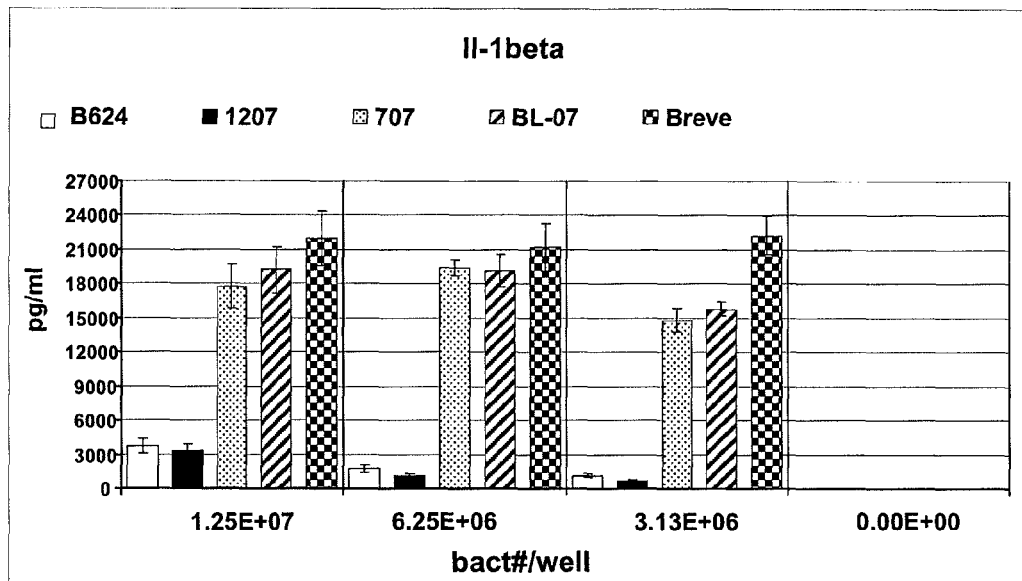
FIG. 2 is a bar chart showing the induction profile of IL-1beta in PBMCs by *Bifidobacterium longum* infantis strain UCC35624 (B624), *Bifidobacterium longum* strain 1207 (BL1207), *Bifidobacterium longum* strain 15707 (BL15707), *Bifidobacterium lactis* (BL-07) and *Bifidobacterium breve* strain 8807 [UCC2003] (breve)
Figure 3:
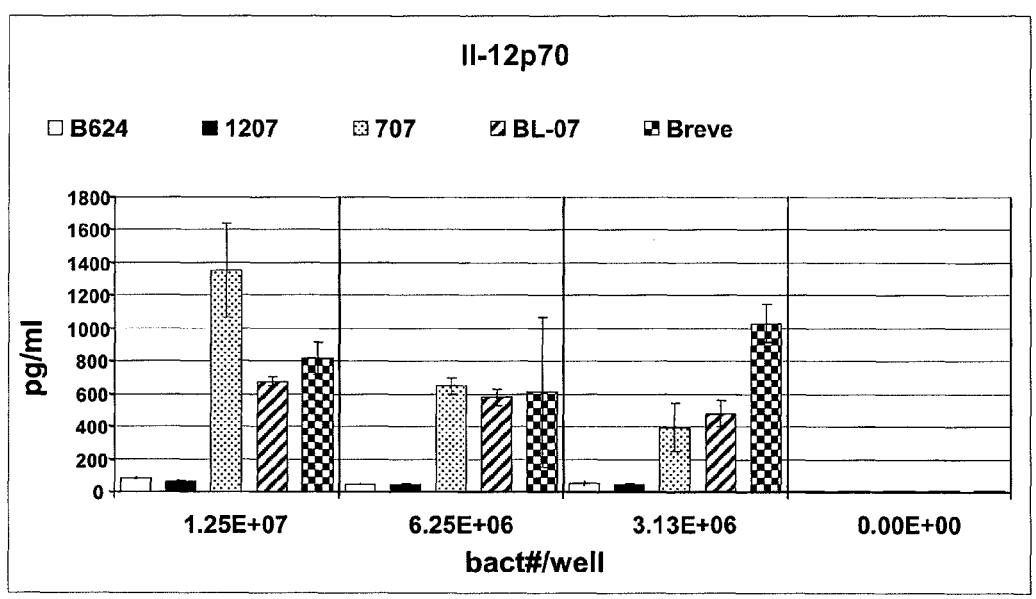
FIG. 3 is a bar chart showing the induction profile of IL-12p70 in PBMCs by *Bifidobacterium longum* infantis strain UCC35624 (B624), *Bifidobacterium longum* strain 1207 (BL1207), *Bifidobacterium longum* strain 15707 (BL15707), *Bifidobacterium lactis* (BL-07) and *Bifidobacterium breve* strain 8807 [UCC2003] (breve)
Figure 4:
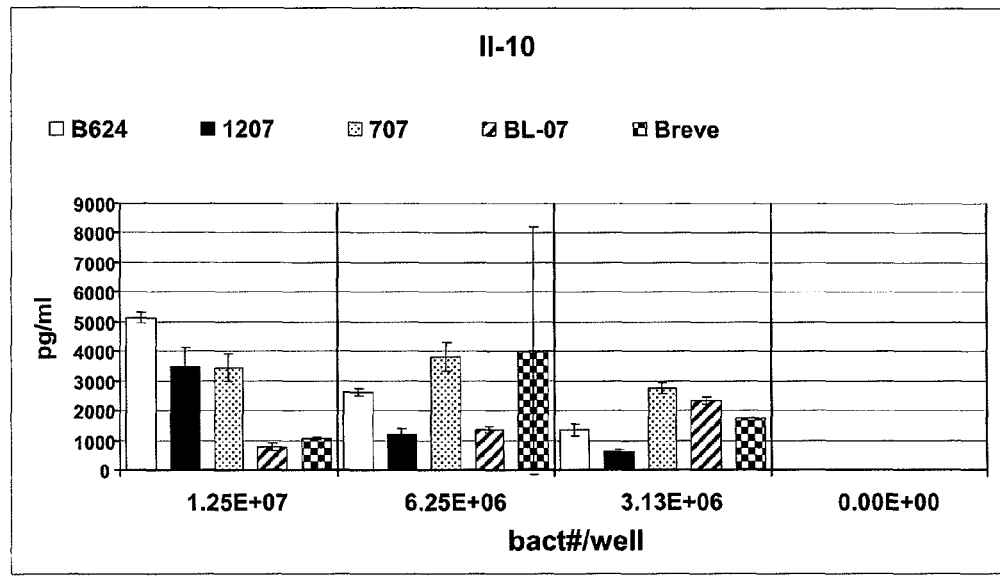
FIG. 4 is a bar chart showing the induction profile of IL-10 in PBMCs by *Bifidobacterium longum* infantis strain UCC35624 (B624), *Bifidobacterium longum* strain 1207 (BL1207), *Bifidobacterium longum* strain 15707 (BL15707), *Bifidobacterium lactis* (BL-07) and *Bifidobacterium breve* strain 8807 [UCC2003] (breve)
Figure 5:
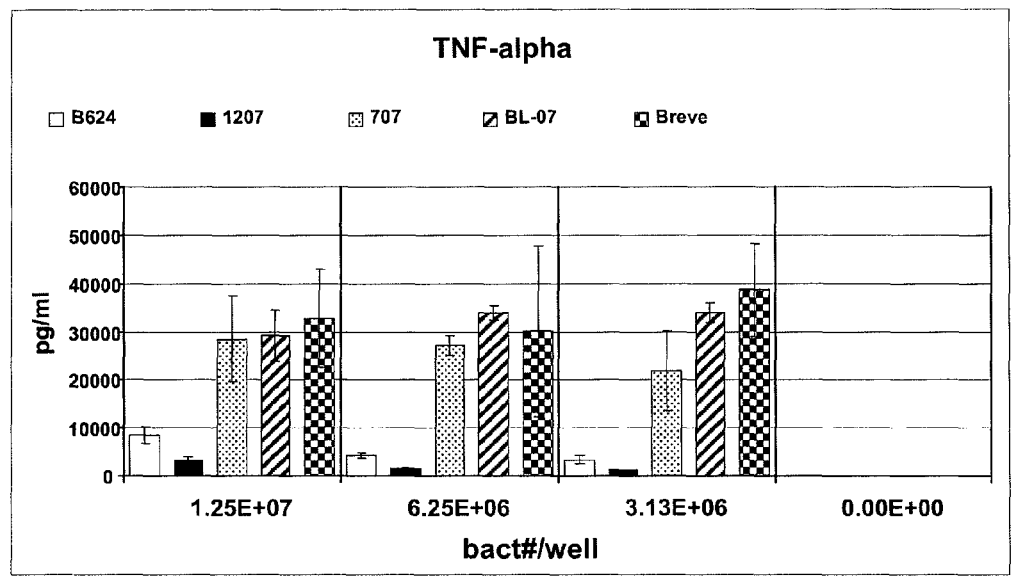
FIG. 5 is a bar chart showing the induction profile of TNF-alpha in PBMCs by *Bifidobacterium longum* infantis strain UCC35624 (B624), *Bifidobacterium longum* strain 1207 (BL1207), *Bifidobacterium longum* strain 15707 (BL15707), *Bifidobacterium lactis* (BL-07) and *Bifidobacterium breve* strain 8807 [UCC2003] (breve).
Figure 6:
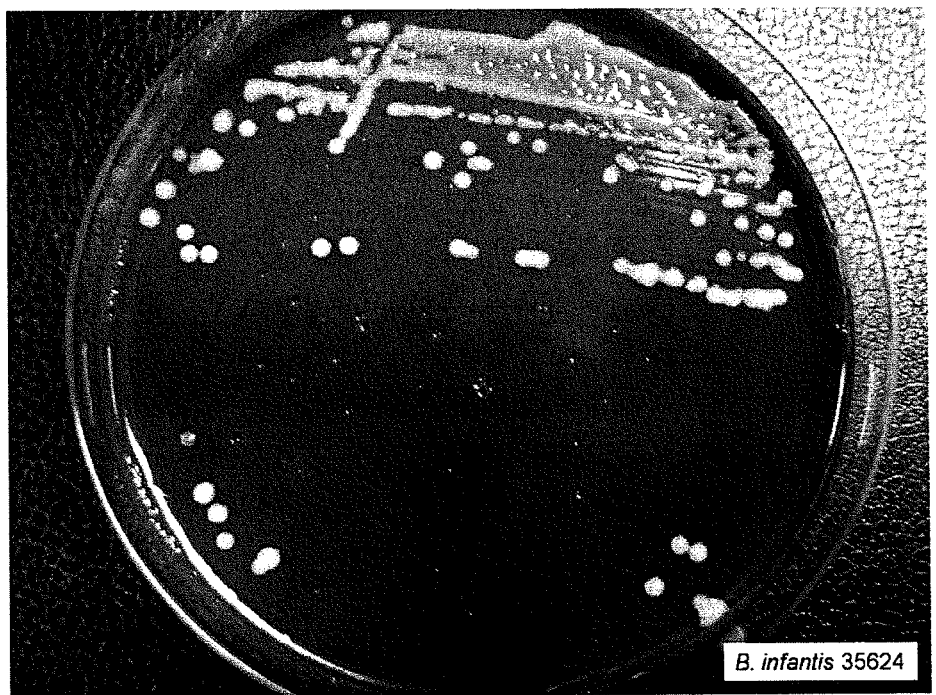
FIG. 6 is a photograph of *B. longum* 35624 grown on a Congo Red Agar plate.
Figure 7:
FIG. 7 is a photograph of *B. longum* AH121A grown on a Congo Red Agar plate.
Figure 8:
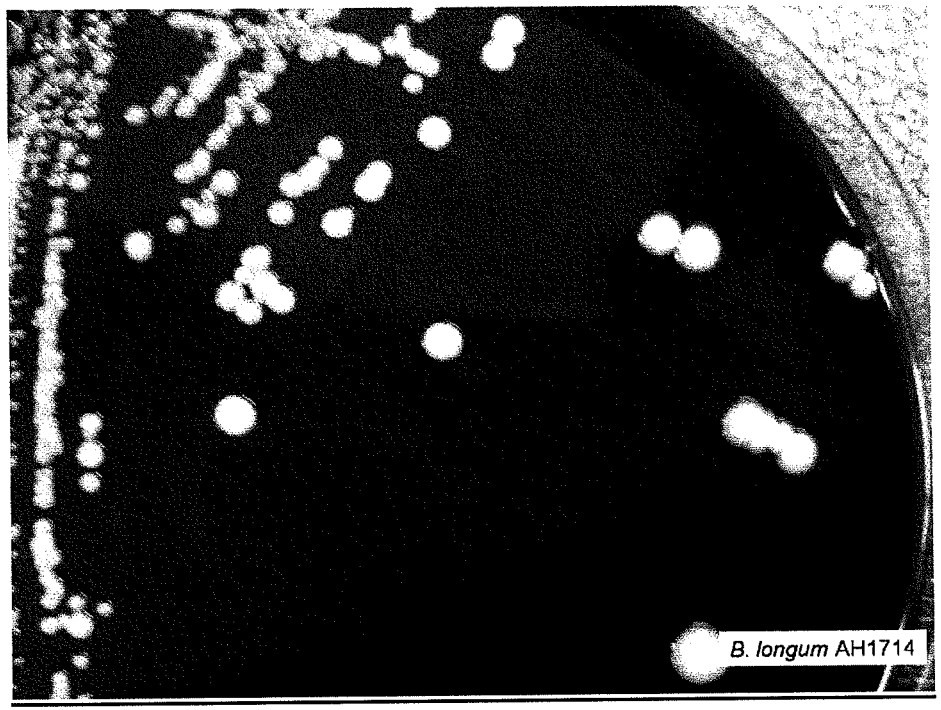
FIG. 8 is a photograph of *B. longum* AH1714 grown on a Congo Red Agar plate.
Figure 9:
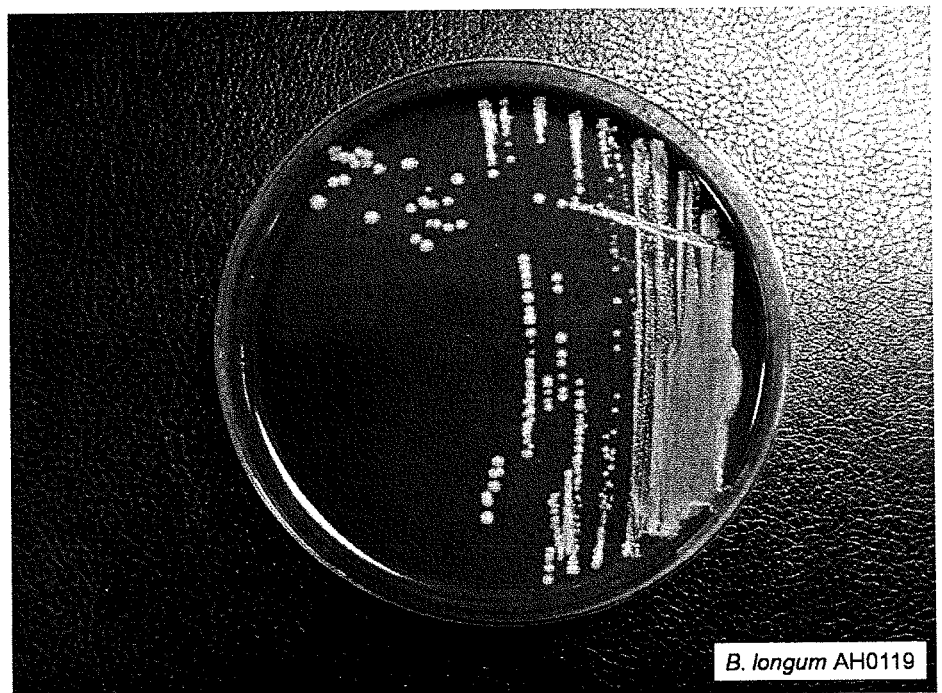
FIG. 9 is a photograph of *B. longum* AH0119 grown on a Congo Red Agar plate.
Figure 10:
FIG. 10 is a photograph of *B. breve* UCC2003 grown on a Congo Red Agar plate.
Figure 11:
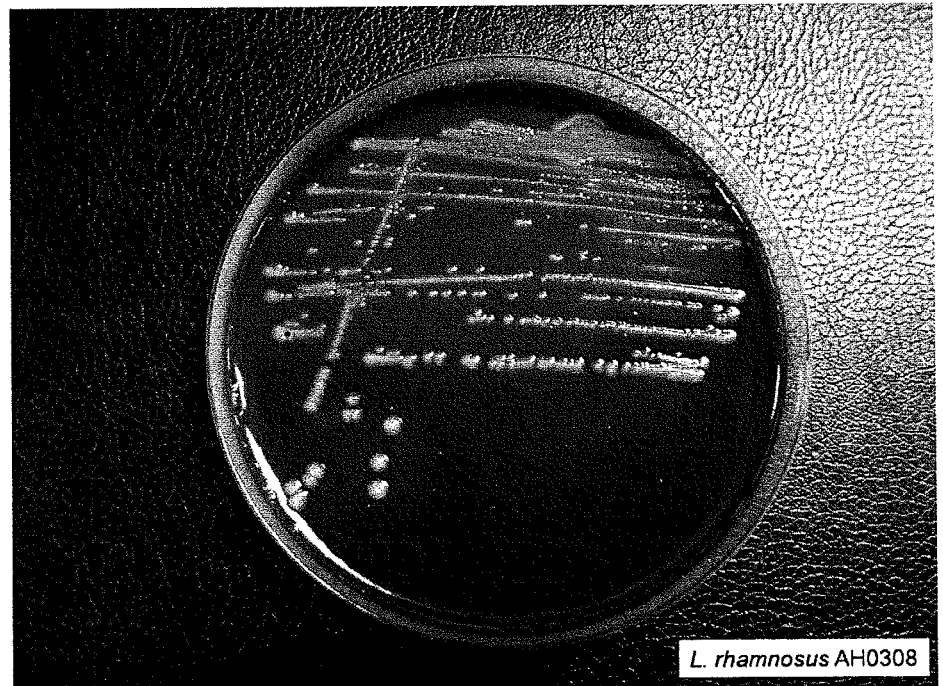
FIG. 11 is a photograph of *L. Rhamnosus* AH308 grown on a Congo Red Agar plate.
Figure 12:
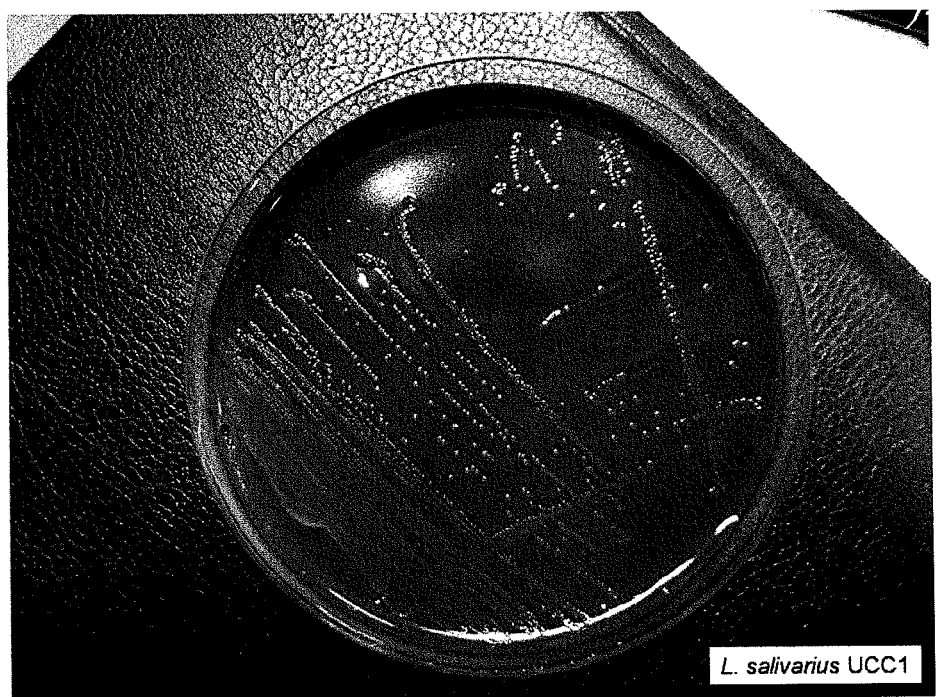
FIG. 12 is a photograph of *L. salivarius* UCC1 grown on a Congo Red Agar plate.

Disclosed herein is an isolated polynucleotide of SEQ ID No. 1. The polynucleotide of SEQ ID No. 1 encodes a strain of *Bifidobacterium*. The *Bifidobacterium* encoded by the isolated polynucleotide sequence has a number of unique genes. The unique genes encoded by the polynucleotide have a unique order in the sequence of SEQ ID No. 1. As used herein, the term "unique genes", mean genes that are not found in the currently available sequences of Bifodobacterium. As used herein, the term "unique order", means that the position/sequence of the genes in the polynucleotide is not found in the currently available sequences of Bifodobacterium. The unique genes present in the isolated polynucleotide may be interspersed with nucleic acid residues that code for other (known) genes or stretches of non-coding sequence but the overall order/sequence of the unique genes in the isolated polynucleotide is in itself unique compared to the order of genes found in the currently available sequences of *Bifodobacterium*.

The polynucleotide was isolated from a strain of the bacterial species *Bifidobacterium longum* biotype infantis with the strain designation UCC 35624. A deposit of *Bifidobacterium longum* biotype infantis strain UCC 35624 was made at the National Collections of Industrial and Marine Bacteria Limited (NCIMB) Ferguson Building, Craibstone Estate, Bucksburn, Aberdeen, AB21 9YA, Scotland, UK on Jan. 13, 1999 and accorded the accession number NCIMB 41003.

A deposit of *Bifidobacteria infantis* strain BL1207 was made at the American Type Culture Collection (ATTC) 10801 University Boulevard, Manassas, Va. 20110-2209, USA on Nov. 14, 2008 and accorded the accession number PTA-9608.

A deposit of *Bifidobacterium longum* strain AH121A was made at the National Collections of Industrial and Marine Bacteria Limited (NCIMB) Ferguson Building, Craibstone Estate, Bucksburn, Aberdeen, AB21 9YA, Scotland, UK on Nov. 5, 2009 and accorded the accession number NCIMB 41675.

A deposit of *Bifidobacterium longum* strain AH1714 was made at the National Collections of Industrial and Marine Bacteria Limited (NCIMB) Ferguson Building, Craibstone Estate, Bucksburn, Aberdeen, AB21 9YA, Scotland, UK on Nov. 5, 2009 and accorded the accession number NCIMB 41676.

Given the size of the isolated polynucleotide it would not be uncommon for a point mutation or some other form of mutation to be present in the sequence. As such we encompass variants of SEQ ID No. 1 in the disclosure. As used herein, the term "variants", means strains of *Bifidobacteria* that have a sequence identity of at least 99.5% or more with SEQ ID No. 1.

SEQ ID No. 1 contains a large number of open reading frames which represent the predicted genes. We have identified 1,836 protein coding regions or genes within this polynucleotide. As such, our disclosure encompasses fragments of the polynucleotide of SEQ ID No. 1. The fragments may correspond to portions of the polynucleotide sequence that encode one or more proteins. Alternatively, the fragments may correspond to portions of the polynucleotide sequence that specify part of a gene or genes for example the fragment may correspond to a portion of the polynucleotide sequence that spans a part of two or more genes.

The sequence of SEQ ID No. 1 is a DNA polynucleotide sequence, our disclosure encompasses sequences that are complementary to the DNA sequence for example complementary DNA (cDNA) or RNA sequences including messenger RNA (mRNA) and transfer RNA (tRNA) or protein sequences such as amino acid sequences encoded by the polynucleotide sequence.

The polynucleotide of SEQ ID No.1 and complementary sequences thereof may take many forms for example an isolated polynucleotide sequence; an isolated protein sequence; a biologically pure culture of a Bifidobacterial strain comprising the nucleic acid of SEQ ID NO. 1; a plasmid comprising the polynucleotide of SEQ ID No. 1; and the like. All of these forms of the sequence of SEQ ID No. 1 are encompassed in this disclosure.

As used herein, the term "expresses an exopolysaccharide", may be interpreted to mean that a bacterial strain contains a DNA sequence encoding an exopolysaccharide for example a DNA sequence that encodes at least one gene from SEQ ID No. 2 and/or at least one gene from SEQ ID No. 3 or a functional fragment or variant thereof.

As used herein, the term "sequence homology" encompasses sequence homology at a nucleic acid and/or an amino acid (protein) level. Sequence homology is indicated as the overall percentage of identity across the nucleic acid and/or amino acid sequence. The sequence homology may be determined using standard techniques known to those skilled in the art. For example sequence homology may be determined using the on-line homology algorithm "BLAST" program, publicly available at. A sequence may have at least 85% or at least 86% or at least 87% or at least 88% or at least 89% or at lest 90% or at least 91% or at least 92% or at least 93% or at least 94% or at least 95% or at least 96% or at least 97% or at least 98% or at least 99% sequence homology with the nucleic acid sequences described herein or the amino acid (protein) encoded thereby.

The present invention is based on the whole genome sequence of *Bifidobacterium longum* biotype infantis UCC 35624. The genome sequence is listed in SEQ ID No. 1 of the attached sequence listing and comprises 2,264374 base pairs. Analysis of the genome sequence identified 1,836 genes having the open reading frames as set out in Table 1 below.

TABLE 1

| GeneID | Start | End | Strand | Description |
| --- | --- | --- | --- | --- |
| BI00001 | 1667321 | 1667608 | − | CRISPR-associated protein Cas2 |
| BI00002 | 1667697 | 1668593 | − | CRISPR-associated protein Cas1 |
| BI00002a | 1668725 | 1669423 | − | CRISPR-associated protein Cas4 |
| BI00003 | 1669465 | 1670313 | − | CRISPR-associated protein, TM1801 family |
| BI00004 | 1670320 | 1672275 | − | CRISPR-associated protein, CT1133 family |
| BI00005 | 1672281 | 1672982 | − | CRISPR-associated protein, CT1134 family |
| BI00006 | 1672992 | 1675427 | − | hypothetical CRISPR-associated helicase Cas3 |
| BI00007 | 1676109 | 1676426 | − | COG3464: Transposase and inactivated derivatives |
| BI00008 | 1677053 | 1680283 | − | isoleucyl-tRNA synthetase |
| BI00009 | 1680955 | 1682163 | + | aminotransferase, class I, putative |
| BI00010 | 1682280 | 1683785 | − | galactoside symporter |
| BI00011 | 1684111 | 1687299 | + | beta-galactosidase, putative |
| BI00012 | 1687365 | 1688372 | − | sugar-binding transcriptional regulator, LacI family, putative |
| BI00013 | 1688522 | 1689889 | − | Putative antibiotic resistance protein (membrane protein) |
| BI00014 | 1690007 | 1690906 | − | hypothetical pfkB family carbohydrate kinase |
| BI00015 | 1690909 | 1692111 | − | alcohol dehydrogenase, iron-containing |
| BI00016 | 1692111 | 1692794 | − | hypothetical haloacid dehalogenase-like hydrolase |
| BI00017 | 1692921 | 1693901 | − | inosine-uridine preferring nucleoside hydrolase |
| BI00018 | 1693960 | 1694913 | − | hypothetical pfkB family carbohydrate kinase |
| BI00019 | 1694909 | 1695553 | − | hypothetical N-(5'phosphoribosyl)anthranilate isomerase |
| BI00020 | 1695603 | 1696415 | − | ABC transporter, ATP-binding protein |
| BI00021 | 1696415 | 1697242 | − | conserved hypothetical protein |
| BI00022 | 1697246 | 1698055 | − | hypothetical Cobalt transport protein |
| BI00023 | 1698062 | 1698712 | − | conserved hypothetical protein |
| BI00024 | 1698969 | 1700846 | + | transcriptional regulator, LacI family/carbohydrate kinase, PfkB family protein |
| BI00026 | 1700977 | 1702989 | − | ABC transporter, ATP-binding/permease protein |
| BI00027 | 1702989 | 1704944 | − | ABC transporter, ATP-binding protein |
| BI00028 | 1704944 | 1705402 | − | transcriptional regulator, MarR family, putative |
| BI00029 | 1705699 | 1706610 | − | COG1472: Beta-glucosidase-related glycosidases |
| BI00030 | 1706029 | 1706937 | + | COG1309: Transcriptional regulator |
| BI00031 | 1707015 | 1708373 | − | unnamed protein product |
| BI00032 | 1708509 | 1710902 | − | xylosidase/arabinosidase [imported] |
| BI00033 | 1710937 | 1711287 | − | hypothetical protein |
| BI00034 | 1711383 | 1712762 | − | glutamate--cysteine ligase, putative |
| BI00035 | 1712905 | 1718037 | + | conserved domain protein |
| BI00036 | 1718044 | 1718883 | + | hypothetical protein |
| BI00037 | 1719052 | 1724187 | − | BadF/BadG/BcrA/BcrD ATPase family family |
| BI00038 | 1724418 | 1725143 | − | anaerobic ribonucleoside-triphosphate reductase activating protein |
| BI00039 | 1725294 | 1727699 | − | anaerobic ribonucleoside-triphosphate reductase |
| BI00040 | 1728167 | 1729534 | + | exodeoxyribonuclease VII, large subunit |
| BI00041 | 1729587 | 1729886 | + | exodeoxyribonuclease VII, small subunit |
| BI00042 | 1730013 | 1730534 | + | NADP(H) oxidoreductase CC0205 [imported] |
| BI00043 | 1730676 | 1732529 | − | long-chain-fatty-acid--CoA ligase, putative |
| BI00044 | 1732662 | 1732787 | − | COG1970: Large-conductance mechanosensitive channel |
| BI00045 | 1732765 | 1733166 | − | hypothetical Large-conductance mechanosensitive channel, MscL |
| BI00046 | 1733337 | 1733762 | − | UNKNOWN PROTEIN, putative |
| BI00047 | 1733887 | 1734102 | − | COG0454: Histone acetyltransferase HPA2 and related acetyltransferases |
| BI00048 | 1734587 | 1735696 | + | hypothetical transmembrane protein with unknown function |
| BI00049 | 1735718 | 1736683 | − | exopolyphosphatase, putative |
| BI00050 | 1736864 | 1737967 | − | aminotransferase, class I |
| BI00051 | 1738178 | 1739230 | + | oxidoreductase, Gfo/Idh/MocA family, putative |
| BI00052 | 1739267 | 1739779 | − | patch repair protein [imported] |
| BI00053 | 1739931 | 1740377 | + | acetyltransferase, GNAT family |
| BI00054 | 1740356 | 1740841 | − | conserved hypothetical protein |
| BI00055 | 1741026 | 1745207 | − | helicase, Snf2 family |
| BI00056 | 1745285 | 1746367 | + | conserved hypothetical protein |
| BI00057 | 1746358 | 1746504 | − | hypothetical protein |
| BI00058 | 1746604 | 1747620 | + | tetrahydrodipicolinate N-succinyltransferase (dapD) |
| BI00059 | 1747840 | 1749129 | − | citrate synthase I |
| BI00060 | 1749406 | 1750242 | − | methionine aminopeptidase, type I |
| BI00061 | 1750378 | 1751355 | − | membrane protein, putative |
| BI00062 | 1751532 | 1753703 | + | belongs to peptidase family M13 |
| BI00063 | 1753792 | 1754526 | − | single-stranded DNA-binding protein (ssb) subfamily |

TABLE 1-continued

Open reading frames of the genome of UCC 35624.

| GeneID | Start | End | Strand | Description |
|---|---|---|---|---|
| BI00064 | 1754805 | 1756616 | − | prolyl-tRNA synthetase |
| BI00065 | 1757008 | 1757361 | + | hypothetical protein |
| BI00066 | 1757392 | 1758561 | − | pflA |
| BI00067 | 1758551 | 1760338 | − | Protein of unknown function family |
| BI00068 | 1760391 | 1761806 | − | TPR domain protein |
| BI00069 | 1761858 | 1762505 | − | oligoribonuclease |
| BI00070 | 1762676 | 1764259 | − | inosine-5'-monophosphate dehydrogenase |
| BI00071 | 1764282 | 1765562 | − | undecaprenyl-phosphate alpha-N-acetylglucosaminyltransferase |
| BI00072 | 1765562 | 1766233 | − | Sua5/YciO/YrdC/YwlC family protein |
| BI00073 | 1766408 | 1767082 | + | maltose O-acetyltransferase |
| BI00074 | 1767220 | 1767921 | − | branched-chain amino acid ABC transporter, ATP-binding protein |
| BI00075 | 1767924 | 1768781 | − | branched chain amino acid ABC transporter, ATP-binding protein |
| BI00076 | 1768781 | 1769854 | − | branched-chain amino acid ABC transporter, permease protein |
| BI00077 | 1769874 | 1770797 | − | branched-chain amino acid ABC transporter, permease protein |
| BI00078 | 1771042 | 1772226 | − | branched-chain amino acid ABC transporter, amino acid-binding protein, putative |
| BI00079 | 1772502 | 1773407 | − | N-methylase PapM |
| BI00080 | 1773473 | 1774492 | − | peptide chain release factor 1 |
| BI00003g | 1774715 | 1774924 | − | ribosomal protein L31 |
| BI00081 | 1775256 | 1776482 | − | transcription regulator ROK family VC2007 [imported], putative |
| BI00082 | 1776702 | 1778219 | + | xylulokinase |
| BI00083 | 1778416 | 1778760 | + | lipoprotein, putative |
| BI00084 | 1778773 | 1779114 | + | hypothetical protein |
| BI00085 | 1779393 | 1779737 | − | possible sugar permease |
| BI00086 | 1779656 | 1780930 | − | transposase, Mutator family |
| BI00087 | 1781199 | 1782545 | − | xylose isomerase |
| BI00088 | 1782842 | 1783072 | + | drug resistance transporter, EmrB/QacA subfamily |
| BI00089 | 1783095 | 1783409 | + | drug resistance transporter, EmrB/QacA subfamily |
| BI00090 | 1783425 | 1784222 | − | conserved hypothetical protein |
| BI00091 | 1785149 | 1785661 | − | polypeptide deformylase |
| BI00092 | 1785576 | 1786421 | − | oxidoreductase, aldo/keto reductase family superfamily |
| BI00093 | 1786497 | 1786673 | − | COG0477: Permeases of the major facilitator superfamily |
| BI00094 | 1786761 | 1787264 | − | hypothetical COG0477: Permeases of the major facilitator superfamily |
| BI00095 | 1787291 | 1787791 | − | possible MarR-type transcriptional regulator |
| BI00011g | 1787998 | 1788333 | − | hypothetical protein Blon02136 |
| BI00096 | 1788358 | 1789572 | − | sugar ABC transporter, permease protein |
| BI00097 | 1789575 | 1791125 | − | sugar ABC transporter, ATP-binding protein |
| BI00098 | 1791229 | 1792383 | − | sugar ABC transporter, periplasmic sugar-binding protein |
| BI00099 | 1792462 | 1792608 | − | hypothetical protein |
| BI00100 | 1792854 | 1793801 | + | probable repressor protein in (NagC/XylR) family |
| BI00101 | 1793842 | 1794705 | + | sugar ABC transporter, ATP-binding protein, putative |
| BI00102 | 1794736 | 1795683 | − | glucokinase, putative |
| BI00103 | 1796537 | 1798192 | + | ATP binding protein of ABC transporter |
| BI00104 | 1798507 | 1799409 | + | acyl-CoA thioesterase II |
| BI00105 | 1799511 | 1800035 | − | hypothetical membrane protein with unknown function |
| BI00106 | 1800213 | 1801622 | − | dihydroneopterin aldolase |
| BI00107 | 1801736 | 1802608 | − | dihydropteroate synthase |
| BI00108 | 1802699 | 1803295 | − | GTP cyclohydrolase I |
| BI00109 | 1803391 | 1805478 | − | cell division protein FtsH |
| BI00110 | 1805478 | 1806038 | − | hypoxanthine phosphoribosyltransferase |
| BI00111 | 1806028 | 1807191 | − | COG0037: Predicted ATPase of the PP-loop superfamily implicated |
| BI00112 | 1807285 | 1808772 | − | D-alanyl-D-alanine carboxypeptidase/D-alanyl-D-alanine-endopeptidase |
| BI00113 | 1808798 | 1810468 | − | hypothetical transmembrane protein with unknown function |
| BI00114 | 1810468 | 1811421 | − | ATP-binding protein of ABC transporter system |
| BI00115 | 1811519 | 1812739 | − | glycosyl transferase domain protein, putative |
| BI00116 | 1812742 | 1814496 | − | hypothetical integral membrane protein in upfo118 |
| BI00117 | 1814587 | 1815252 | + | probable glycosyltransferase |
| BI00118 | 1815481 | 1816629 | − | alcohol dehydrogenase, iron-containing |

TABLE 1-continued

Open reading frames of the genome of UCC 35624.

| GeneID | Start | End | Strand | Description |
| --- | --- | --- | --- | --- |
| BI00119 | 1817069 | 1818370 | + | cyclopropane-fatty-acyl-phospholipid synthase |
| BI00120 | 1818383 | 1819687 | + | hypothetical COG0477: Permeases of the major facilitator superfamily |
| BI00121 | 1820205 | 1821215 | − | UDP-glucose 4-epimerase |
| BI00122 | 1821585 | 1822400 | + | methyltransferase, putative |
| BI00123 | 1822698 | 1823195 | − | hypothetical protein |
| BI00124 | 1823244 | 1823708 | − | Orf2 |
| BI00125 | 1823795 | 1824079 | + | hypothetical Helix-turn-helix |
| BI00126 | 1824492 | 1824788 | − | hypothetical protein |
| BI00127 | 1825086 | 1826453 | − | gp22 |
| BI00128 | 1827148 | 1827699 | − | hypothetical protein |
| BI00170t | 1827699 | 1828901 | − | hypothetical Phage integrase family |
| BI00129 | 1829429 | 1830229 | + | azlC protein, putative |
| BI00130 | 1830229 | 1830558 | + | branched-chain amino acid permease |
| BI00131 | 1830743 | 1831258 | − | phosphotyrosine protein phosphatase, putative |
| BI00132 | 1831385 | 1832044 | − | dihydrofolate reductase |
| BI00133 | 1832157 | 1832936 | − | thymidylate synthase |
| BI00134 | 1833154 | 1833564 | + | conserved hypothetical protein |
| BI00135 | 1833629 | 1834663 | − | demannu, putative |
| BI00136 | 1834835 | 1835572 | − | P60 extracellular protein, invasion associated protein Iap |
| BI00137 | 1835733 | 1836476 | − | NLP/P60 family domain protein |
| BI00138 | 1836692 | 1837645 | − | N-acetylmuramoyl-L-alanine amidase domain protein |
| BI00139 | 1838255 | 1839178 | + | phosphoserine aminotransferase, putative |
| BI00140 | 1839305 | 1839562 | + | conserved hypothetical protein |
| BI00141 | 1839693 | 1840874 | − | sensor histidine kinase, putative |
| BI00142 | 1841128 | 1841745 | + | phosphate transport system regulatory protein PhoU, putative |
| BI00143 | 1842110 | 1842847 | − | phosphoglycerate mutase |
| BI00144 | 1842910 | 1843872 | − | 1,4-dihydroxy-2-naphthoate octaprenyltransferase |
| BI00145 | 1843937 | 1845412 | − | lysyl-tRNA synthetase |
| BI00146 | 1846534 | 1847304 | + | AraJ-like protein probably involved in transport of arabinose polymers |
| BI00147 | 1847394 | 1849754 | + | TPR Domain domain protein |
| BI00148 | 1849833 | 1850462 | + | conserved hypothetical protein |
| BI00149 | 1850618 | 1852216 | − | hypothetical membrane protein possibly involved in transport |
| BI00150 | 1852325 | 1853029 | − | conserved hypothetical protein |
| BI00151 | 1853062 | 1854903 | − | conserved hypothetical protein |
| BI00152 | 1854930 | 1856174 | + | possible histidine kinase sensor of two component system |
| BI00153 | 1856174 | 1856866 | + | transcription regulator, LuxR family NMB1250 [imported] |
| BI00154 | 1856920 | 1857939 | − | UDP-glucose 4-epimerase |
| BI00155 | 1858012 | 1859556 | − | galactose-1-phosphate uridylyltransferase |
| BI00156 | 1859606 | 1860682 | − | putative desulfatase possibly for mucin |
| BI00157 | 1860713 | 1862965 | − | conserved hypothetical protein |
| BI00158 | 1863426 | 1864382 | − | sugar ABC transporter, permease protein |
| BI00159 | 1864382 | 1865278 | − | sugar ABC transporter, permease protein, putative |
| BI00160 | 1865546 | 1866859 | − | solute binding protein of ABC transporter for sugars |
| BI00161 | 1867217 | 1867369 | − | hypothetical protein |
| BI00162 | 1867867 | 1868856 | − | seryl-tRNA synthetase |
| BI00163 | 1869384 | 1870562 | + | Diacylglycerol kinase catalytic domain (presumed) protein |
| BI00164 | 1870573 | 1871409 | − | transcription antiterminator, BglG family, putative |
| BI00165 | 1871430 | 1873829 | − | PTS system component, putative |
| BI00166 | 1874293 | 1875843 | + | major facilitator family transporter CC0814 [imported], putative |
| BI00167 | 1875934 | 1877607 | + | phosphoglucomutase, alpha-D-glucose phosphate-specific |
| BI00222t | 1878343 | 1879437 | − | conserved hypothetical protein |
| BI00168 | 1879668 | 1880087 | + | conserved hypothetical protein |
| BI00169 | 1880224 | 1881837 | + | oxidoreductase, pyridine nucleotide-disulfide, class I |
| BI00170 | 1882002 | 1882151 | − | hypothetical protein |
| BI00171 | 1882305 | 1883360 | + | RNase H |
| BI00172 | 1883494 | 1884189 | + | ribose 5-phosphate isomerase |
| BI00173 | 1884629 | 1885258 | − | conserved hypothetical protein |
| BI00174 | 1885386 | 1886921 | + | DNA repair protein RadA |
| BI00175 | 1886942 | 1888063 | − | riboflavin biosynthesis protein RibF |
| BI00176 | 1888164 | 1889324 | − | tRNA pseudouridine synthase B |
| BI00177 | 1889329 | 1889799 | − | ribosome-binding factor A |
| BI00178 | 1889953 | 1892799 | − | translation initiation factor IF-2 |
| BI00179 | 1893150 | 1894214 | − | N utilization substance protein A |

TABLE 1-continued

Open reading frames of the genome of UCC 35624.

| GeneID | Start | End | Strand | Description |
|---|---|---|---|---|
| BI00180 | 1894422 | 1895147 | + | lipoprotein, putative |
| BI00181 | 1895194 | 1896234 | − | transcriptional regulator, LacI family, putative |
| BI00182 | 1896528 | 1896629 | − | hypothetical protein |
| BI00183 | 1896770 | 1897798 | − | hypothetical |
| BI00184 | 1897936 | 1898568 | − | alpha-L-arabinosidase |
| BI00185 | 1899147 | 1899917 | − | Transglutaminase-like superfamily domain protein |
| BI00186 | 1900154 | 1902331 | − | Domain of unknown function (DUF404) family |
| BI00187 | 1902473 | 1902586 | − | hypothetical protein |
| BI00188 | 1902727 | 1903515 | + | tRNA pseudouridine synthase A |
| BI00189 | 1903603 | 1904142 | − | ribosomal protein L17 |
| BI00190 | 1904245 | 1905237 | − | RNA polymerases L/13 to 16 kDa subunit |
| BI00191 | 1905321 | 1905716 | − | ribosomal protein S11 |
| BI00192 | 1905807 | 1906181 | − | ribosomal protein S13p/S18e |
| BI00193 | 1906333 | 1906443 | − | ribosomal protein L36 |
| BI00194 | 1906470 | 1906685 | − | translation initiation factor IF-1 |
| BI00195 | 1906865 | 1907422 | − | adenylate kinase |
| BI00196 | 1907595 | 1908722 | − | preprotein translocase, SecY subunit |
| BI00197 | 1909207 | 1909656 | − | ribosomal protein L15 |
| BI00198 | 1909662 | 1909844 | − | ribosomal protein L30 |
| BI00199 | 1909853 | 1910581 | − | ribosomal protein S5 |
| BI00200 | 1910581 | 1910991 | − | ribosomal protein L18 |
| BI00201 | 1910954 | 1911490 | − | ribosomal protein L6 |
| BI00202 | 1911511 | 1911906 | − | ribosomal protein S8 |
| BI00203 | 1911999 | 1912181 | − | ribosomal protein S14p/S29e |
| BI00204 | 1912186 | 1912755 | − | ribosomal protein L5 VC2584 [imported] |
| BI00205 | 1912755 | 1913087 | − | ribosomal protein L24 |
| BI00206 | 1913092 | 1913457 | − | ribosomal protein L14 |
| BI00207 | 1913555 | 1913812 | − | ribosomal protein S17 |
| BI00208 | 1913818 | 1914066 | − | ribosomal protein L29 |
| BI00209 | 1914069 | 1914485 | − | ribosomal protein L16 |
| BI00210 | 1914495 | 1915295 | − | ribosomal protein S3 |
| BI00211 | 1915301 | 1915657 | − | ribosomal protein L22 |
| BI00212 | 1915677 | 1915952 | − | ribosomal protein S19 |
| BI00213 | 1915971 | 1916798 | − | ribosomal protein L2 |
| BI00214 | 1916838 | 1917131 | − | ribosomal protein L23 |
| BI00215 | 1917140 | 1917793 | − | ribosomal protein L4/L1 family |
| BI00216 | 1917803 | 1918441 | − | ribosomal protein L3 |
| BI00217 | 1918461 | 1918766 | − | ribosomal protein S10 |
| BI00218 | 1919023 | 1920027 | + | membrane protein, putative |
| BI00219 | 1920366 | 1923092 | − | Unknown |
| BI00220 | 1923607 | 1924797 | + | probable repressor in the Rok (NagC/XylR) family |
| BI00221 | 1924797 | 1927334 | + | glycogen operon protein GlgX |
| BI00222 | 1927431 | 1927919 | − | ribosomal protein S9 |
| BI00223 | 1927945 | 1928391 | − | ribosomal protein L13 |
| BI00224 | 1928792 | 1930954 | − | 4-alpha-glucanotransferase |
| BI00225 | 1931125 | 1931931 | − | hypothetical Leucine rich repeat variant |
| BI00226 | 1931876 | 1932514 | − | conserved hypothetical protein TIGR00257 |
| BI00227 | 1932579 | 1933592 | − | possible 2-hydroxyacid dehydrogenase |
| BI00228 | 1933669 | 1935009 | − | capA protein, putative |
| BI00229 | 1935547 | 1936608 | − | COG0697: Permeases of the drug/metabolite transporter (DMT) superfamily |
| BI00230 | 1936648 | 1937991 | + | DNA-damage-inducible protein P |
| BI00231 | 1938024 | 1939256 | − | aminotransferase, putative |
| BI00232 | 1939374 | 1939691 | − | fdxC |
| BI00233 | 1939755 | 1941278 | − | possible cationic amino acid transporter |
| BI00234 | 1941433 | 1942398 | − | UDP-N-acetylenolpyruvoylglucosamine reductase |
| BI00235 | 1942930 | 1943094 | − | ribosomal protein L33 |
| BI00236 | 1943529 | 1944245 | + | possible cystathionine gamma lyase |
| BI00237 | 1944924 | 1945214 | − | chaperonin, 10 kDa |
| BI00238 | 1945390 | 1946604 | − | conserved hypothetical protein |
| BI00239 | 1946895 | 1947557 | − | rimJ |
| BI00240 | 1947644 | 1948360 | + | 5-formyltetrahydrofolate cyclo-ligase-related protein |
| BI00241 | 1948527 | 1948709 | + | conserved hypothetical protein |
| BI00242 | 1948950 | 1949516 | + | conserved hypothetical protein |
| BI00243 | 1949617 | 1949814 | − | hypothetical protein Blon021580 |
| BI00244 | 1949820 | 1953440 | − | conserved hypothetical protein |
| BI00245 | 1953452 | 1954999 | − | conserved hypothetical protein |
| BI00246 | 1955200 | 1955577 | − | ribosomal protein L7/L12 |
| BI00247 | 1955689 | 1956207 | − | ribosomal protein L10 |
| BI00248 | 1956479 | 1957222 | − | conserved hypothetical protein |
| BI00249 | 1957561 | 1958952 | + | Unknown |
| BI00250 | 1959385 | 1962123 | − | polyribonucleotide nucleotidyltransferase |
| BI00251 | 1962444 | 1962710 | − | ribosomal protein S15 |

TABLE 1-continued

Open reading frames of the genome of UCC 35624.

| GeneID | Start | End | Strand | Description |
|---|---|---|---|---|
| BI00252 | 1962882 | 1963562 | − | conserved hypothetical protein |
| BI00253 | 1963721 | 1963951 | − | hypothetical protein |
| BI00254 | 1964091 | 1966964 | − | possible extracellular exo-xylanase |
| BI00255 | 1967190 | 1969712 | − | endo-1,4-beta-xylanase D |
| BI00256 | 1970329 | 1971432 | + | IS30 family, transposase [imported] |
| BI00257 | 1971591 | 1972274 | − | conserved hypothetical protein |
| BI00334t | 1972174 | 1972389 | + | conserved hypothetical protein |
| BI00258 | 1972411 | 1973094 | − | hypothetical protein Blon021028 |
| BI00259 | 1973553 | 1974914 | − | possible cell surface protein |
| BI00260 | 1974994 | 1977351 | − | von Willebrand factor type A domain protein |
| BI00261 | 1978150 | 1978326 | − | hypothetical protein Blon021305 |
| BI00262 | 1978353 | 1978820 | − | phosphopantethiene protein transferase |
| BI00263 | 1979459 | 1988974 | − | MaoC like domain protein |
| BI00264 | 1989016 | 1990635 | − | propionyl-CoA carboxylase, beta chain |
| BI00265 | 1990631 | 1992514 | − | accA3 |
| BI00266 | 1993105 | 1993701 | + | bioY protein |
| BI00267 | 1993739 | 1994710 | − | biotin--acetyl-CoA-carboxylase ligase |
| BI00268 | 1994853 | 1996895 | + | membrane protein, putative |
| BI00269 | 1996904 | 1997731 | + | conserved hypothetical protein |
| BI00270 | 1997829 | 1998524 | − | transcriptional regulator, putative |
| BI00350t | 1998629 | 1999459 | − | hypothetical transcriptional regulator, IclR family |
| BI00271 | 2011598 | 2011726 | − | hypothetical protein |
| BI00272 | 2011797 | 2012486 | − | ribosomal protein L1 |
| BI00273 | 2012505 | 2012933 | − | ribosomal protein L11 |
| BI00274 | 2013199 | 2014089 | − | transcription termination/antitermination factor NusG |
| BI00275 | 2014122 | 2014346 | − | preprotein translocase SecE subunit |
| BI00276 | 2014593 | 2015795 | − | aspartate aminotransferase [imported] |
| BI00277 | 2015889 | 2016986 | − | glutamate 5-kinase |
| BI00278 | 2017023 | 2018711 | − | GTP-binding protein |
| BI00279 | 2018783 | 2019028 | − | ribosomal protein L27 |
| BI00280 | 2019054 | 2019359 | − | ribosomal protein L21 |
| BI00281 | 2019502 | 2022534 | − | hypothetical ribonuclease, Rne/Rng family |
| BI00282 | 2022850 | 2024121 | − | succinyl-diaminopimelate desuccinylase |
| BI00283 | 2024159 | 2025100 | + | transporter, putative |
| BI00284 | 2025282 | 2026727 | − | permease, putative domain protein |
| BI00285 | 2026727 | 2027818 | − | ABC transporter, ATP-binding protein |
| BI00286 | 2027996 | 2029441 | − | Maf-like protein |
| BI00287 | 2029581 | 2030690 | − | homoserine kinase |
| BI00288 | 2030800 | 2032113 | − | homoserine dehydrogenase |
| BI00289 | 2032276 | 2033865 | − | diaminopimelate decarboxylase |
| BI00290 | 2033871 | 2035541 | − | arginyl-tRNA synthetase |
| BI00291 | 2035944 | 2036606 | + | possible TetR-type transcriptional regulator |
| BI00292 | 2036606 | 2037880 | + | permease, putative |
| BI00293 | 2037742 | 2038899 | + | transcription regulator LysR family VC1588 [imported], putative |
| BI00294 | 2038996 | 2040246 | + | probable aminotransferase |
| BI00295 | 2040298 | 2041521 | − | UDP-N-acetylglucosamine 1-carboxyvinyltransferase |
| BI00296 | 2041869 | 2043212 | + | NADH oxidase |
| BI00297 | 2043424 | 2044548 | − | dihydroorotate dehydrogenase family protein, putative |
| BI00298 | 2044591 | 2046468 | − | CAAX amino terminal protease family protein family |
| BI00299 | 2046594 | 2047283 | − | 3-isopropylmalate dehydratase small subunit |
| BI00300 | 2047369 | 2048769 | − | 3-isopropylmalate dehydratase, large subunit |
| BI00301 | 2049087 | 2049860 | + | transcriptional regulator, IclR family |
| BI00302 | 2050021 | 2051391 | − | Ser/Thr protein phosphatase family |
| BI00303 | 2051896 | 2054130 | + | polyphosphate kinase |
| BI00304 | 2054291 | 2055487 | + | mutT1 |
| BI00305 | 2055480 | 2056298 | + | hypothetical protein Blon021115 |
| BI00306 | 2056564 | 2057871 | − | conserved hypothetical protein |
| BI00307 | 2057963 | 2058121 | − | hypothetical protein |
| BI00308 | 2058175 | 2058813 | + | uracil phosphoribosyltransferase |
| BI00309 | 2058864 | 2059340 | + | conserved hypothetical protein TIGR00246 |
| BI00310 | 2059542 | 2060648 | − | possible phosphodiesterase |
| BI00311 | 2060677 | 2061747 | − | glutamyl-tRNA synthetase domain protein |
| BI00312 | 2061933 | 2064599 | − | ATP-dependent Clp protease, ATP-binding subunit ClpB |
| BI00313 | 2064821 | 2066371 | − | histidine ammonia-lyase |
| BI00314 | 2066617 | 2067489 | + | transcriptional regulator, IclR family, putative |
| BI00315 | 2067489 | 2067662 | + | conserved hypothetical protein |
| BI00316 | 2067741 | 2068559 | − | possible 2-hydroxyhepta-2,4-diene-1,7-dioate isomerase in the fumarylacetoacetate hydrolase family |

TABLE 1-continued

Open reading frames of the genome of UCC 35624.

| GeneID | Start | End | Strand | Description |
|---|---|---|---|---|
| BI00317 | 2068665 | 2069873 | − | hypothetical membrane protein with unknown function |
| BI00318 | 2070097 | 2071272 | − | UDP-galactopyranose mutase |
| BI00319 | 2071426 | 2072670 | + | dTDP-glucose 4,6-dehydratase |
| BI00320 | 2072827 | 2074311 | + | conserved hypothetical protein |
| BI00321 | 2074367 | 2075068 | + | conserved hypothetical protein |
| BI00423t | 2075382 | 2075687 | + | putative transposase |
| BI00322 | 2075763 | 2076530 | − | IS1533, OrfB |
| BI00323 | 2076530 | 2077987 | − | transposase (25) BH3998 [imported], putative |
| BI00324 | 2078280 | 2078996 | − | glycosyltransferase, putative |
| BI00325 | 2079313 | 2079666 | − | sialic acid-specific 9-O-acetylesterase |
| BI00326 | 2080049 | 2081173 | + | hypothetical Acyltransferase family |
| BI00327 | 2081181 | 2082893 | − | hypothetical membrane protein with unknown function |
| BI00328 | 2082902 | 2085811 | − | hypothetical Glycosyl transferase family 8 |
| BI00329 | 2085935 | 2087170 | − | hypothetical glycosyl transferase, group 2 family protein |
| BI00330 | 2087259 | 2088509 | − | polysaccharide ABC transporter, ATP-binding protein |
| BI00331 | 2088515 | 2089351 | − | polysaccharide ABC transporter, permease protein, putative |
| BI00332 | 2089580 | 2091367 | + | hypothetical Glycosyl transferase family 8 |
| BI00333 | 2091457 | 2092698 | − | UDP-glucose 6-dehydrogenase |
| BI00334 | 2092974 | 2093636 | + | hypothetical NAD dependent epimerase/dehydratase family |
| BI00335 | 2093654 | 2094844 | − | membrane protein, putative |
| BI00336 | 2094847 | 2097099 | − | conserved hypothetical protein |
| BI00337 | 2097441 | 2098844 | + | hypothetical membrane protein with unknown function |
| BI00338 | 2098844 | 2099962 | + | possible ATP binding protein of ABC transporter |
| BI00339 | 2100089 | 2100790 | + | HDIG domain protein |
| BI00340 | 2100871 | 2101728 | − | conserved hypothetical protein |
| BI00341 | 2101825 | 2104335 | − | Kup system potassium uptake protein [imported] |
| BI00342 | 2104481 | 2105188 | − | hydrolase, TatD family |
| BI00343 | 2105717 | 2106784 | + | Fic protein family family |
| BI00344 | 2106816 | 2108621 | − | ABC transporter, ATP-binding/permease protein |
| BI00345 | 2108635 | 2110542 | − | ABC transporter, ATP-binding/permease protein |
| BI00346 | 2110935 | 2111099 | − | hypothetical protein |
| BI00347 | 2111297 | 2112703 | − | possible alpha-galactosidase |
| BI00348 | 2113077 | 2114231 | + | transcriptional regulator, LacI family, putative |
| BI00349 | 2114409 | 2115356 | − | probable AraC/XylS-type transcriptional regulator |
| BI00350 | 2115401 | 2117626 | − | conserved hypothetical protein |
| BI00351 | 2117851 | 2119374 | + | aminopeptidase C |
| BI00352 | 2119555 | 2120628 | + | conserved hypothetical protein |
| BI00353 | 2121673 | 2123403 | − | methionyl-tRNA synthetase |
| BI00354 | 2123873 | 2124496 | + | conserved hypothetical protein |
| BI00466t | 2124496 | 2124864 | + | conserved hypothetical protein |
| BI00355 | 2124897 | 2125922 | − | conserved hypothetical protein TIGR00096 |
| BI00356 | 2126487 | 2127902 | − | possible symporter |
| BI00357 | 2127864 | 2129027 | + | conserved hypothetical protein |
| BI00358 | 2129186 | 2131012 | − | ABC transporter, ATP-binding/permease protein |
| BI00359 | 2131231 | 2133099 | − | ABC transporter, ATP-binding/permease protein |
| BI00360 | 2133289 | 2133684 | − | transcriptional regulator, MarR family, putative |
| BI00475t | 2134267 | 2134506 | + | DNA-damage-inducible protein of Escherichia coli |
| BI00361 | 2135008 | 2138841 | − | LPXTG-motif cell wall anchor domain protein |
| BI00362 | 2139056 | 2139151 | − | hypothetical protein |
| BI00363 | 2139209 | 2143594 | − | secreted protein |
| BI00364 | 2143901 | 2145394 | − | ATP-dependent DNA helicase recG |
| BI00365 | 2145737 | 2147257 | − | amino acid permease |
| BI00366 | 2147448 | 2151185 | − | permease, putative |
| BI00367 | 2151199 | 2151897 | − | ABC transporter, ATP-binding protein |
| BI00368 | 2152041 | 2152607 | + | probable TetR-like transcriptional regulator |
| BI00369 | 2152832 | 2154310 | + | aromatic amino acid transport protein AroP |
| BI00370 | 2154575 | 2155774 | + | putative invertase/transposase |
| BI00371 | 2155961 | 2160952 | − | hypothetical Glycosyl hydrolases family 43 |
| BI00372 | 2161359 | 2164649 | − | hypothetical |
| BI00373 | 2164997 | 2168173 | − | possible arabinosidase |
| BI00374 | 2168529 | 2169131 | − | conserved hypothetical protein |
| BI00375 | 2169340 | 2170179 | − | sugar ABC transporter, permease protein, putative |
| BI00376 | 2170182 | 2171033 | − | sugar ABC transporter, permease protein, putative |
| BI00377 | 2171416 | 2172429 | + | transcription regulator, LacI family [imported], putative |
| BI00378 | 2172690 | 2174015 | − | possible solute binding protein of ABC transporter |

TABLE 1-continued

Open reading frames of the genome of UCC 35624.

| GeneID | Start | End | Strand | Description |
|---|---|---|---|---|
| BI00379 | 2174424 | 2175134 | − | phosphoglycerate mutase family protein |
| BI00380 | 2175226 | 2175600 | + | hypothetical COG0531: Amino acid transporters |
| BI00381 | 2175612 | 2176550 | + | hypothetical nitroreductase family protein |
| BI00382 | 2176846 | 2179572 | + | phage infectio, putative |
| BI00383 | 2179572 | 2181908 | + | phage infection protein, putative |
| BI00384 | 2188511 | 2189263 | + | regulatory protein, SIR2 family |
| BI00385 | 2189415 | 2190791 | − | threonine dehydratase |
| BI00386 | 2190928 | 2192745 | − | glucan 1,6-alpha-glucosidase |
| BI00387 | 2192872 | 2194731 | − | hypothetical Raffinose synthase or seed imbibition protein Sip1 |
| BI00388 | 2194766 | 2196433 | − | alpha-amylase family protein |
| BI00389 | 2196537 | 2197358 | − | hypothetical abc transporter permease protein yurm. {bacillus |
| BI00390 | 2197364 | 2198383 | − | hypothetical Binding-protein-dependent transport systems inner membrane component |
| BI00391 | 2198408 | 2199730 | − | hypothetical Bacterial extracellular solute-binding protein |
| BI00392 | 2199980 | 2201095 | − | hypothetical protein Efae022644 |
| BI00393 | 2201159 | 2202484 | − | hypothetical Bacterial extracellular solute-binding protein |
| BI00394 | 2202692 | 2203717 | + | transcription regulator, LacI family [imported], putative |
| BI00395 | 2203838 | 2204854 | + | transcription regulator, LacI family [imported], putative |
| BI00396 | 2204919 | 2205782 | − | sugar ABC transporter, permease protein |
| BI00397 | 2205804 | 2206730 | − | sugar ABC transporter, permease protein |
| BI00398 | 2206755 | 2208041 | − | sugar ABC transporter, sugar-binding protein, putative |
| BI00399 | 2208215 | 2209420 | + | transcription regulator ROK family VC2007 [imported], putative |
| BI00400 | 2209591 | 2211894 | − | alpha-galactosidase |
| BI00401 | 2212017 | 2212445 | − | hypothetical Cytidine and deoxycytidylate deaminase zinc-binding region |
| BI00402 | 2212589 | 2214658 | + | Na+/H+ antiporter |
| BI00403 | 2214858 | 2215613 | − | serine esterase, putative |
| BI00404 | 2215613 | 2215714 | − | hypothetical protein |
| BI00405 | 2215735 | 2216592 | − | conserved hypothetical protein |
| BI00406 | 2216949 | 2217527 | + | deoxycytidine triphosphate deaminase |
| BI00407 | 2217593 | 2219320 | + | cell wall surface anchor family protein, putative |
| BI00408 | 2219543 | 2222527 | − | calcium E1-E2-type ATPase |
| BI00409 | 2222713 | 2223447 | − | protein probably involved in xylan degradation, possible xylan esterase |
| BI00410 | 2223622 | 2225049 | − | hypothetical major facilitator superfamily protein |
| BI00411 | 2225005 | 2225994 | + | RNA methyltransferase, TrmH family, group 3 |
| BI00412 | 2226107 | 2227516 | − | conserved hypothetical protein |
| BI00413 | 2227740 | 2228864 | − | ATP binding protein of ABC transporter for sugars |
| BI00414 | 2229226 | 2230419 | − | glycosyl transferase domain protein |
| BI00415 | 2230486 | 2231475 | − | Ribonucleotide reductase, beta subunit |
| BI00416 | 2231704 | 2233896 | − | ribonucleoside-diphosphate reductase, alpha subunit |
| BI00417 | 2234015 | 2234470 | − | nrdI protein |
| BI00418 | 2234470 | 2234733 | − | COG0695: Glutaredoxin and related proteins |
| BI00419 | 2235324 | 2235767 | − | hypothetical Helix-turn-helix |
| BI00420 | 2235958 | 2236635 | − | conserved hypothetical protein |
| BI00421 | 2236828 | 2237592 | + | ion transporter |
| BI00422 | 2237788 | 2238891 | + | conserved hypothetical protein |
| BI00423 | 2239035 | 2239349 | − | beta-glucosidase-related glycosidase |
| BI00424 | 2239828 | 2241951 | + | widely conserved protein with eukaryotic protein kinase domain |
| BI00425 | 2242132 | 2243106 | + | conserved hypothetical protein |
| BI00426 | 2243627 | 2245111 | + | conserved hypothetical protein |
| BI00427 | 2245147 | 2246067 | + | dimethyladenosine transferase |
| BI00428 | 2246067 | 2247014 | + | kinase, GHMP family, group 2 |
| BI00429 | 2246860 | 2247690 | + | hypothetical protein BL0655 |
| BI00430 | 2247781 | 2249193 | − | pcnA |
| BI00431 | 2249280 | 2250569 | + | NUDIX domain protein |
| BI00432 | 2250569 | 2252836 | + | cell wall surface anchor family protein, putative |
| BI00433 | 2252836 | 2254560 | + | conserved hypothetical membrane protein in MviN family |
| BI00434 | 2254646 | 2256706 | + | conserved hypothetical protein |
| BI00435 | 2256829 | 2257845 | + | thioredoxin reductase |
| BI00436 | 2258158 | 2259516 | − | chromosome partitioning protein ParB |
| BI00437 | 2259519 | 2260487 | − | Soj family protein |
| BI00438 | 2260741 | 2261403 | − | methyltransferase GidB |
| BI00439 | 2261558 | 2262088 | − | R3H domain protein |

TABLE 1-continued

Open reading frames of the genome of UCC 35624.

| GeneID | Start | End | Strand | Description |
|---|---|---|---|---|
| BI00440 | 2262215 | 2263219 | − | inner membrane protein, 60 kDa VC0004 [imported] |
| BI00143g | 2263219 | 2263533 | − | conserved hypothetical protein TIGR00278 |
| BI00576t | 2263533 | 2264063 | − | ribonuclease P protein component |
| BI00441 | 2263925 | 2264056 | − | ribosomal protein L34 |
| BI00442 | 1 | 1500 | + | chromosomal replication initiator protein DnaA |
| BI00443 | 2239 | 3360 | + | DNA polymerase III, beta subunit |
| BI00444 | 3442 | 4626 | + | recF protein |
| BI00445 | 4626 | 5093 | + | conserved hypothetical protein |
| BI00446 | 5229 | 7364 | + | DNA gyrase, B subunit |
| BI00447 | 7534 | 10083 | + | DNA gyrase, A subunit |
| BI00448 | 10156 | 10719 | + | conserved hypothetical protein |
| BI00449 | 11406 | 12116 | + | hypothetical protein |
| BI00450 | 12179 | 13699 | + | hypothetical Pectinesterase |
| BI00451 | 14103 | 15446 | − | NADP-specific glutamate dehydrogenase |
| BI00452 | 15768 | 16199 | − | AsnC-type transcriptional regulator |
| BI00453 | 16405 | 17736 | + | aspartate aminotransferase |
| BI00454 | 17757 | 18746 | − | hypothetical protein Blon021073 |
| BI00455 | 19007 | 19600 | + | hypothetical protein BL0627 |
| BI00456 | 19770 | 20462 | + | hypothetical protein Blon021075 |
| BI00457 | 20579 | 20821 | + | Putative acrab operon repressor transcription regulator protein |
| BI00599t | 21403 | 21735 | − | IS1557, transposase, putative |
| BI00146g | 21834 | 22397 | − | conserved hypothetical protein |
| BI00458 | 22130 | 23497 | − | hypothetical COG1167: Transcriptional regulators containing a DNA-binding HTH domain and an aminotransferase domain (MocR family) and their eukaryotic orthologs |
| BI00459 | 24132 | 25454 | + | aminotransferase, class III superfamily |
| BI00460 | 25495 | 26397 | + | Zinc metalloprotease |
| BI00461 | 26414 | 26509 | − | hypothetical protein |
| BI00462 | 26487 | 26849 | + | COG3265: Gluconate kinase |
| BI00463 | 27114 | 28424 | − | conserved hypothetical protein |
| BI00464 | 28662 | 29138 | − | Dps family protein, putative |
| BI00465 | 29238 | 30608 | − | CBS domain protein, putative |
| BI00466 | 30841 | 31521 | − | Prokaryotic-type carbonic anhydrases |
| BI00467 | 31727 | 32287 | + | alkyl hydrogen peroxide reductase |
| BI00468 | 32458 | 34371 | + | thioredoxin reductase |
| BI00469 | 34494 | 35963 | − | oxalate: formate antiporter |
| BI00470 | 35948 | 36094 | + | hypothetical protein |
| BI00471 | 36333 | 37328 | + | LacI-type transcriptional regulator |
| BI00472 | 37558 | 40308 | − | phosphoenolpyruvate carboxylase |
| BI00473 | 40594 | 42471 | + | membrane protein, putative |
| BI00474 | 42737 | 44344 | + | possible sodium/proline symporter |
| BI00475 | 44680 | 45663 | − | narrowly conserved hypothetical protein |
| BI00476 | 45917 | 47533 | + | conserved hypothetical protein |
| BI00477 | 47717 | 48805 | − | tryptophanyl-tRNA synthetase |
| BI00478 | 49056 | 49325 | + | hypothetical protein |
| BI00479 | 49437 | 49967 | − | conserved hypothetical protein |
| BI00480 | 49986 | 52505 | + | glycogen phosphorylase |
| BI00481 | 52725 | 52940 | − | hypothetical protein BL0595 |
| BI00482 | 53195 | 53887 | + | Rhomboid family protein |
| BI00483 | 54562 | 55029 | − | conserved hypothetical protein |
| BI00484 | 55119 | 55907 | + | conserved hypothetical protein |
| BI00485 | 55907 | 57142 | + | hypothetical transmembrane protein with unknown function |
| BI00486 | 57196 | 57837 | + | pabA |
| BI00487 | 58067 | 60136 | − | serine/threonine protein kinase |
| BI00488 | 60136 | 60942 | − | serine/threonine protein kinase |
| BI00489 | 61083 | 62546 | − | pbpA |
| BI00490 | 62546 | 64204 | − | Unknown, putative |
| BI00491 | 64204 | 65895 | − | possible phosphoprotein phosphatase |
| BI00492 | 65903 | 66430 | − | FHA-domain-containing proteins |
| BI00493 | 66463 | 67161 | − | FHA domain protein |
| BI00494 | 67349 | 69790 | − | dipeptidyl peptidase IV, putative |
| BI00495 | 69951 | 70997 | + | lysophospholipase L2, putative |
| BI00496 | 71080 | 72228 | + | von Willebrand factor type A domain protein |
| BI00497 | 72231 | 72947 | + | conserved hypothetical protein |
| BI00498 | 72947 | 73348 | + | hypothetical protein Blon021556 |
| BI00654t | 73348 | 73497 | + | hypothetical protein Blon021556 |
| BI00499 | 73873 | 74724 | + | tellurite resistance protein |
| BI00500 | 75108 | 75608 | + | heat shock protein, Hsp20 family |
| BI00501 | 75938 | 76891 | + | Probable transmembrane protein |
| BI00502 | 77065 | 77520 | − | conserved hypothetical protein |
| BI00503 | 77753 | 79132 | + | COG0627: Predicted esterase |
| BI00504 | 79132 | 81702 | + | COG2898: Uncharacterized BCR |

TABLE 1-continued

Open reading frames of the genome of UCC 35624.

| GeneID | Start | End | Strand | Description |
|---|---|---|---|---|
| BI00505 | 82241 | 83212 | + | peptide methionine sulfoxide reductase |
| BI00506 | 83218 | 83304 | + | hypothetical protein BL0567 |
| BI00668t | 83341 | 83496 | + | COG0463: Glycosyltransferases involved in cell wall biogenesis |
| BI00507 | 83506 | 86709 | − | helicase-related protein |
| BI00509 | 86785 | 87195 | − | mutator MutT protein, putative |
| BI00510 | 87337 | 88587 | + | hypothetical Domain of unknown function |
| BI00511 | 88678 | 89139 | + | acetyltransferase, GNAT family family |
| BI00512 | 89226 | 90080 | − | hypothetical |
| BI00513 | 90187 | 90420 | − | hypothetical protein |
| BI00514 | 90480 | 90842 | + | conserved hypothetical protein |
| BI00515 | 91329 | 92639 | − | queuine tRNA-ribosyltransferase |
| BI00516 | 93056 | 95065 | + | heat shock protein HtrA |
| BI00517 | 95480 | 97636 | + | cation-transporting ATPase, E1-E2 family |
| BI00684t | 97816 | 98862 | + | transcriptional regulator, LacI family |
| BI00518 | 98874 | 99131 | − | hypothetical mttA/Hcf106 family |
| BI00519 | 99136 | 100215 | − | Sec-independent protein translocase TatC |
| BI00687t | 100215 | 100730 | − | hypothetical twin-arginine translocation protein, TatA/E family |
| BI00520 | 101182 | 103581 | + | hypothetical Tat (twin-arginine translocation) pathway signal sequence |
| BI00521 | 103674 | 106151 | + | hypothetical |
| BI00522 | 106547 | 107707 | − | conserved hypothetical protein |
| BI00523 | 107911 | 109359 | + | ferredoxin/ferredoxin--NADP reductase, putative |
| BI00524 | 109452 | 110450 | + | heat shock protein HtpX |
| BI00525 | 110667 | 111731 | − | fructose-bisphosphate aldolase, class II |
| BI00526 | 111947 | 113230 | + | adenylosuccinate synthetase |
| BI00527 | 113524 | 114837 | + | chloride channel |
| BI00528 | 115027 | 116094 | + | CrcB-like protein family |
| BI00700t | 116097 | 116489 | + | protein with similarity to CrcB |
| BI00529 | 116581 | 116691 | + | hypothetical protein |
| BI00530 | 116767 | 117849 | + | sugar-binding transcriptional regulator, LacI family, putative |
| BI00531 | 118274 | 119842 | + | Kup system potassium uptake protein [imported] |
| BI00532 | 120262 | 121806 | + | alpha-L-arabinofuranosidase |
| BI00533 | 121981 | 123012 | + | transcription regulator, LacI family [imported], putative |
| BI00534 | 123104 | 124012 | − | glycosyl hydrolase, family 31 |
| BI00535 | 124149 | 124370 | − | IS861, transposase OrfB |
| BI00711t | 124604 | 125803 | + | probable integrase/recombinase |
| BI00712t | 125878 | 126765 | + | probable integrase/recombinase |
| BI00536 | 126765 | 127817 | + | integrase/recombinase XerC, probable [imported], putative |
| BI00537 | 127910 | 128956 | − | IS3 family transposase |
| BI00538 | 129291 | 130814 | + | sucrose phosphorylase |
| BI00539 | 131035 | 132669 | + | hypothetical transmembrane protein with unknown function |
| BI00540 | 132736 | 133776 | + | sugar-binding transcriptional regulator, LacI family, putative |
| BI00541 | 134407 | 135771 | + | major facilitator family transporter |
| BI00542 | 135971 | 137020 | + | ketol-acid reductoisomerase |
| BI00543 | 137452 | 138501 | + | ketol-acid reductoisomerase |
| BI00544 | 138689 | 140500 | − | alpha-amylase family protein |
| BI00545 | 140663 | 141694 | − | transcription regulator, LacI family [imported], putative |
| BI00546 | 142008 | 144242 | − | 4-alpha-glucanotransferase |
| BI00547 | 144506 | 144784 | − | hypothetical protein Blon021648 |
| BI00548 | 144856 | 145482 | + | conserved hypothetical protein |
| BI00549 | 145500 | 146507 | − | transcription regulator, LacI family [imported], putative |
| BI00550 | 146777 | 147490 | + | sugar ABC transporter, permease protein |
| BI00551 | 147605 | 150139 | + | glycosyl hydrolase, family 31 |
| BI00552 | 151125 | 153002 | + | dnaK protein |
| BI00553 | 153005 | 153658 | + | co-chaperone GrpE |
| BI00554 | 153753 | 154769 | + | DnaJ protein [imported] |
| BI00555 | 154787 | 155371 | + | hspR |
| BI00556 | 155647 | 156996 | + | xanthine permease, putative |
| BI00557 | 157036 | 158154 | + | possible acyl protein synthase/acyl-CoA reductase-like protein |
| BI00558 | 158144 | 159640 | + | possible acyl-CoA reductase |
| BI00559 | 159715 | 160497 | + | 3-oxoacyl-acyl carrier protein reductase |
| BI00560 | 160553 | 161281 | + | beta-phosphoglucomutase, putative |
| BI00561 | 161435 | 162157 | + | DedA protein |
| BI00749t | 162383 | 163330 | + | conserved hypothetical protein |
| BI00562 | 163340 | 164404 | + | trbB |
| BI00751t | 164410 | 165060 | + | conserved hypothetical protein |

TABLE 1-continued

Open reading frames of the genome of UCC 35624.

| GeneID | Start | End | Strand | Description |
|---|---|---|---|---|
| BI00752t | 165060 | 165659 | + | hypothetical membrane protein with unknown function |
| BI00563 | 165947 | 166231 | + | hypothetical protein BL0505 |
| BI00754t | 166240 | 166614 | + | conserved hypothetical protein |
| BI00564 | 166715 | 167041 | + | conserved hypothetical protein |
| BI00565 | 167093 | 168220 | + | BmrU protein, putative |
| BI00566 | 168424 | 169020 | − | possible TetR-type transcriptional regulator |
| BI00567 | 169297 | 172125 | + | DNA polymerase III, tau/gamma subunit |
| BI00568 | 172154 | 172753 | + | recombination protein RecR |
| BI00569 | 172756 | 173886 | − | sortase family protein |
| BI00570 | 174774 | 176054 | + | conserved hypothetical protein |
| BI00571 | 176649 | 177179 | + | hypothetical Amino acid kinase family |
| BI00572 | 177262 | 177801 | + | aspartokinase, alpha and beta subunits |
| BI00573 | 177889 | 178980 | − | aspartate-semialdehyde dehydrogenase |
| BI00574 | 179055 | 179765 | + | conserved hypothetical protein |
| BI00575 | 179774 | 181351 | − | Ser/Thr protein phosphatase family |
| BI00576 | 182040 | 183953 | + | 2-isopropylmalate synthase |
| BI00577 | 184031 | 186493 | − | penicillin-binding protein, putative |
| BI00578 | 186772 | 187959 | + | possible pre-pilin peptidase |
| BI00579 | 188086 | 191169 | + | DNA topoisomerase I |
| BI00580 | 191549 | 192067 | + | thymidylate kinase |
| BI00581 | 192067 | 193215 | + | DNA polymerase III, delta subunit |
| BI00582 | 193337 | 193888 | + | conserved hypothetical protein TIGR00481 |
| BI00583 | 194034 | 195632 | + | Unknown |
| BI00584 | 195767 | 197281 | + | formate--tetrahydrofolate ligase |
| BI00585 | 197684 | 198028 | − | conserved hypothetical protein |
| BI00586 | 198149 | 198763 | + | narrowly conserved hypothetical membrane protein |
| BI00587 | 198817 | 200226 | − | hypothetical membrane protein with unknown function |
| BI00588 | 200521 | 201177 | + | phosphoglycerate mutase family protein |
| BI00589 | 201278 | 202228 | + | conserved hypothetical protein |
| BI00590 | 202352 | 203224 | + | transglycolase, epimerase |
| BI00591 | 203348 | 204496 | − | extensin precursor (cell wall hydroxyproline-rich glycoprotein) |
| BI00790t | 204684 | 204866 | + | hypothetical protein BL0470 |
| BI00592 | 205053 | 206570 | + | glutamyl-tRNA synthetase |
| BI00593 | 207503 | 207988 | + | hypothetical protein Blon021299 |
| BI00594 | 207946 | 208221 | − | hypothetical protein BL0466 |
| BI00595 | 208388 | 214285 | + | cell wall surface anchor family protein, authentic frameshift |
| BI00596 | 214390 | 215208 | − | hypothetical |
| BI00597 | 216652 | 218460 | + | conserved hypothetical integral membrane protein |
| BI00598 | 218637 | 219317 | + | membrane antigen, putative |
| BI00599 | 219470 | 220744 | + | Integral membrane protein |
| BI00600 | 220769 | 222070 | + | possible permease protein of ABC transporter system |
| BI00601 | 222107 | 223327 | + | possible permease protein of ABC transporter system |
| BI00602 | 223346 | 224140 | + | ABC transporter, ATP-binding protein |
| BI00603 | 224259 | 224819 | + | lipoprotein, putative |
| BI00604 | 224831 | 225427 | − | transcriptional regulator, TetR family, putative |
| BI00605 | 225545 | 227704 | − | phage infection protein, putative |
| BI00606 | 227704 | 230250 | − | phage infection protein, putative |
| BI00607 | 230686 | 231969 | + | membrane protein, putative |
| BI00608 | 232037 | 233602 | + | 6-phosphogluconate dehydrogenase, decarboxylating |
| BI00609 | 233756 | 234595 | − | 6-phosphogluconolactonase |
| BI00610 | 234825 | 235847 | − | oxppcycle protein OpcA |
| BI00611 | 235847 | 237499 | − | glucose-6-phosphate 1-dehydrogenase |
| BI00612 | 237652 | 239337 | + | Unknown |
| BI00613 | 239417 | 240448 | − | Glycosyltransferase involved in cell wall biogenesis |
| BI00614 | 240475 | 241311 | − | transcriptional regulator, TetR family |
| BI00615 | 241407 | 242675 | + | signal recognition particle-docking protein FtsY |
| BI00616 | 243046 | 244338 | + | ammonium transporter |
| BI00617 | 244343 | 244678 | + | Nitrogen regulatory protein P-II |
| BI00618 | 244832 | 246613 | + | protein-pII, uridylyltransferase |
| BI00619 | 246653 | 248095 | − | DNA-damage-inducible protein F, putative |
| BI00620 | 248301 | 249827 | + | replicative DNA helicase |
| BI00621 | 249830 | 251299 | + | UDP-N-acetylmuramyl tripeptide synthase |
| BI00622 | 251405 | 252154 | + | cobyric acid synthase |
| BI00623 | 252306 | 252590 | + | conserved hypothetical protein |
| BI00624 | 252590 | 254407 | + | ABC1 family family |
| BI00625 | 254428 | 255447 | − | transcriptional regulator, LacI family |
| BI00626 | 255933 | 257255 | + | solute binding protein of ABC transporter system |

TABLE 1-continued

Open reading frames of the genome of UCC 35624.

| GeneID | Start | End | Strand | Description |
|---|---|---|---|---|
| BI00627 | 257546 | 258469 | + | sugar ABC transporter, permease protein, putative |
| BI00628 | 258493 | 259308 | + | ABC transporter, permease protein, MalFG family |
| BI00629 | 259473 | 261446 | + | conserved hypothetical protein |
| BI00630 | 262147 | 267966 | + | hypothetical |
| BI00631 | 268074 | 271778 | + | cell wall surface anchor family protein, putative |
| BI00632 | 271911 | 272741 | + | conserved hypothetical protein TIGR00044 |
| BI00633 | 272825 | 273835 | − | prsA |
| BI00634 | 273960 | 274439 | − | hypothetical COG3210: Large exoproteins involved in heme utilization or adhesion |
| BI00635 | 274604 | 274891 | + | ribosomal protein S6 |
| BI00636 | 274951 | 275604 | + | hypothetical single-strand binding protein |
| BI00637 | 275668 | 275913 | + | ribosomal protein S18 |
| BI00638 | 275936 | 276379 | + | ribosomal protein L9 |
| BI00639 | 276769 | 277026 | + | ptsH |
| BI00640 | 277029 | 278705 | + | phosphoenolpyruvate-protein phosphotransferase |
| BI00641 | 278942 | 279673 | + | glycerol uptake facilitator protein |
| BI00642 | 279763 | 282468 | − | copper-translocating P-type ATPase |
| BI00643 | 282580 | 282858 | + | COG1937 family protein |
| BI00644 | 283012 | 284325 | + | Uncharacterized BCR, YigN family, COG1322 family |
| BI00645 | 284325 | 284951 | + | conserved hypothetical protein |
| BI00646 | 285048 | 285893 | + | COG0566: rRNA methylases |
| BI00647 | 285787 | 286359 | + | glutamyl-tRNA(Gln) amidotransferase, C subunit |
| BI00648 | 286366 | 287904 | + | glutamyl-tRNA(Gln) amidotransferase, A subunit |
| BI00649 | 287933 | 289429 | + | glutamyl-tRNA(Gln) amidotransferase, B subunit |
| BI00650 | 289728 | 290789 | + | possible acetyltransferase |
| BI00651 | 290803 | 291114 | + | conserved hypothetical protein |
| BI00652 | 291501 | 293141 | + | conserved hypothetical protein |
| BI00653 | 293363 | 294973 | + | BarJ |
| BI00654 | 295245 | 297248 | + | transcription termination factor Rho |
| BI00655 | 297358 | 297501 | + | hypothetical protein |
| BI00656 | 297559 | 297945 | + | chorismate mutase |
| BI00657 | 298070 | 300151 | + | cell wall surface anchor family protein, putative |
| BI00658 | 300383 | 303220 | − | valyl-tRNA synthetase, putative |
| BI00659 | 303262 | 304686 | − | ABC transporter, periplasmic substrate-binding protein, putative |
| BI00660 | 304850 | 305533 | − | endonuclease III |
| BI00661 | 305595 | 306374 | − | transcriptional regulator |
| BI00662 | 306556 | 307212 | − | membrane protein, putative |
| BI00663 | 307369 | 307950 | − | integral membrane protein in the upf0059 |
| BI00664 | 308187 | 308678 | − | inorganic pyrophosphatase |
| BI00665 | 308908 | 311145 | − | alpha-amylase family protein |
| BI00666 | 311386 | 313377 | + | conserved hypothetical protein |
| BI00667 | 313988 | 315019 | + | homoserine O-succinyltransferase |
| BI00668 | 315484 | 316293 | + | ATP synthase F0, A subunit |
| BI00669 | 316400 | 316624 | + | ATP synthase F0, C subunit |
| BI00670 | 316684 | 317199 | + | ATP synthase F0, B subunit |
| BI00671 | 317237 | 318070 | + | ATP synthase F1, delta subunit |
| BI00672 | 318149 | 319777 | + | ATP synthase F1, alpha subunit |
| BI00673 | 319784 | 320704 | + | ATP synthase F1, gamma subunit |
| BI00674 | 320716 | 322185 | + | ATP synthase F1, beta subunit |
| BI00675 | 322188 | 322478 | + | ATP synthase F1, epsilon subunit, putative |
| BI00676 | 322539 | 323336 | + | Predicted nuclease of the RecB family |
| BI00677 | 323388 | 324374 | − | possible secreted peptidyl-prolyl cis-trans isomerase protein |
| BI00678 | 324455 | 325531 | + | conserved hypothetical protein |
| BI00679 | 325534 | 326538 | + | conserved hypothetical protein |
| BI00680 | 326790 | 327761 | + | thioredoxin [imported], putative |
| BI00681 | 327850 | 328473 | − | Adenylate cyclase |
| BI00682 | 329012 | 329398 | + | endoribonuclease L-PSP, putative |
| BI00683 | 329536 | 330498 | + | Acyltransferase domain protein |
| BI00684 | 330595 | 331593 | + | glycerol-3-phosphate dehydrogenase, NAD-dependent |
| BI00685 | 331783 | 332967 | + | D-ala D-ala ligase |
| BI00686 | 333223 | 334386 | + | ABC transporter, periplasmic substrate-binding protein |
| BI00687 | 334206 | 335348 | + | spermidine/putrescine ABC transporter, permease protein, putative |
| BI00688 | 335348 | 336199 | + | spermidine/putrescine ABC transporter, permease protein, putative |
| BI00689 | 336207 | 337481 | + | spermidine/putrescine ABC transporter, ATP-binding protein |
| BI00690 | 337788 | 338828 | + | CAAX amino terminal protease family protein family |

TABLE 1-continued

Open reading frames of the genome of UCC 35624.

| GeneID | Start | End | Strand | Description |
|---|---|---|---|---|
| BI00691 | 338873 | 339667 | − | Mechanosensitive ion channel family |
| BI00692 | 339751 | 341181 | − | aspartate ammonia-lyase |
| BI00693 | 341302 | 342030 | − | transcriptional regulator, TetR family domain protein |
| BI00694 | 342124 | 343527 | − | conserved hypothetical protein |
| BI00695 | 343852 | 344400 | − | methylated-DNA--protein-cysteine methyltransferase |
| BI00696 | 345228 | 346055 | + | hypothetical protein with helix turn helix motif |
| BI00697 | 345928 | 347202 | − | MFS transporter family protein, putative |
| BI00698 | 347393 | 348406 | − | ribokinase [imported] |
| BI00939t | 348735 | 349001 | + | ribosomal protein L28 |
| BI00699 | 349116 | 351944 | + | ATP-dependent DNA helicase RecG |
| BI00700 | 352204 | 352782 | + | methyltransferase, putative |
| BI00701 | 352812 | 353624 | − | tRNA (guanine-N1)-methyltransferase |
| BI00702 | 353623 | 355341 | + | Unknown |
| BI00703 | 355422 | 356399 | + | conserved hypothetical protein |
| BI00704 | 356482 | 357354 | + | 4-diphosphocytidyl-2C-methyl-D-erythritol synthase, putative |
| BI00705 | 357367 | 358041 | + | pyrrolidone-carboxylate peptidase, putative |
| BI00706 | 358303 | 359766 | + | IgA-specific serine endopeptidase, putative |
| BI00707 | 359884 | 361224 | + | aminopeptidase C |
| BI00708 | 361519 | 362649 | + | phospho-2-dehydro-3-deoxyheptonate aldolase |
| BI00709 | 362781 | 364010 | + | phospho-2-dehydro-3-deoxyheptonate aldolase |
| BI00710 | 364141 | 364845 | + | MTA/SAH nucleosidase |
| BI00711 | 365444 | 366427 | + | hypothetical ATPase, histidine kinase-, DNA gyrase B-, and HSP90-like domain protein |
| BI00712 | 366563 | 367330 | + | DNA-binding response regulator RegX3 |
| BI00713 | 367583 | 368713 | + | phosphate ABC transporter, phosphate-binding protein |
| BI00714 | 368927 | 369877 | + | pstC2 |
| BI00715 | 369997 | 370875 | + | phosphate ABC transporter, permease protein |
| BI00716 | 370931 | 371707 | + | phoT |
| BI00717 | 372005 | 372580 | + | lemA protein |
| BI00718 | 372647 | 374902 | + | conserved hypothetical protein |
| BI00719 | 374971 | 375831 | + | oxidoreductase, aldo/keto reductase family |
| BI00720 | 375932 | 376981 | + | inosine-uridine preferring nucleoside hydrolase |
| BI00721 | 377109 | 377729 | − | 16S rRNA processing protein RimM |
| BI00722 | 377755 | 377985 | − | KH domain protein |
| BI00723 | 378009 | 378467 | − | ribosomal protein S16 |
| BI00724 | 378703 | 379809 | − | Endonuclease/Exonuclease/phosphatase family family |
| BI00725 | 379889 | 381634 | − | signal recognition particle protein |
| BI00726 | 381843 | 382748 | + | cation efflux family protein superfamily |
| BI00727 | 382773 | 384488 | − | cysteinyl-tRNA synthetase |
| BI00728 | 384518 | 385363 | + | possible amidotransferase |
| BI00729 | 385627 | 387687 | + | ABC transporter, ATP-binding protein |
| BI00730 | 387746 | 388162 | − | plasmid stability protein StbB |
| BI00731 | 388175 | 388450 | − | hypothetical protein |
| BI00732 | 388609 | 389160 | − | acetolactate synthase, small subunit |
| BI00733 | 389180 | 391144 | − | acetolactate synthase, large subunit, biosynthetic type |
| BI00734 | 391308 | 392033 | − | ribonuclease III |
| BI00735 | 392189 | 392380 | − | ribosomal protein L32 |
| BI00736 | 392472 | 393098 | − | Uncharacterized ACR, COG1399 |
| BI00737 | 393191 | 394078 | − | conserved hypothetical protein |
| BI00738 | 394089 | 394586 | − | pantetheine-phosphate adenylyltransferase |
| BI00739 | 394860 | 395150 | + | conserved hypothetical protein |
| BI00740 | 395198 | 396205 | − | K+ channel, beta subunit |
| BI00741 | 396379 | 396804 | + | transcription regulator, MerR family NMB1303 [imported], putative |
| BI00742 | 396910 | 397533 | − | hypothetical transmembrane protein with unknown function |
| BI00743 | 397764 | 399083 | + | nicotinate phosphoribosyltransferase, putative |
| BI00744 | 399381 | 400142 | + | ribonuclease PH |
| BI00745 | 400189 | 400944 | + | Ham1 family |
| BI00746 | 401106 | 402659 | + | hypothetical FemAB family |
| BI00747 | 402736 | 404043 | + | FemAB family protein, putative |
| BI00748 | 404096 | 405373 | + | beta-lactam resistance factor, putative |
| BI00749 | 405462 | 406460 | − | membrane protein, putative |
| BI00750 | 407182 | 408879 | + | glucose-6-phosphate isomerase |
| BI00751 | 409515 | 409877 | + | ribosomal protein L19 |
| BI00752 | 410047 | 410901 | + | lepB |
| BI00753 | 411024 | 411860 | + | ribonuclease HII |
| BI00754 | 411990 | 413102 | + | transcription regulator, LacI family [imported] |
| BI00755 | 413261 | 414904 | + | probable sugar kinase |
| BI00756 | 414992 | 415681 | + | sugar isomerase |

TABLE 1-continued

Open reading frames of the genome of UCC 35624.

| GeneID | Start | End | Strand | Description |
| --- | --- | --- | --- | --- |
| BI00757 | 416114 | 417430 | + | L-arabinose isomerase |
| BI00758 | 417620 | 418240 | − | trp-G type glutamine amidotransferase/dipeptidase |
| BI00759 | 418178 | 420178 | + | membrane protein, putative |
| BI00760 | 420330 | 421694 | + | permease, putative |
| BI00761 | 421694 | 422914 | + | transmembrane protein Vexp1, putative |
| BI00762 | 422930 | 423562 | + | Vexp2 |
| BI00763 | 423886 | 425706 | − | long-chain-fatty-acid--CoA ligase, putative |
| BI00764 | 425820 | 426098 | + | fragment of arabinose permease |
| BI00765 | 426765 | 429890 | + | hypothetical ABC transporter |
| BI00766 | 430170 | 430436 | − | major facilitator family transporter CC0814 [imported], putative |
| BI00767 | 431272 | 432618 | + | solute binding protein of ABC transporter system |
| BI00768 | 432750 | 433799 | + | sugar ABC transporter, permease protein, putative |
| BI00769 | 433820 | 434809 | + | Unknown |
| BI00770 | 435125 | 437128 | + | beta-D-galactosidase, putative |
| BI00771 | 437175 | 438227 | + | transcription regulator, LacI family [imported], putative |
| BI00772 | 438426 | 441116 | + | arabinogalactan endo-1,4-beta-galactosidase, putative |
| BI00773 | 441755 | 442621 | + | oxidoreductase, aldo/keto reductase family |
| BI00774 | 442628 | 443368 | + | conserved hypothetical protein |
| BI00775 | 443378 | 444745 | − | conserved hypothetical protein |
| BI00776 | 445003 | 446367 | + | transport protein, NRAMP family |
| BI00777 | 446472 | 448073 | − | drug resistance transporter, EmrB/QacA subfamily |
| BI00778 | 448424 | 450007 | + | glycosyl transferase CpsE |
| BI00779 | 450302 | 452029 | + | COG0840: Methyl-accepting chemotaxis protein |
| BI00780 | 452064 | 453566 | + | possible Etk-like tyrosine kinase involved in Eps biosynthesis |
| BI00781 | 453760 | 454725 | + | hypothetical glycosyl transferase, group 1 family protein |
| BI00782 | 454725 | 456065 | + | putative glycosyltransferase protein |
| BI00783 | 456065 | 457126 | + | NAD dependent epimerase/dehydratase family protein |
| BI00784 | 457201 | 458448 | + | UDP-glucose 6-dehydrogenase |
| BI00785 | 458489 | 459550 | + | hypothetical glycosyl transferase, group 1 family protein |
| BI00786 | 459581 | 460408 | + | hypothetical Eps11I |
| BI00787 | 460446 | 460952 | + | hypothetical Bacterial transferase hexapeptide (three repeats) |
| BI00788 | 460985 | 461998 | + | hypothetical Capsular polysaccharide synthesis protein |
| BI00789 | 462020 | 463360 | + | hypothetical protein |
| BI00790 | 463363 | 464292 | + | Eps9K |
| BI00791 | 464362 | 465753 | + | hypothetical Polysaccharide biosynthesis protein |
| BI00792 | 465789 | 466280 | + | hypothetical Bacterial transferase hexapeptide (three repeats) |
| BI00793 | 466366 | 467514 | − | NAD-dependent epimerase/dehydratase family protein, putative |
| BI00794 | 467785 | 468363 | − | transposase, degenerate |
| BI00795 | 468615 | 468770 | − | hypothetical COG2963: Transposase and inactivated derivatives |
| BI00796 | 469189 | 470208 | + | dTDP-glucose 4,6-dehydratase |
| BI00797 | 470347 | 471303 | + | dTDP-4-dehydrorhamnose 3,5-epimerase |
| BI00798 | 471349 | 472245 | + | glucose-1-phosphate thymidylyltransferase |
| BI00799 | 472858 | 473046 | − | hypothetical protein |
| BI00800 | 473371 | 473802 | − | conserved hypothetical protein |
| BI00801 | 474083 | 474640 | − | hypothetical Low molecular weight phosphotyrosine protein phosphatase |
| BI00802 | 474825 | 475331 | − | hypothetical protein |
| BI00803 | 475655 | 475867 | − | hypothetical Helix-turn-helix |
| BI00804 | 475860 | 476042 | − | hypothetical protein |
| BI00805 | 475971 | 476312 | + | hypothetical protein |
| BI00806 | 476415 | 477422 | − | conserved hypothetical protein |
| BI00807 | 477471 | 478751 | + | narrowly conserved hypothetical protein |
| BI00808 | 477495 | 477866 | − | thioredoxin |
| BI00809 | 478880 | 479734 | + | 3-oxoadipate enol-lactonase, putative |
| BI00810 | 479747 | 481036 | + | MutT/nudix family protein |
| BI00811 | 481065 | 481475 | + | glycine cleavage system H protein |
| BI00812 | 481547 | 482875 | + | conserved hypothetical protein |
| BI00813 | 482973 | 485453 | + | protease II |
| BI00814 | 485521 | 486549 | + | 3-isopropylmalate dehydrogenase |
| BI00815 | 486610 | 487692 | + | lipoate-protein ligase a |
| BI00817 | 487934 | 488650 | + | probable transcriptional regulator with cyclic nucleotide-binding domain |

TABLE 1-continued

Open reading frames of the genome of UCC 35624.

| GeneID | Start | End | Strand | Description |
|---|---|---|---|---|
| BI00818 | 488757 | 491069 | + | ponA, putative |
| BI00819 | 491264 | 492634 | + | NADH-dependent flavin oxidoreductase, putative |
| BI00820 | 492807 | 493955 | − | dihydroorotate dehydrogenase, putative |
| BI00821 | 494409 | 495122 | + | glycerol-3-phosphate regulon repressor |
| BI00822 | 495118 | 496365 | + | galactose-1-phosphate uridylyltransferase |
| BI00823 | 496241 | 497632 | + | galactokinase |
| BI00824 | 497718 | 497987 | + | ACT domain protein |
| BI00825 | 498201 | 499487 | + | similar to unknown proteins |
| BI00826 | 499800 | 500516 | − | spoU |
| BI00827 | 500612 | 501463 | + | mutY |
| BI00828 | 501531 | 502250 | + | conserved hypothetical protein |
| BI00829 | 502633 | 505968 | + | DNA-directed RNA polymerase, beta subunit |
| BI00830 | 506139 | 510173 | + | DNA-directed RNA polymerase, beta-prime subunit |
| BI00831 | 510338 | 510967 | − | FHA domain protein |
| BI00832 | 510986 | 511498 | − | hypothetical protein Blon020438 |
| BI00833 | 511528 | 512457 | − | possible phosphoprotein phosphatase |
| BI00834 | 512457 | 514967 | − | membrane protein, putative |
| BI00835 | 514967 | 516187 | − | Protein of unknown function family |
| BI00836 | 516215 | 517585 | − | moxR2 |
| BI00837 | 517599 | 523580 | − | cell wall surface anchor family protein, putative |
| BI00838 | 523750 | 525168 | − | serine/threonine protein kinase, putative |
| BI00839 | 525300 | 529592 | + | hypothetical COG0210: Superfamily I DNA and RNA helicases |
| BI00840 | 529427 | 533620 | + | UvrD/REP helicase domain protein |
| BI00841 | 533962 | 535152 | + | possible transport protein |
| BI00842 | 535527 | 536243 | + | dihydrodipicolinate reductase |
| BI00843 | 536388 | 537311 | + | dihydrodipicolinate synthase |
| BI00844 | 537585 | 539246 | + | metallo-beta-lactamase superfamily protein |
| BI00845 | 539291 | 541897 | + | Peptidase family M1 domain protein |
| BI00846 | 542078 | 542971 | + | hypothetical transmembrane protein with unknown function |
| BI00847 | 543164 | 543502 | + | conserved hypothetical protein |
| BI00848 | 543954 | 545336 | + | phosphoglucosamine mutase |
| BI00849 | 545362 | 546012 | + | polypeptide deformylase |
| BI00850 | 546072 | 547472 | + | conserved hypothetical protein |
| BI00851 | 547492 | 547620 | + | hypothetical protein |
| BI00852 | 547858 | 548979 | + | peptide chain release factor 2 |
| BI00853 | 548991 | 550121 | + | ftsE |
| BI00854 | 550135 | 551055 | + | cell division ABC transporter, permease protein FtsX, putative |
| BI00855 | 551161 | 552519 | + | autolysin, putative |
| BI00856 | 552673 | 553146 | + | SsrA-binding protein |
| BI00857 | 553192 | 554265 | + | amino acid ABC transporter, permease protein |
| BI00858 | 554479 | 555420 | + | amino acid ABC transporter, permease protein |
| BI00859 | 555554 | 556546 | + | amino acid ABC transporter, permease protein |
| BI00860 | 556566 | 557393 | + | glutamine ABC transporter, ATP-binding protein |
| BI00861 | 557604 | 559493 | + | glucosamine--fructose-6-phosphate aminotransferase, isomerizing |
| BI00862 | 559699 | 560271 | + | COG0564: Pseudouridylate synthases, 23S RNA-specific |
| BI00863 | 560313 | 560525 | − | hypothetical protein Blon020898 |
| BI00864 | 560565 | 561548 | − | transcriptional regulator, LacI family, putative |
| BI00865 | 561794 | 562717 | + | sugar ABC transporter, permease protein, putative |
| BI00866 | 562776 | 563780 | + | Unknown |
| BI00867 | 563975 | 566047 | + | beta-D-galactosidase |
| BI00868 | 566259 | 567185 | + | transcriptional regulator, LacI family, putative |
| BI00869 | 567311 | 569008 | − | alpha-L-arabinofuranosidase |
| BI00870 | 569168 | 570517 | + | solute binding protein of ABC transporter system |
| BI00871 | 570852 | 572192 | + | probable solute binding protein of ABC transporter system for sugars |
| BI00872 | 572449 | 573729 | + | sugar binding protein Sbp |
| BI00873 | 573795 | 574562 | − | transcription activator, probable Baf family [imported] |
| BI00874 | 574688 | 576304 | + | ABC transporter, periplasmic substrate-binding protein, putative |
| BI00875 | 576372 | 577346 | + | membrane protein, putative |
| BI00876 | 577346 | 578245 | + | peptide ABC transporter, permease protein, putative |
| BI00877 | 578245 | 579033 | + | ABC transporter, nucleotide binding/ATPase protein |
| BI00878 | 579029 | 579811 | + | ABC transporter, ATP-binding protein |
| BI00879 | 580296 | 581360 | + | cystathionine beta-synthase |
| BI00880 | 581455 | 582636 | + | cystathionine beta-lyase |
| BI00881 | 582780 | 584501 | − | ErfK/YbiS/YcfS/YnhG family |
| BI00882 | 584781 | 586613 | + | ATP-dependent DNA helicase RecQ |

TABLE 1-continued

Open reading frames of the genome of UCC 35624.

| GeneID | Start | End | Strand | Description |
|---|---|---|---|---|
| BI00883 | 586729 | 587220 | + | autoinducer-2 production protein LuxS |
| BI00884 | 587453 | 587917 | + | acetyltransferase, GNAT family, putative |
| BI00885 | 588181 | 589638 | − | hypothetical protein Blon020876 |
| BI00886 | 589890 | 591347 | − | amino acid permease |
| BI00887 | 591542 | 592891 | + | alanine racemase |
| BI00888 | 593087 | 594370 | + | deoxyguanosinetriphosphate triphosphohydrolase, putative |
| BI00889 | 594546 | 596642 | + | DNA primase, putative |
| BI00890 | 596961 | 597710 | + | pyridoxine biosynthesis protein |
| BI00891 | 597799 | 598434 | + | SNO glutamine amidotransferase family superfamily |
| BI00892 | 598495 | 600156 | + | aminotransferase, class I, putative |
| BI00893 | 600514 | 601443 | + | asparaginase family protein |
| BI00894 | 601476 | 601607 | + | hypothetical protein Blon020867 |
| BI00895 | 601574 | 601897 | − | hypothetical protein |
| BI00896 | 601995 | 603179 | + | possible transport protein |
| BI00897 | 603210 | 603467 | − | hypothetical protein Blon020865 |
| BI00898 | 603634 | 603723 | + | hypothetical protein |
| BI00899 | 603651 | 605795 | − | similar to alpha-L-arabinofuranosidase A |
| BI00900 | 605923 | 606921 | + | EF0065, putative |
| BI00901 | 607014 | 608087 | − | conserved hypothetical protein |
| BI00902 | 608687 | 609373 | + | ABC transporter, ATP-binding protein |
| BI00903 | 609373 | 610545 | + | conserved hypothetical protein |
| BI00904 | 610560 | 612116 | + | ABC transporter, ATP-binding protein |
| BI00905 | 612106 | 614304 | − | 1-deoxyxylulose-5-phosphate synthase |
| BI00906 | 614478 | 615467 | + | oxidoreductase, zinc-binding, putative |
| BI00907 | 615572 | 616069 | + | phosphoribosylaminoimidazole carboxylase, catalytic subunit |
| BI00908 | 616095 | 617231 | + | phosphoribosylaminoimidazole carboxylase, ATPase subunit |
| BI00909 | 617243 | 617668 | + | furB |
| BI00910 | 617709 | 617954 | − | conserved hypothetical protein |
| BI00911 | 618183 | 619103 | + | possible solute binding protein of ABC transporter system |
| BI00912 | 619367 | 621439 | + | membrane protein, putative |
| BI00913 | 621563 | 623197 | + | aldehyde dehydrogenase |
| BI00914 | 623577 | 624842 | − | phosphoribosylamine--glycine ligase |
| BI00915 | 624872 | 625702 | − | phosphoribosylformylglycinamidine cyclo-ligase |
| BI00916 | 626029 | 627537 | − | amidophosphoribosyltransferase |
| BI00917 | 627944 | 628726 | − | glutamine ABC transporter, ATP-binding protein |
| BI00918 | 628726 | 629610 | − | amino acid ABC transporter, permease protein |
| BI00919 | 629723 | 630583 | − | amino acid ABC transporter, periplasmic amino acid-binding protein |
| BI00920 | 630788 | 631255 | − | conserved hypothetical protein |
| BI00921 | 631328 | 632698 | − | Atz/Trz family protein, putative |
| BI00922 | 632741 | 634240 | − | S-adenosyl-L-homocysteine hydrolase, NAD binding domain |
| BI00923 | 634405 | 635991 | + | structural gene for ultraviolet resistance |
| BI00924 | 635991 | 636206 | + | hypothetical protein Blon020836 |
| BI00925 | 636246 | 637220 | − | K+ channel, beta subunit |
| BI00926 | 637331 | 638293 | − | transcriptional regulator, HTH_1 family, putative |
| BI00927 | 638512 | 640023 | + | Na+/H+ antiporter, putative |
| BI00928 | 640043 | 640699 | − | membrane protein, putative |
| BI00929 | 640699 | 642066 | − | conserved hypothetical protein |
| BI00930 | 642042 | 643337 | − | possible carboxylesterase or lipase |
| BI00931 | 643478 | 647209 | − | phosphoribosylformylglycinamidine synthase |
| BI00932 | 647275 | 648024 | − | phosphoribosylaminoimidazole-succinocarboxamide synthase |
| BI00933 | 648113 | 648232 | − | hypothetical protein |
| BI00934 | 648420 | 649754 | − | phosphoribosylglycinamide formyltransferase 2 VC1228 [imported] |
| BI00935 | 649928 | 651085 | + | type 1 capsular polysaccharide biosynthesis protein J (capJ) |
| BI00936 | 651238 | 652260 | − | conserved hypothetical protein |
| BI00937 | 652822 | 653880 | + | transporter |
| BI00938 | 654695 | 654967 | + | ribosomal protein S12 |
| BI00939 | 654976 | 655443 | + | ribosomal protein S7 |
| BI00940 | 655478 | 657598 | + | translation elongation factor G |
| BI00941 | 657774 | 658970 | + | translation elongation factor Tu |
| BI00942 | 659184 | 659909 | + | conserved hypothetical protein |
| BI00943 | 660169 | 660864 | + | transcriptional regulator, LysR family, putative |
| BI00944 | 661085 | 662098 | + | membrane protein, putative |
| BI00945 | 662161 | 662637 | − | COG2246: Predicted membrane protein |
| BI00946 | 662721 | 663083 | − | CrcB protein |
| BI00947 | 663086 | 663619 | − | protein with similarity to CrcB |
| BI00948 | 663706 | 663987 | + | hypothetical protein |

TABLE 1-continued

Open reading frames of the genome of UCC 35624.

| GeneID | Start | End | Strand | Description |
|---|---|---|---|---|
| BI00949 | 664023 | 665063 | + | alcohol dehydrogenase, zinc-containing |
| BI00950 | 665437 | 665625 | + | hypothetical protein |
| BI00951 | 665652 | 667028 | − | conserved hypothetical protein |
| BI00952 | 667295 | 667462 | − | possible MarR-type transcriptional regulator |
| BI00953 | 667902 | 670487 | + | excinuclease ABC, subunit A |
| BI00954 | 670548 | 671903 | + | MATE efflux family protein, putative |
| BI00955 | 671914 | 672603 | + | endonuclease III, putative |
| BI00956 | 672783 | 673076 | − | hypothetical protein Blon020400 |
| BI00957 | 673098 | 673766 | + | Unknown |
| BI00958 | 673782 | 674042 | − | hexapeptide-repeat containing-acetyltransferase |
| BI00959 | 674207 | 675292 | + | possible integral membrane permease protein |
| BI00960 | 675273 | 675902 | + | hypothetical Glycosyl hydrolases family 2, TIM barrel domain |
| BI00961 | 676090 | 677316 | − | glutamine synthetase, type I |
| BI00962 | 677846 | 678625 | − | narrowly conserved hypothetical transmembrane protein |
| BI00963 | 678712 | 680199 | − | dihydrolipoamide dehydrogenase |
| BI00964 | 680351 | 680971 | − | conserved hypothetical protein |
| BI00965 | 681063 | 682427 | + | widely conserved protein in peptidase or deacetlylase family |
| BI00966 | 682730 | 683326 | + | conserved hypothetical protein |
| BI00967 | 683329 | 684801 | + | ABC transporter, ATP-binding protein, putative |
| BI00968 | 684801 | 685625 | + | possible permease protein of ABC transporter for cobalt |
| BI00969 | 685824 | 686699 | + | spoU rRNA methylase family protein [imported] |
| BI00970 | 686891 | 687820 | + | phenylalanyl-tRNA synthetase, alpha subunit |
| BI00971 | 687831 | 690437 | + | phenylalanyl-tRNA synthetase, beta subunit |
| BI00972 | 690471 | 691154 | + | conserved hypothetical protein |
| BI00973 | 691385 | 692347 | + | N-acetyl-gamma-glutamyl-phosphate reductase |
| BI00974 | 692434 | 693519 | + | arginine biosynthesis bifunctional protein ArgJ |
| BI00013g | 693503 | 693979 | − | hypothetical protein Magn025872 |
| BI00975 | 693809 | 694612 | + | acetylglutamate kinase |
| BI00976 | 694605 | 695897 | + | acetylornithine aminotransferase |
| BI00977 | 695944 | 696906 | + | ornithine carbamoyltransferase |
| BI00978 | 696906 | 697415 | + | arginine repressor |
| BI00979 | 697501 | 698736 | + | argininosuccinate synthase |
| BI00980 | 699184 | 700653 | + | argininosuccinate lyase |
| BI01326t | 701005 | 701196 | + | thiamine biosynthesis protein ThiS |
| BI00981 | 701211 | 702077 | + | thiG protein |
| BI00982 | 702157 | 702963 | + | moeB |
| BI00983 | 703023 | 703376 | + | rhodanese-like domain protein |
| BI00984 | 703541 | 704071 | + | HD domain protein |
| BI00985 | 703978 | 704835 | + | hypothetical |
| BI00986 | 704964 | 706283 | + | tyrosyl-tRNA synthetase |
| BI00987 | 706314 | 708086 | + | hypothetical protein BL1050 |
| BI00988 | 708098 | 709135 | + | Predicted sugar phosphatases of the HAD superfamily |
| BI00989 | 709395 | 710165 | + | hemolysin A |
| BI00990 | 710153 | 710719 | − | conserved hypothetical protein |
| BI00991 | 710729 | 710881 | + | hypothetical protein |
| BI00992 | 710965 | 711624 | − | similar to a bacterial K(+)-uptake system |
| BI00993 | 711678 | 713141 | − | Cation transport protein domain protein |
| BI00994 | 713388 | 714407 | + | poly(P)/ATP-NAD kinase |
| BI00995 | 714410 | 716233 | + | DNA repair protein RecN |
| BI00996 | 716266 | 716910 | + | hydrolase, haloacid dehalogenase-like family, putative |
| BI00997 | 717154 | 717525 | + | transcriptional regulator, GntR family |
| BI00998 | 717550 | 718467 | + | ABC transporter, ATP-binding protein |
| BI01351t | 718477 | 719091 | + | membrane protein, putative |
| BI00999 | 719985 | 722768 | − | calcium-translocating P-type ATPase, PMCA-type |
| BI01000 | 722966 | 723238 | + | hypothetical protein BL1037 |
| BI01001 | 723291 | 724778 | − | threonine synthase |
| BI01356t | 725001 | 725699 | + | serine hydroxymethyltransferase |
| BI01002 | 726028 | 727116 | + | gamma-glutamyl phosphate reductase |
| BI01003 | 727134 | 727694 | + | conserved hypothetical protein |
| BI01004 | 727694 | 728476 | + | nicotinate (nicotinamide) nucleotide adenylyltransferase |
| BI01005 | 728580 | 729857 | − | glycosyl hydrolase, family 3, putative |
| BI01006 | 729952 | 733203 | + | Uncharacterized ACR |
| BI01007 | 733340 | 733834 | + | phosphinothricin acetyltransferase |
| BI01008 | 734033 | 734629 | + | peptidyl-tRNA hydrolase |
| BI01009 | 734622 | 738203 | + | transcription-repair coupling factor |
| BI01010 | 738346 | 739290 | + | oxidoreductase, putative |
| BI01011 | 739444 | 740739 | + | enolase |
| BI01012 | 740809 | 741423 | + | hypothetical Septum formation initiator |

TABLE 1-continued

Open reading frames of the genome of UCC 35624.

| GeneID | Start | End | Strand | Description |
|---|---|---|---|---|
| BI01013 | 741423 | 741986 | + | conserved hypothetical protein |
| BI01014 | 742052 | 743050 | + | possible exopolyphosphatase-like protein |
| BI01015 | 743578 | 744711 | + | IS30 family, transposase [imported] |
| BI01016 | 744846 | 747062 | + | L-serine dehydratase 1 |
| BI01018 | 747207 | 747611 | + | peptidyl-prolyl cis-trans isomerase, FKBP-type |
| BI01019 | 747713 | 748189 | + | transcription elongation factor GreA |
| BI01020 | 748250 | 749191 | − | hemolysin, putative |
| BI01021 | 749361 | 750086 | + | conserved hypothetical protein |
| BI01022 | 750474 | 751736 | + | histidine kinase-like protein |
| BI01023 | 751815 | 752090 | − | hypothetical Transcription factor WhiB |
| BI01024 | 752207 | 753922 | − | diarrheal toxin |
| BI01025 | 754203 | 755633 | − | Transcriptional regulator |
| BI01389t | 755884 | 756180 | + | whiB1 |
| BI01026 | 756350 | 759319 | + | membrane protein, putative |
| BI01027 | 759319 | 760857 | + | LPXTG-motif cell wall anchor domain protein, putative |
| BI01028 | 760966 | 761391 | − | conserved hypothetical protein |
| BI01029 | 761660 | 762283 | + | conserved hypothetical protein |
| BI01030 | 762332 | 763015 | + | Phosphoribosyl transferase domain protein |
| BI00019g | 762937 | 763509 | − | hypothetical Peptidase family S24 |
| BI01031 | 763391 | 764464 | − | sensory box histidine kinase, putative |
| BI01032 | 764464 | 765183 | − | DNA-binding response regulator MtrA |
| BI01033 | 765222 | 767432 | − | 1,4-alpha-glucan branching enzyme |
| BI01034 | 767649 | 768239 | + | possible transcriptional regulator |
| BI01035 | 768351 | 768872 | + | 2C-methyl-D-erythritol 2,4-cyclodiphosphate synthase |
| BI01036 | 768930 | 769760 | − | zinc ABC transporter, permease protein, putative |
| BI01037 | 769830 | 770834 | − | ABC transporter, ATP-binding protein |
| BI01038 | 770893 | 772419 | − | possible solute binding protein of ABC transporter system |
| BI01039 | 772190 | 773062 | + | methylenetetrahydrofolate dehydrogenase/methenyltetrahydrofolate cyclohydrolase |
| BI01040 | 773185 | 774657 | + | ribosomal protein S1 [imported] |
| BI01041 | 774834 | 775448 | + | dephospho-CoA kinase |
| BI01042 | 775463 | 777571 | + | excinuclease ABC, B subunit |
| BI01043 | 777887 | 778726 | + | TerC family protein [imported] |
| BI01044 | 778897 | 780336 | + | pyruvate kinase |
| BI01045 | 780490 | 781086 | − | possible NTP pyrophosphatase in MutT family |
| BI01046 | 781432 | 782214 | + | response regulator |
| BI01047 | 782278 | 785127 | + | DNA polymerase I |
| BI01048 | 785291 | 786217 | + | conserved hypothetical protein TIGR00486 |
| BI01049 | 786266 | 786937 | + | MutT/nudix family protein, putative |
| BI01050 | 787135 | 789132 | + | glycogen operon protein GlgX |
| BI01424t | 789186 | 789413 | + | hypothetical protein with helix turn helix motif |
| BI01051 | 789420 | 790067 | + | conserved hypothetical protein |
| BI01052 | 790243 | 790794 | − | DNA-3-methyladenine glycosylase I |
| BI01053 | 791884 | 792942 | − | hypothetical protein |
| BI01054 | 793226 | 793780 | + | hypothetical protein |
| BI01055 | 793761 | 794246 | − | hypothetical protein |
| BI00021g | 794049 | 794498 | + | transposase B |
| BI00020g | 794300 | 794749 | + | IS1601-D |
| BI01056 | 794665 | 794844 | + | transposase subunit B |
| BI01057 | 794937 | 795989 | − | integrase/recombinase XerC, probable [imported], putative |
| BI01434t | 795989 | 796876 | − | probable integrase/recombinase |
| BI01058 | 796951 | 798150 | − | probable integrase/recombinase |
| BI01059 | 798284 | 799564 | − | IS3-Spn1, transposase |
| BI01060 | 799635 | 800477 | − | putative transposase subunit |
| BI01061 | 800762 | 802579 | − | hypothetical Protein of unknown function DUF262 |
| BI01062 | 802742 | 803464 | − | hypothetical protein |
| BI01063 | 803748 | 804065 | − | conserved hypothetical protein |
| BI01064 | 804058 | 804405 | − | hypothetical protein |
| BI01065 | 804667 | 808221 | + | DNA polymerase III, alpha chain VC2245 [imported] |
| BI01066 | 808312 | 808743 | + | conserved hypothetical protein |
| BI01067 | 808952 | 810826 | + | antigen, 67 kDa |
| BI01068 | 810916 | 811413 | + | NH2-acetyltransferase |
| BI01069 | 817553 | 818377 | − | oxidoreductase, aldo/keto reductase family |
| BI01070 | 818538 | 819956 | + | sugar kinase, FGGY family, putative |
| BI01451t | 819972 | 820262 | + | Acylphosphatase |
| BI01071 | 820382 | 821761 | + | histidinol dehydrogenase |
| BI01072 | 821761 | 822918 | + | histidinol-phosphate aminotransferase |
| BI01073 | 823007 | 823603 | + | imidazoleglycerol-phosphate dehydratase |
| BI01074 | 823606 | 824397 | + | hypothetical protein Blon020586 |

TABLE 1-continued

Open reading frames of the genome of UCC 35624.

| GeneID | Start | End | Strand | Description |
|---|---|---|---|---|
| BI01075 | 824435 | 825079 | + | imidazole glycerol phosphate synthase, glutamine amidotransferase subunit |
| BI01076 | 825152 | 825874 | + | bifunctional HisA/TrpF protein |
| BI01077 | 825984 | 826103 | − | narrowly conserved hypothetical protein |
| BI01463t | 826039 | 827637 | − | conserved hypothetical protein |
| BI01078 | 827738 | 828898 | + | Glutamine synthetase, catalytic domain |
| BI01079 | 829137 | 829604 | + | transporter, putative |
| BI01080 | 829657 | 830625 | − | conserved hypothetical protein |
| BI01081 | 830625 | 834758 | − | ATP-dependent helicase HrpA |
| BI01082 | 834751 | 835404 | − | conserved hypothetical protein |
| BI01083 | 835647 | 837065 | + | GTP-binding protein |
| BI01084 | 837405 | 838208 | + | L-lactate dehydrogenase |
| BI01085 | 838356 | 839291 | − | cation efflux system protein |
| BI01086 | 839460 | 840182 | − | LexA repressor |
| BI01087 | 840333 | 840680 | + | LysM domain protein |
| BI01088 | 840736 | 841173 | + | conserved hypothetical protein TIGR00244 |
| BI01089 | 841314 | 842510 | − | D-3-phosphoglycerate dehydrogenase |
| BI01090 | 842524 | 844800 | − | COG3973: Superfamily I DNA and RNA helicases |
| BI01091 | 845133 | 845651 | + | conserved hypothetical protein TIGR00242 |
| BI01092 | 845654 | 846730 | + | S-adenosyl-methyltransferase MraW |
| BI01093 | 846740 | 847186 | + | hypothetical protein Blon020568 |
| BI01094 | 847186 | 848985 | + | penicillin-binding protein, putative |
| BI01095 | 849015 | 849884 | + | conserved hypothetical protein |
| BI01096 | 849936 | 851384 | + | UDP-N-acetylmuramoylalanyl-D-glutamyl-2,6-diaminopimelate--D-alanyl-D-alanyl ligase |
| BI01097 | 851453 | 852535 | + | phospho-N-acetylmuramoyl-pentapeptide-transferase |
| BI01098 | 852593 | 854035 | + | UDP-N-acetylmuramoylalanine--D-glutamate ligase |
| BI01099 | 854025 | 855239 | + | cell division protein, FtsW/RodA/SpoVE family, putative |
| BI01100 | 855258 | 856436 | + | UDP-N-acetylglucosamine--N-acetylmuramyl-(pentapeptide) pyrophosphoryl-undecaprenol N-acetylglucosamine transferase |
| BI01101 | 856651 | 858075 | + | UDP-N-acetylmuramate--alanine ligase |
| BI01102 | 858078 | 859139 | + | hypothetical Cell division protein FtsQ |
| BI01103 | 859565 | 860983 | + | hypothetical Appr-1-p processing enzyme family |
| BI01104 | 861241 | 861813 | + | unknown |
| BI01105 | 861640 | 861885 | − | hypothetical protein |
| BI01106 | 861906 | 862391 | + | D-tyrosyl-tRNA(Tyr) deacylase |
| BI01107 | 862494 | 863735 | − | glucose/galactose transporter, putative |
| BI01108 | 863844 | 864230 | − | hypothetical glyoxalase family protein |
| BI01109 | 864308 | 865201 | − | fructokinase, putative |
| BI01110 | 865277 | 866488 | − | transcription regulator ROK family VC2007 [imported], putative |
| BI01111 | 866715 | 867626 | + | glucokinase, putative |
| BI01112 | 867792 | 868913 | − | NagC/XylR-type transcriptional regulator |
| BI01113 | 869251 | 870060 | + | glucosamine-6-phosphate isomerase |
| BI01114 | 870119 | 871393 | + | N-acetylglucosamine-6-phosphate deacetylase |
| BI01115 | 871646 | 873307 | + | dipeptide ABC transporter, dipeptide-binding protein |
| BI01116 | 873480 | 874568 | + | oligopeptide ABC transporter, permease protein |
| BI01117 | 874714 | 875739 | + | dipeptide ABC transporter, permease protein |
| BI01118 | 875746 | 877452 | + | ATP binding protein of ABC transporter |
| BI01119 | 877508 | 878026 | − | MutT/nudix family protein |
| BI01120 | 878078 | 879670 | − | Xaa-Pro aminopeptidase I |
| BI01121 | 879977 | 880954 | − | conserved hypothetical protein |
| BI01122 | 882044 | 883672 | + | folC |
| BI01123 | 883736 | 887410 | + | SMC family, C-terminal domain family |
| BI01124 | 887535 | 888527 | − | conserved hypothetical protein |
| BI01125 | 888652 | 890202 | − | UDP-N-acetylmuramoylalanyl-D-glutamate-2,6-diaminopimelate ligase |
| BI01126 | 890377 | 891126 | + | RNA polymerase sigma-70 factor, ECF subfamily |
| BI01127 | 891129 | 891446 | + | conserved hypothetical protein |
| BI01128 | 891719 | 892660 | − | Aldose 1-epimerase superfamily |
| BI01129 | 892788 | 893741 | − | Aldose 1-epimerase superfamily |
| BI01130 | 894032 | 895021 | + | hydroxymethylbutenyl pyrophosphate reductase |
| BI01131 | 895067 | 895573 | − | transcriptional regulator, putative |
| BI01132 | 895670 | 896725 | − | glyceraldehyde-3-phosphate dehydrogenase, type I |
| BI01133 | 896968 | 897690 | − | Thiamin pyrophosphokinase, catalytic domain family |
| BI01134 | 897586 | 898923 | + | hypothetical Spermine/spermidine synthase |
| BI01135 | 899364 | 899930 | + | Translation initiation factor IF-3, C-terminal domain |

TABLE 1-continued

Open reading frames of the genome of UCC 35624.

| GeneID | Start | End | Strand | Description |
|---|---|---|---|---|
| BI00041g | 899764 | 900105 | + | ribosomal protein L35 |
| BI01136 | 900161 | 900541 | + | ribosomal protein L20 |
| BI01137 | 900605 | 901537 | + | Integrase |
| BI01138 | 901668 | 904511 | + | ABC transporter, ATP-binding protein |
| BI01139 | 904656 | 905612 | + | Soj family protein |
| BI01140 | 905634 | 906545 | + | Uncharacterised ACR, COG1354 |
| BI01141 | 906675 | 907274 | + | conserved hypothetical protein TIGR00281 |
| BI01142 | 907409 | 908233 | + | MutT/nudix family protein |
| BI01143 | 908296 | 909573 | + | quinolinate synthetase complex, A subunit |
| BI01144 | 909668 | 911296 | + | L-aspartate oxidase |
| BI01145 | 911303 | 912193 | + | nicotinate-nucleotide pyrophosphorylase |
| BI01146 | 912292 | 913443 | + | possible pyridoxal-phosphate-dependent aminotransferase |
| BI01147 | 913478 | 914824 | + | major facilitator family transporter |
| BI01148 | 915142 | 917070 | + | GTP-binding protein TypA |
| BI01149 | 917197 | 917616 | + | conserved hypothetical protein |
| BI01150 | 917699 | 918673 | + | prephenate dehydratase, putative |
| BI01151 | 918670 | 919734 | + | prephenate dehydrogenase |
| BI01152 | 919947 | 920201 | + | conserved hypothetical protein |
| BI01153 | 920239 | 921303 | + | phage integrase family protein |
| BI01154 | 921559 | 923196 | + | solute binding protein of ABC transporter system possibly for peptides |
| BI01155 | 923500 | 924423 | + | dppB |
| BI01156 | 924445 | 925446 | + | dppC |
| BI01157 | 925505 | 927478 | + | ABC-type transporter, duplicated ATPase component |
| BI01158 | 927793 | 928650 | − | exodeoxyribonuclease III |
| BI01159 | 928775 | 929626 | + | conserved hypothetical protein |
| BI01160 | 929645 | 930400 | + | narrowly conserved hypothetical transmembrane protein |
| BI01161 | 930393 | 931658 | + | RNA methyltransferase, TrmA family |
| BI01162 | 931673 | 932365 | + | lipoprotein, putative |
| BI01163 | 932483 | 935032 | + | cation-transporting ATPase, E1-E2 family |
| BI01164 | 935156 | 937852 | + | aconitate hydratase 1 |
| BI01165 | 938001 | 938360 | + | Ribbon-helix-helix protein, copG family domain protein |
| BI01166 | 938363 | 938851 | + | PIN domain, putative |
| BI01167 | 938917 | 941019 | − | Protein of unknown function DUF262 family |
| BI01168 | 941112 | 941777 | − | acetyltransferase, GNAT family family |
| BI01169 | 941793 | 942608 | − | DNA-binding response regulator, putative |
| BI01170 | 942553 | 943935 | − | atypical histidine kinase sensor of two-component system |
| BI01171 | 944117 | 944959 | + | conserved hypothetical protein |
| BI01172 | 945143 | 946039 | + | membrane protein, putative |
| BI01173 | 946326 | 947195 | + | membrane protein, putative |
| BI01174 | 947234 | 948073 | − | GTP pyrophosphokinase [imported] |
| BI01175 | 948115 | 949554 | + | tRNA-i(6)A37 thiotransferase enzyme MiaB |
| BI01176 | 949568 | 950551 | + | tRNA delta(2)-isopentenylpyrophosphate transferase |
| BI01177 | 950591 | 951517 | − | Fic protein family family |
| BI01178 | 951663 | 954437 | + | cell division protein FtsK |
| BI01179 | 954635 | 955267 | + | CDP-diacylglycerol--glycerol-3-phosphate 3-phosphatidyltransferase |
| BI01180 | 955282 | 955812 | + | competence/damage-inducible protein CinA domain protein |
| BI01181 | 955881 | 956387 | + | possible DNA binding protein |
| BI01182 | 956502 | 956732 | + | conserved hypothetical protein |
| BI01183 | 957036 | 958226 | + | recA protein |
| BI01184 | 958232 | 958822 | + | regulatory protein RecX |
| BI01185 | 959702 | 960361 | + | S30AE family protein |
| BI01186 | 960556 | 963417 | + | preprotein translocase, SecA subunit |
| BI00044g | 963734 | 963970 | − | COG3464: Transposase and inactivated derivatives |
| BI01187 | 963974 | 964096 | − | COG3464: Transposase and inactivated derivatives |
| BI00045g | 964219 | 964602 | + | hypothetical protein BL0497 |
| BI01188 | 964674 | 965717 | + | anthranilate phosphoribosyltransferase |
| BI01189 | 965964 | 966686 | − | hypothetical transmembrane protein with unknown function |
| BI01190 | 966447 | 967418 | + | hypothetical Acyltransferase |
| BI01191 | 967476 | 969722 | + | serine/threonine protein kinase, putative |
| BI01192 | 969893 | 970858 | − | idsA2 |
| BI01193 | 971179 | 971838 | + | conserved hypothetical protein |
| BI01194 | 972002 | 973465 | + | RNA polymerase principal sigma factor, sigma 70 |
| BI01195 | 973526 | 975799 | + | DNA gyrase, subunit B |
| BI01196 | 975969 | 977192 | + | membrane protein, putative |

TABLE 1-continued

Open reading frames of the genome of UCC 35624.

| GeneID | Start | End | Strand | Description |
|---|---|---|---|---|
| BI01197 | 977269 | 978228 | + | ribokinase |
| BI01198 | 978247 | 982977 | + | DEAD/DEAH box helicase domain protein |
| BI01199 | 982994 | 983779 | − | DNA-binding response regulator TcrA, putative |
| BI01200 | 983927 | 986953 | − | DNA gyrase A subunit |
| BI01201 | 986925 | 988169 | + | conserved hypothetical protein |
| BI01202 | 988185 | 989189 | − | conserved hypothetical protein |
| BI01203 | 989432 | 989722 | + | conserved hypothetical protein |
| BI01204 | 989725 | 990198 | + | deoxyuridine 5triphosphate nucleotidohydrolase |
| BI01205 | 990335 | 992656 | + | GTP pyrophosphokinase |
| BI01206 | 992780 | 993058 | − | orfB |
| BI01207 | 993226 | 994425 | + | probable integrase/recombinase |
| BI01640t | 994500 | 995387 | + | probable integrase/recombinase |
| BI01208 | 995387 | 996439 | + | integrase/recombinase XerC, probable [imported], putative |
| BI01209 | 996532 | 997095 | − | COG2801: Transposase and inactivated derivatives |
| BI00053g | 997107 | 997619 | − | ASOPSNART-11OSRSI |
| BI01210 | 997719 | 998264 | − | possible peptidyl-prolyl cis-trans isomerase |
| BI01211 | 998331 | 999296 | − | COG3391: Uncharacterized conserved protein |
| BI01212 | 999519 | 999623 | − | hypothetical protein |
| BI01213 | 999683 | 1000615 | − | membrane protein, putative |
| BI01214 | 1000747 | 1001295 | + | Hypothetical cytosolic protein |
| BI01215 | 1001329 | 1002621 | − | conserved hypothetical protein |
| BI01216 | 1002648 | 1003532 | + | possible phosphoglycerate mutase |
| BI01217 | 1003650 | 1004597 | + | magnesium transporter, CorA family |
| BI01218 | 1004615 | 1005538 | + | glnH, putative |
| BI01219 | 1005776 | 1008544 | + | leucyl-tRNA synthetase |
| BI01220 | 1008708 | 1009484 | + | competence protein ComEA helix-hairpin-helix repeat region domain protein |
| BI01221 | 1009553 | 1011235 | + | conserved hypothetical transmembrane protein related to ComA |
| BI01222 | 1011378 | 1012721 | + | possible prolidase (X-Pro dipeptidase) or chlorohydrolase |
| BI01223 | 1012791 | 1013759 | + | conserved hypothetical protein |
| BI01224 | 1013783 | 1014346 | + | conserved hypothetical protein TIGR00150 |
| BI01225 | 1014411 | 1015289 | + | conserved hypothetical protein |
| BI01226 | 1015308 | 1015859 | + | ribosomal-protein-alanine acetyltransferase |
| BI01227 | 1015859 | 1016899 | + | O-sialoglycoprotein endopeptidase |
| BI01228 | 1017438 | 1017539 | − | hypothetical protein |
| BI01229 | 1017569 | 1018501 | + | probable integrase/recombinse |
| BI01230 | 1018564 | 1018887 | − | conserved hypothetical protein |
| BI01231 | 1018909 | 1019787 | − | conserved hypothetical protein |
| BI01232 | 1019849 | 1020361 | − | conserved hypothetical protein |
| BI01233 | 1020474 | 1021376 | − | Fic protein family family |
| BI01234 | 1021357 | 1021929 | − | hypothetical protein BL1463 |
| BI01235 | 1021949 | 1023763 | − | conserved hypothetical protein |
| BI01236 | 1023782 | 1024864 | − | conserved hypothetical protein |
| BI01237 | 1024893 | 1025600 | − | conserved hypothetical protein |
| BI01238 | 1025761 | 1026843 | − | possible TraG-related protein |
| BI01239 | 1026843 | 1027799 | − | hypothetical protein Blon020262 |
| BI01240 | 1027799 | 1028164 | − | hypothetical protein Blon020261 |
| BI01242 | 1028379 | 1028669 | + | hypothetical protein Blon020260 |
| BI01241 | 1028588 | 1030942 | + | DNA topoisomerase III |
| BI01243 | 1030771 | 1031448 | + | hypothetical protein Blon020258 |
| BI01244 | 1031753 | 1032193 | + | COG1758: DNA-directed RNA polymerase, subunit K/omega |
| BI01245 | 1032161 | 1032553 | − | hypothetical protein Blon020256 |
| BI01246 | 1032621 | 1033400 | − | Fic protein family family |
| BI01247 | 1033518 | 1034822 | + | MC38, putative |
| BI01248 | 1034848 | 1036128 | − | PUTATIVE HIPA TRANSCRIPTION REGULATOR PROTEIN |
| BI01249 | 1036128 | 1036439 | − | hypothetical protein Blon020251 |
| BI01250 | 1036545 | 1037675 | − | conserved hypothetical protein |
| BI01251 | 1038618 | 1040387 | − | MC40 |
| BI01252 | 1040507 | 1041145 | − | conserved hypothetical protein |
| BI01253 | 1041250 | 1042281 | − | conserved hypothetical protein |
| BI01254 | 1042389 | 1042865 | − | conserved hypothetical protein |
| BI01255 | 1043244 | 1044842 | − | ATP binding protein-like protein |
| BI01256 | 1044857 | 1046341 | − | conserved hypothetical protein |
| BI01257 | 1046369 | 1048195 | − | lipoprotein, putative |
| BI01258 | 1048370 | 1048669 | − | conserved hypothetical protein |
| BI01259 | 1048710 | 1049189 | − | MC47, putative |
| BI01713t | 1049183 | 1050538 | + | hypothetical protein BL1487 |
| BI01260 | 1049206 | 1050405 | − | hypothetical protein |
| BI01261 | 1050435 | 1051070 | − | hypothetical protein Blon020236 |
| BI01262 | 1051396 | 1056213 | − | hypothetical COG2217: Cation transport ATPase |

TABLE 1-continued

Open reading frames of the genome of UCC 35624.

| GeneID | Start | End | Strand | Description |
|---|---|---|---|---|
| BI01263 | 1056508 | 1057458 | − | hypothetical protein Blon020231 |
| BI01264 | 1057844 | 1058440 | − | hypothetical COG1192: ATPases involved in chromosome partitioning |
| BI01265 | 1059167 | 1059430 | − | COG1192: ATPases involved in chromosome partitioning |
| BI01266 | 1059569 | 1060042 | − | possible WhiB-like transcription factor |
| BI01267 | 1060036 | 1061400 | − | conserved hypothetical protein |
| BI01727t | 1061400 | 1061597 | − | hypothetical protein Blon020220 |
| BI01268 | 1061748 | 1061894 | − | hypothetical protein |
| BI01730t | 1061882 | 1062055 | − | hypothetical protein Blon020217 |
| BI01269 | 1062779 | 1062997 | − | conserved hypothetical protein |
| BI01270 | 1063127 | 1063546 | + | Helix-turn-helix domain protein |
| BI01733t | 1064092 | 1064778 | + | conserved hypothetical protein |
| BI01271 | 1064862 | 1066490 | − | lipoprotein, putative |
| BI01272 | 1066742 | 1067959 | − | isocitrate dehydrogenase, NADP-dependent |
| BI01273 | 1068051 | 1069208 | + | IMP dehydrogenase family protein |
| BI01274 | 1069373 | 1069861 | + | hypothetical protein Blon020211 |
| BI01275 | 1069955 | 1072039 | + | long-chain-fatty-acid--CoA ligase, putative |
| BI01276 | 1072049 | 1072534 | + | polypeptide deformylase |
| BI01277 | 1072876 | 1073736 | + | ribosomal protein S2 |
| BI01278 | 1073818 | 1074666 | + | translation elongation factor Ts |
| BI01279 | 1074978 | 1075580 | + | uridylate kinase |
| BI01280 | 1075660 | 1076208 | + | ribosome recycling factor |
| BI01281 | 1076309 | 1077217 | + | phosphatidate cytidylyltransferase |
| BI01282 | 1077557 | 1078597 | + | radical SAM enzyme, Cfr family |
| BI01283 | 1078604 | 1079149 | − | protease I |
| BI01284 | 1079324 | 1080091 | + | imidazoleglycerol phosphate synthase, cyclase subunit |
| BI01285 | 1080228 | 1080620 | + | phosphoribosyl-AMP cyclohydrolase |
| BI01286 | 1080704 | 1082257 | + | anthranilate synthase component I |
| BI01287 | 1082328 | 1082564 | − | conserved hypothetical protein |
| BI01288 | 1082576 | 1084174 | + | ATP binding protein of ABC transporter |
| BI01289 | 1084221 | 1084925 | + | oxidoreductase, short-chain dehydrogenase/reductase family, putative |
| BI01290 | 1084999 | 1085364 | + | narrowly conserved protein with unknown function |
| BI01291 | 1085423 | 1086091 | − | conserved hypothetical protein |
| BI01292 | 1086091 | 1087701 | − | ABC transporter, ATP-binding protein |
| BI01293 | 1087704 | 1088600 | − | possible ABC transporter permease for cobalt |
| BI01294 | 1088405 | 1089049 | − | narrowly conserved protein with unknown function |
| BI01295 | 1089261 | 1090877 | + | conserved hypothetical protein |
| BI01296 | 1090916 | 1091548 | + | conserved hypothetical protein |
| BI01297 | 1091551 | 1095093 | + | hypothetical myosin-like protein with unknown function |
| BI01298 | 1095170 | 1096351 | + | conserved hypothetical protein |
| BI01299 | 1096680 | 1097084 | + | hypothetical protein BL0701 |
| BI01300 | 1097367 | 1100384 | + | excinuclease ABC, A subunit |
| BI01301 | 1100532 | 1102895 | + | excinuclease ABC, C subunit |
| BI01302 | 1103007 | 1103975 | + | aroE |
| BI01303 | 1103978 | 1104961 | + | Predicted P-loop-containing kinase |
| BI01304 | 1105247 | 1106110 | + | Uncharacterized BCR, COG1481 |
| BI01305 | 1106282 | 1107484 | + | phosphoglycerate kinase |
| BI01306 | 1107546 | 1108346 | + | triosephosphate isomerase |
| BI01307 | 1108365 | 1108658 | + | preprotein translocase, SecG subunit |
| BI01308 | 1108763 | 1109710 | + | L-lactate dehydrogenase |
| BI01309 | 1109710 | 1110558 | + | Cof family protein |
| BI01310 | 1110672 | 1112225 | + | aminotransferase, class I |
| BI01311 | 1112360 | 1113466 | − | membrane protein, putative |
| BI01312 | 1113642 | 1114943 | − | branched-chain amino acid transport system II carrier protein |
| BI01313 | 1115108 | 1116208 | − | transaldolase |
| BI01314 | 1116332 | 1118392 | − | transketolase |
| BI01315 | 1118812 | 1119927 | + | heat-inducible transcription repressor HrcA |
| BI01316 | 1119986 | 1121128 | + | dnaJ protein |
| BI01317 | 1121180 | 1121968 | − | COG3001: Uncharacterized BCR |
| BI01318 | 1122113 | 1122994 | + | undecaprenol kinase, putative |
| BI01319 | 1123157 | 1124146 | − | conserved hypothetical protein |
| BI01320 | 1124807 | 1126837 | + | threonyl-tRNA synthetase |
| BI01321 | 1127061 | 1127561 | + | HIT family protein |
| BI01322 | 1127703 | 1128455 | + | conserved hypothetical protein TIGR01033 |
| BI01323 | 1128464 | 1129045 | + | crossover junction endodeoxyribonuclease RuvC |
| BI01324 | 1129106 | 1129729 | + | Holliday junction DNA helicase RuvA |
| BI01325 | 1129732 | 1130793 | + | Holliday junction DNA helicase RuvB |
| BI01326 | 1130876 | 1131292 | + | preprotein translocase, YajC subunit |
| BI01327 | 1131359 | 1131937 | + | adenine phosphoribosyltransferase |

TABLE 1-continued

Open reading frames of the genome of UCC 35624.

| GeneID | Start | End | Strand | Description |
|---|---|---|---|---|
| BI01328 | 1132037 | 1133236 | + | succinyl-CoA synthetase, beta subunit |
| BI01329 | 1133239 | 1134147 | + | succinyl-CoA synthase, alpha subunit |
| BI01330 | 1133954 | 1135546 | + | membrane protein, putative |
| BI01331 | 1135497 | 1137131 | + | phosphoribosylaminoimidazolecarboxamide formyltransferase/IMP cyclohydrolase |
| BI01332 | 1137280 | 1137579 | + | hypothetical protein |
| BI01333 | 1137484 | 1138449 | − | aquaporin Z, putative |
| BI01334 | 1138645 | 1139412 | + | ribosomal large subunit pseudouridine synthase B |
| BI01335 | 1139514 | 1141538 | + | possible GTP-binding protein |
| BI01336 | 1141896 | 1143422 | + | UDP-glucose pyrophosphorylase |
| BI01337 | 1143565 | 1145475 | + | conserved hypothetical protein |
| BI01338 | 1145489 | 1145803 | + | hypothetical protein Blon020144 |
| BI01339 | 1145819 | 1148407 | + | helY |
| BI01340 | 1148524 | 1148868 | + | conserved hypothetical protein |
| BI01341 | 1149001 | 1149717 | + | hydrolase, haloacid dehalogenase-like family |
| BI01833t | 1149744 | 1149995 | + | conserved hypothetical protein |
| BI01342 | 1150135 | 1150497 | − | hypothetical protein Blon020140 |
| BI01343 | 1150673 | 1151302 | − | COG0789: Predicted transcriptional regulators |
| BI01344 | 1151406 | 1151846 | − | possible signal transduction protein |
| BI01345 | 1151856 | 1152596 | − | conserved hypothetical protein |
| BI01346 | 1152693 | 1153022 | − | small basic protein |
| BI01347 | 1153025 | 1153999 | − | conserved hypothetical protein |
| BI01348 | 1153992 | 1154684 | − | CDP-diacylglycerol--glycerol-3-phosphate 3-phosphatidyltransferase, putative |
| BI01349 | 1154623 | 1155471 | − | ATP phosphoribosyltransferase |
| BI01350 | 1155486 | 1155746 | − | phosphoribosyl-ATP pyrophosphohydrolase |
| BI01351 | 1155812 | 1156477 | − | ribulose-phosphate 3-epimerase |
| BI01352 | 1156556 | 1157500 | − | prolipoprotein diacylglyceryl transferase |
| BI01353 | 1157614 | 1158480 | − | tryptophan synthase, alpha subunit |
| BI01354 | 1158507 | 1160591 | − | tryptophan synthase, beta subunit |
| BI01355 | 1161120 | 1161968 | − | endonuclease IV |
| BI00066g | 1161414 | 1162400 | + | amino acid permease |
| BI01356 | 1162340 | 1162834 | + | amino acid permease |
| BI01357 | 1162503 | 1162667 | + | amino acid permease |
| BI01358 | 1163206 | 1164216 | − | hypothetical membrane protein with unknown function |
| BI01359 | 1164333 | 1164536 | − | hypothetical protein |
| BI01360 | 1164570 | 1164860 | − | abortive infection protein AbiGI, putative |
| BI01361 | 1164981 | 1165262 | + | hypothetical protein |
| BI01362 | 1165260 | 1165715 | − | lin2984 |
| BI01363 | 1165903 | 1166406 | + | acetyltransferase, GNAT family, putative |
| BI01364 | 1166567 | 1166746 | + | lin0863 |
| BI01365 | 1166793 | 1167323 | − | acetyltransferase, GNAT family |
| BI01366 | 1167392 | 1167961 | − | acetyltransferase, GNAT family |
| BI01367 | 1168315 | 1168992 | − | hypothetical protein |
| BI01368 | 1169017 | 1169823 | − | hypothetical protein |
| BI01369 | 1169832 | 1170527 | − | ABC transporter, ATP-binding protein |
| BI01370 | 1170352 | 1171263 | + | hypothetical Response regulator receiver domain |
| BI01371 | 1171317 | 1172225 | + | hypothetical protein |
| BI01372 | 1172194 | 1172631 | − | hypothetical Integral membrane protein |
| BI01373 | 1172956 | 1173576 | − | hypothetical protein |
| BI01374 | 1173576 | 1174301 | − | hypothetical protein |
| BI01873t | 1174309 | 1174962 | − | bacteriocin ABC transporter, ATP-binding protein, putative |
| BI01375 | 1175274 | 1176518 | + | IS30 family, transposase [imported] |
| BI01376 | 1176714 | 1177379 | − | DNA-binding response regulator |
| BI01377 | 1177379 | 1179001 | − | hypothetical ATPase, histidine kinase-, DNA gyrase B-, and HSP90-like domain protein |
| BI01378 | 1179039 | 1179881 | − | hypothetical permease, putative |
| BI01379 | 1180057 | 1180956 | − | ABC transporter, ATP-binding protein |
| BI01380 | 1181077 | 1181259 | + | hypothetical protein |
| BI01381 | 1181154 | 1181684 | − | hypothetical protein |
| BI01382 | 1182016 | 1182315 | + | BlsA |
| BI01383 | 1182321 | 1182662 | + | hypothetical protein |
| BI01384 | 1182847 | 1183050 | − | hypothetical protein |
| BI01385 | 1183324 | 1183446 | + | hypothetical protein BL0771 |
| BI01386 | 1183489 | 1183932 | + | hypothetical protein Blon020116 |
| BI01387 | 1183955 | 1184314 | − | COG0388: Predicted amidohydrolase |
| BI01388 | 1184376 | 1184531 | − | hypothetical protein |
| BI01389 | 1184840 | 1185853 | − | inner membrane protein, 60 kDa VC0004 [imported] |
| BI01390 | 1186097 | 1186555 | − | hypothetical protein |
| BI01391 | 1186942 | 1187067 | + | hypothetical protein |
| BI01392 | 1187122 | 1188783 | + | amino acid permease |
| BI01393 | 1188993 | 1189640 | − | Signal peptidase I |
| BI00067g | 1189800 | 1190303 | + | conserved hypothetical protein |

TABLE 1-continued

Open reading frames of the genome of UCC 35624.

| GeneID | Start | End | Strand | Description |
|---|---|---|---|---|
| BI01394 | 1189721 | 1190146 | − | hypothetical protein Blon020104 |
| BI01395 | 1190467 | 1191420 | + | lin0466 |
| BI01396 | 1191479 | 1191799 | + | narrowly conserved hypothetical protein |
| BI01397 | 1191887 | 1192165 | + | narrowly conserved hypothetical protein |
| BI01398 | 1192540 | 1193727 | + | Unknown, putative |
| BI01399 | 1193770 | 1195530 | + | YjeF family protein, putative |
| BI01400 | 1195635 | 1196261 | + | possible alpha beta hydrolase |
| BI01401 | 1196417 | 1197286 | + | transcriptional regulator, LysR family |
| BI01402 | 1197447 | 1198565 | − | conserved hypothetical protein |
| BI01403 | 1198783 | 1198932 | − | hypothetical protein |
| BI01404 | 1199044 | 1199736 | − | orotate phosphoribosyltransferase |
| BI01405 | 1199748 | 1200716 | − | dihydroorotate dehydrogenase |
| BI01406 | 1200722 | 1201543 | − | dihydroorotate dehydrogenase, electron transfer subunit |
| BI01407 | 1201682 | 1202632 | − | orotidine 5'-phosphate decarboxylase |
| BI01408 | 1202653 | 1203939 | − | dihydroorotase |
| BI01921t | 1204146 | 1204562 | − | Aspartate carbamoyltransferase regulatory chain, allosteric domain |
| BI01409 | 1204565 | 1205524 | − | aspartate carbamoyltransferase |
| BI01410 | 1205669 | 1208896 | − | glutamate-ammonia ligase adenylyltransferase family |
| BI01411 | 1208955 | 1209905 | − | EF0040 |
| BI01412 | 1210042 | 1210893 | − | 5,10-methylenetetrahydrofolate reductase |
| BI01413 | 1210955 | 1213255 | − | 5-methyltetrahydropteroyltriglutamate--homocysteine S-methyltransferase |
| BI01414 | 1213369 | 1213923 | − | phosphohistidine phosphatase SixA, putative |
| BI01415 | 1214024 | 1215091 | − | conserved hypothetical protein |
| BI01416 | 1215168 | 1215803 | + | serine esterase, putative |
| BI01417 | 1215850 | 1216806 | − | oxidoreductase, aldo/keto reductase 2 family |
| BI01418 | 1217063 | 1217995 | + | lipC, putative |
| BI01419 | 1218234 | 1219178 | + | hypothetical oxidoreductase, zinc-binding dehydrogenase family |
| BI01420 | 1219340 | 1219642 | − | probable ATP binding protein of ABC transporter |
| BI01421 | 1220459 | 1221484 | + | transposase (25) BH3998 [imported], putative |
| BI00069g | 1221277 | 1221948 | + | hypothetical protein |
| BI01422 | 1221948 | 1222706 | + | Tpase2 |
| BI01423 | 1222896 | 1223972 | + | hypothetical protein |
| BI01424 | 1224236 | 1224811 | + | hypothetical protein |
| BI01425 | 1224888 | 1225190 | − | transcriptional regulator, HTH_3 family |
| BI01426 | 1225221 | 1226144 | − | hypothetical protein |
| BI01427 | 1226238 | 1227140 | − | hypothetical protein |
| BI01428 | 1227158 | 1228765 | − | hypothetical protein |
| BI01429 | 1229279 | 1230097 | − | hypothetical ADP-ribosylglycohydrolase |
| BI01430 | 1231271 | 1231726 | − | hypothetical protein |
| BI01431 | 1232085 | 1232906 | + | conserved hypothetical protein |
| BI01432 | 1233000 | 1233539 | − | bcp |
| BI01433 | 1233681 | 1234511 | − | probable amidase [imported] |
| BI01434 | 1234511 | 1235365 | − | hydrolase, haloacid dehalogenase-like family, putative |
| BI01435 | 1235520 | 1236365 | − | amino acid transport protein |
| BI01436 | 1236462 | 1237709 | − | possible glycosyltransferase |
| BI01437 | 1237841 | 1238302 | − | conserved hypothetical protein |
| BI01438 | 1238382 | 1239917 | − | gltD |
| BI01439 | 1239922 | 1244265 | − | Conserved region in glutamate synthase family |
| BI01440 | 1244835 | 1245116 | + | transcription regulator, LacI family [imported] |
| BI01441 | 1245175 | 1246197 | − | conserved hypothetical protein |
| BI01442 | 1246656 | 1246979 | + | conserved hypothetical protein |
| BI01443 | 1247042 | 1247227 | − | hypothetical protein |
| BI01444 | 1247493 | 1248536 | − | transcriptional regulator, LacI family, putative |
| BI01445 | 1249246 | 1250073 | + | conserved hypothetical protein |
| BI01446 | 1250275 | 1250571 | − | hypothetical protein |
| BI00071g | 1250541 | 1250888 | − | conserved hypothetical protein |
| BI01447 | 1250658 | 1250807 | + | hypothetical protein |
| BI01448 | 1251252 | 1252538 | + | MATE efflux family protein, putative |
| BI01449 | 1252678 | 1252794 | − | hypothetical protein |
| BI01450 | 1253083 | 1254216 | + | IS30 family, transposase [imported] |
| BI01451 | 1254323 | 1255327 | − | glycerate kinase |
| BI01452 | 1255679 | 1256734 | + | transcriptional regulator, LacI family, putative |
| BI01453 | 1256820 | 1258094 | − | oxygen-independent coproporphyrinogen III oxidase, putative |
| BI01454 | 1258229 | 1259890 | − | GTP-binding protein LepA |
| BI01455 | 1260253 | 1260510 | + | ribosomal protein S20 |
| BI01456 | 1260768 | 1261556 | − | conserved hypothetical transmembrane protein with unknown function |
| BI01457 | 1261807 | 1262703 | − | transcriptional regulator, MazG family |
| BI01458 | 1262903 | 1264027 | − | branched-chain amino acid aminotransferase |

TABLE 1-continued

Open reading frames of the genome of UCC 35624.

| GeneID | Start | End | Strand | Description |
|---|---|---|---|---|
| BI01459 | 1264254 | 1264871 | − | ribosomal 5S rRNA E-loop binding protein Ctc/L25/TL5 |
| BI01460 | 1265298 | 1266332 | + | conserved hypothetical protein |
| BI01461 | 1266474 | 1267895 | − | NAD(P) transhydrogenase, beta subunit [imported] |
| BI01462 | 1267898 | 1268200 | − | NAD(P) transhydrogenase, alpha subunit |
| BI01463 | 1268219 | 1269379 | − | NAD(P) transhydrogenase, alpha subunit [imported] |
| BI01464 | 1269798 | 1271828 | + | long-chain-fatty-acid--CoA ligase |
| BI01465 | 1271887 | 1272948 | − | GTP-binding protein Era |
| BI01466 | 1272953 | 1274383 | − | CBS domain protein |
| BI01467 | 1274462 | 1275052 | − | conserved hypothetical protein TIGR00043 |
| BI01468 | 1275000 | 1276172 | − | PhoH family protein |
| BI01469 | 1276194 | 1276529 | − | Hit family protein |
| BI01470 | 1276581 | 1277375 | − | conserved hypothetical protein TIGR00046 |
| BI01471 | 1277619 | 1278494 | + | spoU rRNA methylase family protein |
| BI01472 | 1278758 | 1279939 | + | glucose-1-phosphate adenylyltransferase |
| BI01473 | 1280035 | 1280532 | − | mrp protein homolog |
| BI01474 | 1280635 | 1281171 | − | SUF system FeS assembly protein, NifU family |
| BI01475 | 1281201 | 1282472 | − | aminotransferase, class-V |
| BI01476 | 1282614 | 1283390 | − | FeS assembly ATPase SufC |
| BI01477 | 1283419 | 1284651 | − | FeS assembly protein SufD |
| BI01478 | 1284660 | 1286156 | − | FeS assembly protein SufB |
| BI01479 | 1286383 | 1287849 | − | conserved hypothetical protein |
| BI01480 | 1288225 | 1289883 | − | CTP synthase |
| BI01481 | 1290032 | 1291585 | − | dipeptidase, putative |
| BI01482 | 1291684 | 1292127 | − | 3-dehydroquinate dehydratase, type II |
| BI01483 | 1292294 | 1293835 | − | 3-dehydroquinate synthase |
| BI01484 | 1293999 | 1295132 | − | chorismate synthase |
| BI01485 | 1295247 | 1295717 | + | COG0477: Permeases of the major facilitator superfamily |
| BI01486 | 1295891 | 1297003 | − | Uncharacterized BCR, YceG family COG1559 |
| BI01487 | 1297083 | 1297535 | − | conserved hypothetical protein TIGR00250 |
| BI01488 | 1297550 | 1300228 | − | alanyl-tRNA synthetase |
| BI01489 | 1300359 | 1300592 | − | hypothetical protein Blon020010 |
| BI01490 | 1300595 | 1300990 | − | conserved hypothetical protein |
| BI01491 | 1301196 | 1301921 | − | phosphoglycerate mutase |
| BI01492 | 1302158 | 1304008 | + | Acyltransferase family domain protein |
| BI01493 | 1304105 | 1304728 | − | ribosomal protein S4 |
| BI01494 | 1304930 | 1305895 | − | ABC transporter, ATP-binding protein |
| BI01495 | 1305900 | 1307114 | − | hypothetical transmembrane protein with unknown function |
| BI01496 | 1307208 | 1307603 | − | conserved hypothetical protein |
| BI01497 | 1307751 | 1310450 | − | hypothetical UvrD/REP helicase |
| BI01498 | 1310567 | 1311145 | + | xanthine phosphoribosyltransferase |
| BI01499 | 1311199 | 1312560 | + | xanthine/uracil permease family protein |
| BI01500 | 1312696 | 1312902 | − | transcription regulator, Cro/CI family [imported]-related protein |
| BI01501 | 1312912 | 1313169 | − | hypothetical protein |
| BI01502 | 1313326 | 1314144 | − | hydrolase, alpha/beta fold family, putative |
| BI01503 | 1314432 | 1315367 | + | conserved hypothetical protein |
| BI01504 | 1315462 | 1315860 | − | glyoxalase family protein |
| BI01505 | 1316019 | 1316630 | + | isochorismatase |
| BI01506 | 1316885 | 1318360 | + | conserved hypothetical protein |
| BI01507 | 1318371 | 1319780 | − | membrane protein, putative |
| BI01508 | 1319770 | 1321005 | − | membrane protein, putative |
| BI01509 | 1321109 | 1322089 | − | daunorubicin resistance ATP-binding protein |
| BI01510 | 1322192 | 1322296 | − | hypothetical protein |
| BI01511 | 1322475 | 1323824 | + | histidine kinase sensor of two-component system |
| BI01512 | 1323917 | 1324477 | + | DNA-binding response regulator |
| BI01513 | 1324667 | 1325287 | − | Protein of unknown function subfamily |
| BI01514 | 1325308 | 1326324 | − | phosphate transporter family protein |
| BI01515 | 1326480 | 1326674 | − | conserved hypothetical protein |
| BI01516 | 1326735 | 1329005 | − | carbon starvation protein A |
| BI01517 | 1329406 | 1330668 | + | glycosyl hydrolase, family 13, putative |
| BI01518 | 1330703 | 1331404 | − | transcriptional regulator, TetR family, putative |
| BI01519 | 1331486 | 1333669 | − | possible ATP-dependent RNA helicase |
| BI01520 | 1334052 | 1335338 | − | uracil-xanthine permease |
| BI01521 | 1335446 | 1336273 | − | phosphoglycerate mutase family domain protein |
| BI01522 | 1336327 | 1336905 | − | conserved hypothetical protein |
| BI01523 | 1337061 | 1337612 | + | conserved hypothetical protein |
| BI01524 | 1337738 | 1338898 | − | conserved hypothetical protein |
| BI01525 | 1339275 | 1340816 | − | conserved hypothetical protein |
| BI01526 | 1341250 | 1341687 | + | hypothetical COG0653: Preprotein translocase subunit SecA (ATPase, RNA helicase) |

TABLE 1-continued

Open reading frames of the genome of UCC 35624.

| GeneID | Start | End | Strand | Description |
|---|---|---|---|---|
| BI01527 | 1341752 | 1343449 | + | Protein kinase domain protein |
| BI01528 | 1343493 | 1344980 | − | permease, putative |
| BI01529 | 1345295 | 1347565 | − | drug resistance transporter, EmrB/QacA subfamily |
| BI01530 | 1347576 | 1347776 | − | hypothetical protein |
| BI01531 | 1347947 | 1348309 | + | hypothetical Domain of unknown function (DUF307) |
| BI01532 | 1348405 | 1349910 | − | hypothetical protein |
| BI01533 | 1349906 | 1351072 | − | hypothetical protein |
| BI01534 | 1351166 | 1351474 | − | hypothetical protein |
| BI02085t | 1351280 | 1351477 | + | hypothetical protein Blon021394 |
| BI01535 | 1351807 | 1352478 | + | COG4186: Predicted phosphoesterase or phosphohydrolase |
| BI01536 | 1352565 | 1354004 | + | conserved hypothetical protein |
| BI01537 | 1354044 | 1354253 | + | hypothetical protein BL0925 |
| BI01538 | 1354253 | 1354612 | + | hypothetical protein BL0925 |
| BI01539 | 1354729 | 1355193 | + | hypothetical protein |
| BI01540 | 1355496 | 1356380 | − | hypothetical protein |
| BI01541 | 1356380 | 1357450 | − | hypothetical Phage integrase family |
| BI01542 | 1357650 | 1358675 | + | transposase (25) BH3998 [imported], putative |
| BI00076g | 1358468 | 1359139 | + | hypothetical protein |
| BI01543 | 1359139 | 1359897 | + | Tpase2 |
| BI01544 | 1360305 | 1361546 | − | GTP-binding protein YchF |
| BI01545 | 1361533 | 1362351 | − | pyrroline-5-carboxylate reductase |
| BI01546 | 1362416 | 1363891 | − | proline iminopeptidase |
| BI01547 | 1363977 | 1366433 | + | histidine kinase sensor of two-component system |
| BI01548 | 1366551 | 1367345 | + | DNA-binding response regulator |
| BI01549 | 1367384 | 1370233 | − | possible transport protein |
| BI01550 | 1370265 | 1371176 | − | ABC transporter, ATP-binding protein |
| BI01551 | 1371528 | 1372841 | − | O-acetylhomoserine sulfhydrylase |
| BI01552 | 1373315 | 1374184 | + | pyridoxal kinase, putative |
| BI01553 | 1374424 | 1374924 | + | conserved hypothetical protein TIGR00252 |
| BI01554 | 1374983 | 1376515 | + | Mg chelatase-related protein |
| BI01555 | 1376515 | 1378212 | + | DNA processing protein DprA, putative |
| BI01556 | 1378272 | 1380134 | + | sdhA |
| BI01557 | 1380233 | 1381195 | + | sdhB |
| BI01558 | 1381277 | 1381954 | + | probable methyltransferase |
| BI01559 | 1382006 | 1382944 | − | conserved hypothetical protein TIGR00730 |
| BI01560 | 1383180 | 1384595 | − | Na+/H+ antiporter [imported] |
| BI01561 | 1385070 | 1386485 | − | ATP-dependent Clp protease, ATP-binding subunit ClpX |
| BI01562 | 1386610 | 1387308 | − | ATP-dependent Clp protease, proteolytic subunit ClpP |
| BI01563 | 1387317 | 1387907 | − | ATP-dependent Clp protease, proteolytic subunit ClpP |
| BI01564 | 1388046 | 1388423 | − | hypothetical protein Blon021418 |
| BI01565 | 1388538 | 1390001 | − | voltage-gated chloride channel family protein, putative |
| BI01566 | 1390189 | 1391565 | − | trigger factor |
| BI01567 | 1391623 | 1392921 | − | 3-5 exonuclease domain protein |
| BI01568 | 1392921 | 1393730 | − | COG0477: Permeases of the major facilitator superfamily |
| BI01569 | 1393622 | 1394500 | − | pyruvate formate-lyase 1 activating enzyme |
| BI01570 | 1394613 | 1396985 | − | formate acetyltransferase |
| BI01571 | 1397254 | 1397475 | − | conserved hypothetical protein |
| BI01572 | 1397531 | 1399093 | − | NH(3)-dependent NAD+ synthetase |
| BI01573 | 1399577 | 1400725 | − | Peptidase, M20/M25/M40 family |
| BI01574 | 1400817 | 1401500 | − | permease protein of ABC transporter system |
| BI01575 | 1401500 | 1402702 | − | ABC transporter, ATP-binding protein |
| BI01576 | 1402839 | 1403816 | − | lipoprotein, YaeC family |
| BI01577 | 1404020 | 1404847 | + | hydrolase, haloacid dehalogenase-like family |
| BI01578 | 1404975 | 1407449 | − | D-xylulose 5-phosphate/D-fructose 6-phosphate phosphoketolase |
| BI01579 | 1407895 | 1409454 | + | GMP synthase |
| BI01580 | 1409723 | 1410304 | + | COG0798: Arsenite efflux pump ACR3 and related permeases |
| BI01581 | 1410343 | 1410720 | + | arsenical resistance protein/arsenate reductase |
| BI01582 | 1411265 | 1411771 | + | hypothetical Transposase IS66 family |
| BI00078g | 1411579 | 1412214 | + | hypothetical protein Blon021471 |
| BI01583 | 1412111 | 1413136 | + | transposase (25) BH3998 [imported], putative |
| BI00079g | 1412929 | 1413600 | + | hypothetical protein |
| BI01584 | 1413600 | 1414358 | + | Tpase2 |
| BI01585 | 1414423 | 1414911 | + | hypothetical COG3436: Transposase and inactivated derivatives |
| BI02159t | 1415037 | 1416323 | − | COG0477: Permeases of the major facilitator superfamily |

TABLE 1-continued

Open reading frames of the genome of UCC 35624.

| GeneID | Start | End | Strand | Description |
|---|---|---|---|---|
| BI01586 | 1416510 | 1417160 | + | putative ATP-binding protein |
| BI01587 | 1417164 | 1418444 | + | Uncharacterized conserved protein |
| BI01588 | 1418440 | 1418820 | + | hypothetical protein Blon021466 |
| BI01589 | 1418965 | 1420548 | + | conserved hypothetical protein |
| BI01590 | 1420796 | 1422598 | + | acyltransferase, putative |
| BI01591 | 1422687 | 1423706 | + | prsA |
| BI01592 | 1423991 | 1425370 | + | UDP-N-acetylglucosamine pyrophosphorylase |
| BI01593 | 1425377 | 1425787 | + | iojap-related protein |
| BI01594 | 1425942 | 1426637 | + | phosphoglycerate mutase, putative |
| BI01595 | 1427363 | 1428961 | + | phosphate acetyltransferase |
| BI01596 | 1429099 | 1429695 | + | acetate kinase |
| BI01597 | 1429811 | 1430326 | + | hypothetical COG0282: Acetate kinase |
| BI01598 | 1430503 | 1431867 | − | 3-phosphoshikimate 1-carboxyvinyltransferase |
| BI01599 | 1431867 | 1433036 | − | membrane protein, putative |
| BI01600 | 1433757 | 1434125 | − | hypothetical COG2217: Cation transport ATPase |
| BI01601 | 1434688 | 1436172 | − | galactoside symporter |
| BI01602 | 1436515 | 1439583 | + | beta-galactosidase, putative |
| BI01603 | 1440389 | 1441246 | + | hypothetical protein |
| BI01604 | 1441301 | 1441966 | − | hypothetical protein Blon020709 |
| BI01605 | 1442167 | 1442559 | − | hypothetical protein |
| BI01606 | 1442574 | 1442990 | − | hypothetical protein |
| BI01607 | 1442990 | 1444792 | − | hypothetical protein |
| BI01608 | 1444688 | 1445566 | + | COG3757: Lyzozyme M1 (1,4-beta-N-acetylmuramidase) |
| BI01609 | 1445667 | 1445948 | + | hypothetical protein |
| BI01610 | 1446119 | 1446796 | + | hypothetical protein |
| BI01611 | 1447212 | 1448801 | + | hypothetical C-5 cytosine-specific DNA methylase |
| BI01612 | 1448804 | 1449997 | − | hypothetical protein Psyc022392 |
| BI01613 | 1450130 | 1450393 | + | hypothetical protein |
| BI01614 | 1450514 | 1450891 | − | hypothetical protein |
| BI01615 | 1451253 | 1452203 | − | hypothetical protein |
| BI01616 | 1452503 | 1452802 | − | TnpB |
| BI01617 | 1452909 | 1453127 | + | IS861, transposase OrfB |
| BI01618 | 1453248 | 1453586 | + | putative transposase subunit |
| BI01619 | 1455179 | 1455604 | − | cell division protein FtsZ |
| BI01620 | 1455752 | 1459864 | − | hypothetical UvrD/REP helicase |
| BI01621 | 1459861 | 1463163 | − | COG3857: ATP-dependent nuclease, subunit B |
| BI01622 | 1463295 | 1465877 | − | hypothetical DNA polymerase III, alpha subunit |
| BI01623 | 1466012 | 1467055 | + | conserved hypothetical protein |
| BI01624 | 1467089 | 1467886 | − | narrowly conserved hypothetical membrane protein |
| BI01625 | 1468160 | 1468507 | − | hypothetical protein BL0124 |
| BI01626 | 1468949 | 1469908 | − | Pseudouridylate synthases, 23S RNA-specific |
| BI01627 | 1469911 | 1470456 | − | lipoprotein signal peptidase |
| BI01628 | 1470481 | 1471857 | − | conserved hypothetical protein |
| BI01629 | 1472000 | 1472299 | − | COG0762: Predicted integral membrane protein |
| BI01630 | 1472424 | 1472900 | − | conserved hypothetical protein |
| BI01631 | 1472916 | 1473830 | − | hypothetical Tubulin/FtsZ family, C-terminal domain |
| BI01632 | 1474239 | 1475480 | − | TIM-barrel protein, NifR3 family |
| BI01633 | 1475628 | 1476938 | − | glycyl-tRNA synthetase |
| BI01634 | 1477533 | 1478474 | + | hydroxyethylthiazole kinase |
| BI01635 | 1478743 | 1481310 | + | thiamine biosynthesis protein ThiC |
| BI01636 | 1481353 | 1481679 | − | hypothetical protein |
| BI01637 | 1481820 | 1482626 | + | phosphomethylpyrimidine kinase |
| BI01638 | 1482680 | 1483054 | + | COG0011: Uncharacterized ACR |
| BI01639 | 1483563 | 1484939 | + | permease, putative |
| BI02235t | 1485571 | 1485978 | + | conserved hypothetical protein |
| BI01640 | 1486039 | 1487433 | + | Serpin (serine protease inhibitor) superfamily |
| BI01641 | 1487717 | 1488517 | + | transcriptional regulator, LacI family, putative |
| BI01642 | 1488728 | 1490068 | + | sucrose transport protein |
| BI01643 | 1490082 | 1491635 | + | sucrose-6-phosphate hydrolase, putative |
| BI01644 | 1491833 | 1492612 | + | ABC transporter, permease protein, cysTW family, putative |
| BI01645 | 1492927 | 1493943 | + | pyrimidine precursor biosynthesis enzyme, putative |
| BI02246t | 1494070 | 1495254 | + | inosine-uridine preferring nucleoside hydrolase |
| BI01646 | 1495416 | 1496207 | − | undecaprenyl diphosphate synthase |
| BI01647 | 1496207 | 1496923 | − | DNA repair protein RecO |
| BI01648 | 1496975 | 1498684 | − | conserved hypothetical protein |
| BI01649 | 1498808 | 1500028 | − | 1-hydroxy-2-methyl-2-(E)-butenyl 4-diphosphate synthase |
| BI01650 | 1500028 | 1501215 | − | 1-deoxy-D-xylulose 5-phosphate reductoisomerase |

TABLE 1-continued

Open reading frames of the genome of UCC 35624.

| GeneID | Start | End | Strand | Description |
|---|---|---|---|---|
| BI01651 | 1501215 | 1502915 | − | conserved hypothetical protein |
| BI01652 | 1503387 | 1503809 | − | conserved hypothetical protein |
| BI01653 | 1503919 | 1504797 | − | PDZ domain family protein |
| BI01654 | 1505129 | 1506760 | + | conserved hypothetical protein |
| BI01655 | 1506836 | 1508407 | − | ATP-dependent DNA helicase PcrA |
| BI01656 | 1508553 | 1510205 | + | conserved hypothetical protein |
| BI01657 | 1510357 | 1510578 | + | putative ATP-binding protein |
| BI01658 | 1510645 | 1511535 | − | PHP domain N-terminal region family |
| BI01659 | 1511673 | 1512407 | + | narrowly conserved hypothetical transmembrane protein |
| BI01660 | 1512419 | 1513309 | − | diaminopimelate epimerase |
| BI01661 | 1513417 | 1514208 | + | glutamate racemase |
| BI01662 | 1514340 | 1515182 | + | Patatin family |
| BI01663 | 1515255 | 1516151 | − | Unknown |
| BI01664 | 1516314 | 1516580 | − | trans-sulfuration enzyme |
| BI00087g | 1516749 | 1517024 | − | ABC transporter, ATP-binding protein, putative |
| BI00086g | 1517139 | 1517573 | + | conserved hypothetical protein in upf0074 |
| BI01665 | 1517692 | 1517940 | − | conserved hypothetical protein |
| BI01666 | 1518187 | 1519422 | − | cystathionine beta-lyase |
| BI01667 | 1519661 | 1520560 | − | glutamine ABC transporter, periplasmic glutamine-binding protein (glnH) |
| BI01668 | 1520629 | 1521417 | − | amino acid ABC transporter, ATP-binding protein |
| BI01669 | 1521413 | 1521952 | − | amino acid ABC transporter, permease protein SP0710 [imported] |
| BI01670 | 1522074 | 1522730 | − | amino acid ABC transporter, permease protein |
| BI01671 | 1522793 | 1523605 | + | hypothetical Phospholipase/Carboxylesterase |
| BI01672 | 1523620 | 1525872 | − | Tn916, tetracycline resistance protein, putative |
| BI01673 | 1526091 | 1526723 | + | DNA polymerase III, epsilon subunit |
| BI01674 | 1526731 | 1527318 | − | guanylate kinase |
| BI01675 | 1527501 | 1528418 | − | orotidine 5'-phosphate decarboxylase, putative |
| BI01676 | 1528421 | 1531801 | − | carbamoyl-phosphate synthase, large subunit |
| BI01677 | 1531806 | 1533176 | − | carbamoyl-phosphate synthase, small subunit |
| BI01678 | 1533219 | 1533788 | − | transcription antitermination factor NusB |
| BI01679 | 1533846 | 1534154 | − | Elongation factor P (EF-P) |
| BI01680 | 1534514 | 1535248 | + | Unknown, putative |
| BI01681 | 1535248 | 1536033 | + | conserved hypothetical protein TIGR00245 |
| BI01682 | 1536066 | 1536770 | − | Unknown |
| BI01683 | 1536878 | 1539436 | − | hypothetical EAL domain |
| BI01684 | 1539444 | 1540751 | − | Probable hydrolase transmembrane protein |
| BI01685 | 1541332 | 1543257 | + | glycosyltransferase |
| BI01686 | 1543387 | 1543551 | − | hypothetical protein |
| BI01687 | 1543710 | 1544600 | − | 3-hydroxyacyl-CoA dehydrogenase |
| BI01688 | 1544959 | 1546782 | − | alpha-xylosidase |
| BI01689 | 1546897 | 1547199 | − | hypothetical COG1653: ABC-type sugar transport system, periplasmic component |
| BI01690 | 1547359 | 1549491 | − | possible beta-hexosaminidase A |
| BI01691 | 1549605 | 1550417 | − | ABC transporter, permease protein, MalFG family |
| BI01692 | 1551035 | 1551862 | + | conserved hypothetical protein |
| BI01693 | 1552142 | 1553254 | − | mrp |
| BI01694 | 1553434 | 1556193 | − | DNA ligase, NAD-dependent |
| BI01695 | 1556261 | 1559881 | − | conserved hypothetical protein |
| BI01696 | 1560102 | 1562237 | + | membrane protein, putative |
| BI01697 | 1562555 | 1564141 | + | hypothetical protein Blon021196 |
| BI01698 | 1564204 | 1564977 | − | ABC transporter, ATP-binding protein, putative |
| BI01699 | 1565037 | 1566299 | − | aminotransferase, class I, putative |
| BI01700 | 1566573 | 1567337 | − | ROK family protein |
| BI01701 | 1567583 | 1568365 | + | Nitroreductase family protein |
| BI01702 | 1568413 | 1569423 | − | probable glycosyltransferase |
| BI01703 | 1569675 | 1570325 | + | conserved hypothetical protein |
| BI01704 | 1570459 | 1572888 | + | ABC transporter, ATP-binding protein, putative |
| BI01705 | 1572963 | 1573265 | + | Predicted RNA-binding protein containing KH domain |
| BI01706 | 1573370 | 1573732 | − | conserved hypothetical protein |
| BI01707 | 1573842 | 1574456 | + | hypothetical TM2 domain |
| BI01708 | 1574885 | 1575301 | + | hypothetical protein Blon021592 |
| BI01709 | 1575432 | 1576415 | − | D-isomer specific 2-hydroxyacid dehydrogenase family protein |
| BI01710 | 1576714 | 1578168 | + | drug resistance transporter, EmrB/QacA family, putative |
| BI01711 | 1578399 | 1579418 | − | ribose ABC transporter, permease protein VCA0129 [imported], putative |
| BI01712 | 1579418 | 1580485 | − | ribose ABC transporter, permease protein VCA0129 [imported], putative |

TABLE 1-continued

Open reading frames of the genome of UCC 35624.

| GeneID | Start | End | Strand | Description |
| --- | --- | --- | --- | --- |
| BI01713 | 1580490 | 1582028 | − | ATP binding protein of ABC transporter |
| BI01714 | 1582172 | 1583152 | − | ribose ABC transporter, periplasmic D-ribose-binding protein |
| BI01715 | 1583472 | 1585199 | − | lipoprotein, putative |
| BI01716 | 1585199 | 1586752 | − | sensor histidine kinase MtrB |
| BI01717 | 1586893 | 1587837 | − | hypothetical Response regulator receiver domain |
| BI01718 | 1587674 | 1589005 | − | conserved ATP/GTP binding protein |
| BI01719 | 1589136 | 1591535 | − | COG0513: Superfamily II DNA and RNA helicases |
| BI01720 | 1591837 | 1592907 | − | Domain of unknown function (DUF344) family |
| BI02350t | 1592976 | 1593215 | − | conserved hypothetical protein |
| BI01721 | 1593208 | 1593801 | − | COG0737: 5'-nucleotidase/2',3'-cyclic phosphodiesterase and related esterases |
| BI01722 | 1593841 | 1595364 | − | hypothetical secreted protein with probable acid phosphatase domain |
| BI01723 | 1595471 | 1596568 | − | glutamine ABC transporter, glutamine-binding protein/permease protein, putative |
| BI01724 | 1596577 | 1597251 | − | glutamine ABC transporter, permease protein |
| BI01725 | 1597254 | 1598090 | − | amino acid ABC transporter, amino acid-binding protein, putative |
| BI01726 | 1598125 | 1598964 | − | amino acid ABC transporter, ATP-binding protein |
| BI01727 | 1599401 | 1600468 | + | conserved hypothetical protein |
| BI01728 | 1600932 | 1602728 | − | aspartyl-tRNA synthetase |
| BI01729 | 1602767 | 1604107 | − | histidyl-tRNA synthetase |
| BI01730 | 1604264 | 1605721 | + | conserved hypothetical protein |
| BI01731 | 1605933 | 1607723 | − | 5'-nucleotidase family protein, putative |
| BI01732 | 1607898 | 1608653 | − | creatinine amidohydrolase, creatininase |
| BI01733 | 1608742 | 1610115 | − | proline/betaine transporter |
| BI01734 | 1610158 | 1610328 | + | hypothetical protein |
| BI01735 | 1610308 | 1611378 | − | hypothetical protein weakly similar to putative transcriptional regulator from Streptomyces |
| BI01736 | 1611950 | 1613266 | + | N-acyl-D-amino-acid deacylase family protein, putative |
| BI01737 | 1613452 | 1616058 | − | ATP-dependent Clp protease, ATP-binding subunit ClpC |
| BI01738 | 1616208 | 1617170 | + | demannu, putative |
| BI01739 | 1617288 | 1618208 | − | hypothetical protein Blon021510 |
| BI01740 | 1618484 | 1618870 | − | cspB |
| BI01741 | 1618943 | 1620931 | − | sensor histidine kinase |
| BI01742 | 1620965 | 1621738 | − | DNA-binding response regulator |
| BI01743 | 1621689 | 1622492 | − | conserved hypothetical protein |
| BI01744 | 1622567 | 1622854 | + | conserved hypothetical protein |
| BI01745 | 1622957 | 1624579 | − | chaperone |
| BI01746 | 1624820 | 1625056 | − | cold-shock domain family protein |
| BI01747 | 1625289 | 1625870 | − | hypothetical protein Blon020592 |
| BI01748 | 1626163 | 1626771 | + | uracil-DNA glycosylase |
| BI01749 | 1626814 | 1627890 | + | ATPase, MoxR family |
| BI01750 | 1628022 | 1628837 | + | Protein of unknown function family |
| BI01751 | 1628840 | 1629388 | + | conserved hypothetical protein |
| BI01752 | 1629388 | 1630443 | + | conserved hypothetical protein |
| BI01753 | 1630443 | 1631471 | + | conserved hypothetical protein |
| BI01754 | 1631444 | 1632070 | + | platelet binding protein GspB, putative |
| BI01755 | 1632316 | 1632660 | + | conserved hypothetical protein |
| BI01756 | 1632660 | 1634261 | + | conserved hypothetical protein |
| BI01757 | 1634531 | 1634893 | + | conserved hypothetical protein |
| BI01758 | 1635034 | 1635672 | − | hypothetical membrane protein with unknown function |
| BI01759 | 1635805 | 1637238 | + | adenylosuccinate lyase VC1126 [imported] |
| BI01760 | 1637373 | 1639931 | + | narrowly conserved hypothetical membrane protein |
| BI01761 | 1640080 | 1640358 | + | DNA-binding protein HU |
| BI01762 | 1640480 | 1641937 | − | possible DNA-binding protein |
| BI01763 | 1641940 | 1642203 | − | hypothetical Protein of unknown function (DUF797) |
| BI01764 | 1642234 | 1643133 | − | possible inositol monophosphatase |
| BI01765 | 1643139 | 1644803 | − | hypothetical proteasome-associated protein |
| BI01766 | 1644828 | 1646390 | − | cell division control protein 48, AAA family |
| BI01767 | 1646454 | 1647149 | − | DedA family protein |
| BI01768 | 1647410 | 1647919 | + | phosphoserine phosphatase SerB |
| BI01769 | 1648166 | 1650271 | + | primosomal protein N |
| BI01770 | 1650333 | 1651034 | + | possible alpha beta hydrolase |
| BI01771 | 1651061 | 1652044 | + | methionyl-tRNA formyltransferase |
| BI01772 | 1652142 | 1653908 | − | dihydroxy-acid dehydratase |
| BI01773 | 1654203 | 1654484 | + | DNA-directed RNA polymerase, omega subunit |

TABLE 1-continued

Open reading frames of the genome of UCC 35624.

| GeneID | Start | End | Strand | Description |
|---|---|---|---|---|
| BI01774 | 1654765 | 1655982 | + | S-adenosylmethionine synthetase |
| BI02420t | 1656352 | 1657425 | + | hypothetical protein CV1232 |

The Open reading frames (ORF) listed in Table 1 are defined by their position in the genomic sequence of SEQ ID No. 1. For example BI00001 is defined by the nucleotide sequence of base numbers 1667321 and 1667608 (inclusive) of SEQ ID No. 1.

EXAMPLES

The following examples further describe and demonstrate embodiments within the scope of the invention. The examples are given solely for the purpose of illustration and are not to be construed as limitations of the present invention, as many variations thereof are possible without departing from the spirit and scope of the invention.

Example 1

Isolation of *Bifidobacterium Longum* Biotype Infantis UCC 35624

Appendices and sections of the large and small intestine of the human G.I.T., obtained during reconstructive surgery, were screened for probiotic bacterial strains. All samples were stored immediately after surgery at −80° C. in sterile containers. Frozen tissues were thawed, weighed and placed in cysteinated (0.05%) one quarter strength Ringers' solution. Each sample was gently shaken to remove loosely adhering microorganisms. Following transfer to a second volume of Ringers' solution, the sample was vortexed for 7 min to remove tightly adhering bacteria. In order to isolate tissue embedded bacteria, samples were also homogenised in a Braun blender. The solutions were serially diluted and spread-plated (100 µl) on to the following agar media: RCM (reinforced clostridial media) and RCM adjusted to pH 5.5 using acetic acid; TPY (trypticase, peptone and yeast extract), Chevalier, P. et al. (1990). MRS (deMann, Rogosa and Sharpe); ROG (acetate medium (SL) of Rogosa); LLA (Liver-lactose agar of Lapiere); BHI (brain heart infusion agar); LBS (*Lactobacillus* selective agar) and TSAYE (tryptone soya agar supplemented with 0.6% yeast extract). All agar media was supplied by Oxoid Chemicals with the exception of TPY agar. Plates were incubated in anaerobic jars (BBL, Oxoid) using $CO_2$ generating kits (Anaerocult A, Merck) for 2-5 days at 37° C.

Gram positive, catalase negative rod-shaped or bifurcated/pleomorphic bacteria isolates were streaked for purity on to complex non-selective media (TPY). Isolates were routinely cultivated in TPY medium unless otherwise stated at 37° C. under anaerobic conditions. *Bifidobacteria* species were stocked in 40% glycerol and stored at −20° and −80° C.

Approximately fifteen hundred catalase negative bacterial isolates from different samples were chosen and characterised in terms of their Gram reaction, cell size and morphology, growth at 15° C. and 45° C. and fermentation end-products from glucose. Greater than sixty percent of the isolates tested were Gram positive, homofermentative cocci arranged either in tetrads, chains or bunches. Eighteen percent of the isolates were Gram negative rods and heterofermentative coccobacilli.

The remaining isolates (twenty-two percent) were predominantly homofermentative coccobacilli. Thirty eight strains were characterised in more detail. All thirty eight isolates tested negative both for nitrate reduction and production of indole from tryptophan.

*Bifidobacterium longum* biotype infantis strain 35624 was chosen for full genome sequencing from this group of strains due to its proven anti-inflammatory activity in murine models of colitis (McCarthy et. al., 2004) and its immunomodulatory effects following oral consumption by Irritable Bowel Syndrome (IBS) patients (O'Mahony et al., 2005).

Example 2

Sequencing the Genome of *Bifidobacterium Longum* Infantis 35624

The *Bifidobacterium longum* biotype infantis strain 35624 genome sequence was determined using a whole shotgun approach. For this purpose two libraries were constructed: a small insert library (insert size ranging between 2 and 4 kb) employing pGEM-T easy vector (Promega) and a large insert (insert size ranging between 40 and 45 kb) cosmid library (Epicentre Technologies). Sequence sampling from these banks generated just over 26,828,618 base pairs of useable sequence data, which represented about 11.9-fold coverage of the *Bifidobacterium longum* biotype infantis strain 35624 genome (performed by MWG-Biotech, Ebersberg, Germany). Sequence reads were assembled using Phrap (Green) into 11 contigs. Gap closure and quality improvement of the initial sequence assembly was achieved by additional primer-directed sequencing using pre-identified clones from the libraries resulting in a single contig, which represented a circular chromosome of 2,264,374 by long. Based on the final consensus quality scores, we estimate an overall error rate of <1 per $4 \times 10^5$ bases

Example 3

Analysing the Genome of *Bifidobacterium Longum* Biotype Infantis 35624

Protein-encoding open reading frames (ORFs) were predicted using a combination of the methods Glimmer (Delcher et al., 1999b; Salzberg et al., 1998) and GeneBuilder (Internally developed software), as well as comparative analysis involving BLASTX (Altschul et al., 1997)

Results from the gene finder programs were manually combined, and preliminary identification of ORFs was made on the basis of BLASTP (Altschul et al., 1997) analysis against a non-redundant protein database provided by the National Centre for Biotechnology Information (Wheeler et al., 2005). Artemis (Rutherford et al., 2000), was used to inspect the identified ORFs and its associated BLASTP results. A manual inspection was performed in order to verify or, if necessary, redefine the start and stop of each predicted coding region. Annotation made use of the GC frame plot feature of Artemis, ribosome-binding site information obtained from RBSfinder (Suzek et al., 2001), alignments with similar ORFs from other organisms and G+C content analysis.

Example 4

Identifying Unique Genes in the Genome of Bifidobacterium Longum Infantis 35624

Assignment of protein function to predicted coding regions of the *Bifidobacterium longum* biotype infantis strain 35624 genome was performed using internally developed software and manual inspection. Primary functional classification of the *Bifidobacterium longum* biotype infantis strain 35624 gene products was performed according to the Riley rules (Riley, 1998a; Riley, 1993). The COG assignment was performed using XUGNITOR (Tatusov,). HMMER (Eddy,) was used to assign PFAM (Bateman et al., 2002) classification to the predicted proteins. TMHMM (Krogh et al., 2001) was used to predict transmembrane sequences, and SignalP (Bendtsen et al., 2004) was used for the prediction of signal peptides. Ribosomal RNA genes were detected on the basis of BLASTN searches and annotated manually. Transfer RNA genes were identified using tRNAscan-SE (Lowe and Eddy, 1997). Miscellaneous-coding RNAs were identified using the Rfam database (Griffiths-Jones et al., 2005) utilizing the INFERNAL software package (Eddy, 2002). Insertion sequence elements were identified using Repeatfinder (Volfovsky et al., 2001), Reputer (Kurtz & Schleiermcher, 1999) and BLAST (Altschul et al., 1990) and annotated manually. IS families were assigned using ISFinder. Carbohydrate-active enzymes were identified based on similarity to the carbohydrate-active enzyme (CAZy) database entries (Coutinho & Henrissat, 1999), and COG and PFAM classes annotated with carbohydrate enzyme activity. Transporter classification was performed according to the TC-DB scheme (Busch & Saier, 2002).

We identified a region from base numbers 44824 to 472245 (inclusive) of SEQ ID No. 1 that we designated exopolysaccharide (EPS) region 1 (SEQ ID No. 2). The EPS region 1 encodes the following genes:

TABLE 2

Open reading frames of EPS region 1 of the UCC 35624 genome

| Gene ID | Strand | Description | DNA sequence | Protein sequence |
| --- | --- | --- | --- | --- |
| BI00778 | + | glycosyl transferase CpsE | SEQ. ID No. 93 | SEQ. ID No. 133 |
| BI00779 | + | COG0840: Methyl-accepting chemotaxis protein | SEQ. ID No. 94 | SEQ. ID No. 134 |
| BI00780 | + | possible Etk-like tyrosine kinase involved in Eps biosynthesis | SEQ. ID No. 95 | SEQ. ID No. 135 |
| BI00781 | + | hypothetical glycosyl transferase, group 1 family protein | SEQ. ID No. 96 | SEQ. ID No. 136 |
| BI00782 | + | putative glycosyltransferase protein | SEQ. ID No. 97 | SEQ. ID No. 137 |
| BI00783 | + | NAD dependent epimerase/dehydratase family protein | SEQ. ID No. 98 | SEQ. ID No. 138 |
| BI00784 | + | UDP-glucose 6-dehydrogenase | SEQ. ID No. 99 | SEQ. ID No. 139 |
| BI00785 | + | hypothetical glycosyl transferase, group 1 family protein | SEQ. ID No. 100 | SEQ. ID No. 140 |
| BI00786 | + | hypothetical Eps11I | SEQ. ID No. 101 | SEQ. ID No. 141 |
| BI00787 | + | hypothetical Bacterial transferase hexapeptide (three repeats) | SEQ. ID No. 102 | SEQ. ID No. 142 |
| BI00788 | + | hypothetical Capsular polysaccharide synthesis protein | SEQ. ID No. 103 | SEQ. ID No. 143 |
| BI00789 | + | hypothetical protein | SEQ. ID No. 104 | SEQ. ID No. 144 |
| BI00790 | + | Eps9K | SEQ. ID No. 105 | SEQ. ID No. 145 |
| BI00791 | + | hypothetical Polysaccharide biosynthesis protein | SEQ. ID No. 106 | SEQ. ID No. 146 |
| BI00792 | + | hypothetical Bacterial transferase hexapeptide (three repeats) | SEQ. ID No. 107 | SEQ. ID No. 147 |
| BI00793 | − | NAD-dependent epimerase/dehydratase family protein, putative | SEQ. ID No. 108 | SEQ. ID No. 148 |
| BI00794 | − | transposase, degenerate | SEQ. ID No. 109 | SEQ. ID No. 149 |
| BI00795 | − | hypothetical COG2963: Transposase and inactivated derivatives | SEQ. ID No. 110 | SEQ. ID No. 150 |
| BI00796 | + | dTDP-glucose 4,6-dehydratase | SEQ. ID No. 111 | SEQ. ID No. 151 |
| BI00797 | + | dTDP-4-dehydrorhamnose 3,5-epimerase | SEQ. ID No. 112 | SEQ. ID No. 152 |
| BI00798 | + | glucose-1-phosphate thymidylyltransferase | SEQ. ID No. 113 | SEQ. ID No. 153 |

We also identified a region from base numbers 2071426 to 2097099 (inclusive) of SEQ ID No. 1 that we designated EPS region 2 (SEQ ID No. 3). The EPS region 2 encodes the following genes:

TABLE 3

Open reading frames of EPS region 2 of the UCC 35624 genome

| Gene ID | Strand | Description | DNA sequence | Protein sequence |
| --- | --- | --- | --- | --- |
| BI00319 | + | dTDP-glucose 4,6-dehydratase | SEQ. ID No. 114 | SEQ. ID No. 154 |
| BI00320 | + | conserved hypothetical protein | SEQ. ID No. 115 | SEQ. ID No. 155 |
| BI00321 | + | conserved hypothetical protein | SEQ. ID No. 116 | SEQ. ID No. 156 |
| BI00423t | + | conserved putative transposase | SEQ. ID No. 117 | SEQ. ID No. 157 |
| BI00322 | − | IS1533, OrfB | SEQ. ID No. 118 | SEQ. ID No. 158 |
| BI00323 | − | transposase (25) BH3998 [imported], putative | SEQ. ID No. 119 | SEQ. ID No. 159 |
| BI00324 | − | glycosyltransferase, putative | SEQ. ID No. 120 | SEQ. ID No. 160 |
| BI00325 | − | conserved sialic acid-specific 9-O-acetylesterase | SEQ. ID No. 121 | SEQ. ID No. 161 |
| BI00326 | + | hypothetical Acyltransferase family | SEQ. ID No. 122 | SEQ. ID No. 162 |
| BI00327 | − | conserved > hypothetical membrane protein with unknown function | SEQ. ID No. 123 | SEQ. ID No. 163 |
| BI00328 | − | hypothetical Glycosyl transferase family 8 | SEQ. ID No. 124 | SEQ. ID No. 164 |
| BI00329 | − | hypothetical glycosyl transferase, group 2 family protein | SEQ. ID No. 125 | SEQ. ID No. 165 |
| BI00330 | − | polysaccharide ABC transporter, ATP-binding protein | SEQ. ID No. 126 | SEQ. ID No. 166 |
| BI00331 | − | polysaccharide ABC transporter, permease protein, putative | SEQ. ID No. 127 | SEQ. ID No. 167 |
| BI00332 | + | hypothetical Glycosyl transferase family 8 | SEQ. ID No. 128 | SEQ. ID No. 168 |
| BI00333 | − | UDP-glucose 6-dehydrogenase | SEQ. ID No. 129 | SEQ. ID No. 169 |
| BI00334 | + | hypothetical NAD dependent epimerase/dehydratase family | SEQ. ID No. 130 | SEQ. ID No. 170 |
| BI00335 | − | membrane protein, putative | SEQ. ID No. 131 | SEQ. ID No. 171 |
| BI00336 | − | conserved hypothetical protein | SEQ. ID No. 132 | SEQ. ID No. 172 |

Example 5

Isolation and Screening of EPS-producing Bifidobacterial Strain from Fecal Samples Fecal Sample Preparation Fecal samples were collected by the subjects using a Kendall precision commode specimen collection system. The collected samples were stored chilled in a cold pack prior to sample processing. Only samples that are less than twenty four hours old were used in the evaluations.

A 10.0 gm sample of mixed fecal material was placed into a plastic stomaching bag containing 90 ml of saline. The suspension was stomached for 2 minutes. The suspension was filtered through a gauze pad contained within a disposable funnel. Following the filtration, 45 ml of the filtered fecal homogenate was transferred to a 50 ml disposable centrifuge tube. This fecal suspension was further used for DNA extraction or for bacterial isolation.

Screening Fecal Samples Using Three TaqMan Real-Time PCR Assays.

Fecal Sample DNA Preparation. A 2.0 ml aliquot of the fecal homogenate was pelleted using a microcentrifuge. The pellets were resuspended in 20 mg/ml lysozyme, for 2 hours at 37° C. DNA was extracted using a QIAamp DNA Stool Mini Kit (Qiagen). The DNA concentration was measured by Pico Green assay (Molecular Probes). Once the DNA concentration was measured, the DNA was stored at 4° C.

TaqMan Real-Time PCR Reactions. The test samples were diluted to a concentration of DNA of 2 ng/ul so that 5 µl contained a total of 10 ng DNA. Samples were assayed by a total of three separate assays.

The following reaction mix was made:

| | |
| --- | --- |
| Water | 15.75 µl |
| 10 µM forward primer | 1.5 µl (300 nM final concentration) |
| 10 µM reverse primer | 1.5 µl (300 nM final concentration) |
| 10 µM TaqMan probe | 1 µl (200 nM final concentration) |
| BSA (20 mg/ml) | 0.25 µl (0.1 ug/ml final concentration) |
| TaqMan Universal Master Mix | 25 µl |

A bulk mix was made for the number of samples to be assayed. A 45 µl aliquot was dispensed into each well of a 96 well microtitre plate, then 5 µl DNA was added to each well. The plate was spun briefly, and placed into the thermocycler (ABI 7900 HT). The standard TaqMan thermocycling protocol was used.

TanMan RT-PCR Program. The standard TaqMan quantitative PCR thermocycling protocol is as follows:

Step 1: 95° C. for 10 minutes (to activate the AmpliTaq Gold polymerase)

Step 2: 95° C. for 15 seconds (the denaturation step)

Step 3: 60° C. for 60 seconds (the priming/polymerization step)

Steps 2 and 3 are repeated 40 times. Fluorescent data is collected at step 3.

Primers and Probes for Three TaqMan RT-PCR assays. The fecal sample DNAs were screened using a EPS gene-specific assay and two B. infantis 35624 Unknown gene-specific assays (Unknown genes UNK1 and UNK2). The specific genes used and their TaqMan primer sets are shown in Table 4 below.

TABLE 4

UCC 35624 Primer set for TaqMan PCR

| Target Gene | Name | Sequence 5'-3' | Genome start | Genome end | TaqMan Probe label |
|---|---|---|---|---|---|
| BI01615 (UNK-1) | UNK1-F1 | CCATGAGCGGTTTCACGAA (SEQ ID No. 4) | 1451446 | 1451428 | 5' 6-FAM 3' |
| | UNK1-R1 | TTGGACGGTGCCTGTGATTA (SEQ ID No. 5) | 1451393 | 1451412 | NFQ-MG |
| | UNK1-MGB1 | CGGGCAATCAAC (SEQ ID No. 6) | 1451426 | 1451415 | |
| BI02420t (UNK-2) | UNK2-F1 | ACTTGACGTACCGTTTTGAGATTTC (SEQ ID No. 7) | 1656479 | 1656503 | 5' 6-FAM 3' |
| | UNK2-R1 | CTAAGCATGGCAAGGCTGATAGT (SEQ ID No. 8) | 1656562 | 1656540 | NFQ-MGB |
| | UNK2-MGB1 | TGCGACCAACACGC (SEQ ID No. 9) | 1656525 | 1656538 | |
| BI00783 (EPS) | EPS-F1 | GGGTCCAATAAGAAGGTTCCATATT (SEQ ID No. 10) | 456491 | 456515 | 5' 6-FAM 3' |
| | EPS-R1 | GCATGTGCCAACAGCTCATC (SEQ ID NO. 11) | 456591 | 456572 | TAMR |
| | EPS-TAMRA | CGGATGACAAGGTAGATAATCCAGTGAGCCTATAC (SEQ ID No. 12) | 456519 | 456553 | |

The fecal samples which showed high DNA concentration by the *B. infantis* 35624 EPS gene-specific assay, but negative reactions by using *B. infantis* 35624 Unknown gene-specific assays, were further used for the isolation of potential EPS-producing bacteria.

Example 6

Isolation and Characterization of BL1207 from Fecal Samples

One milliliter of bacterial suspension (see Example 5 above) was transferred to 9.0 ml of sterile phosphate-buffered saline which constituted the $10^{-1}$ dilution. One milliliter of this $10^{-1}$ dilution was transferred to 9.0 ml of sterile phosphate-buffered saline which was the $10^{-2}$ dilution. This process was continued until the $10^{-10}$ dilution was prepared. Then, 0.1 ml of each dilution was plated onto the surfaces of Reinforced Clostridial Agar (RCA) plates (BD or equivalent) and *Lactobacillus* Man-Rogosa Sharpe agar (MRSA) plates (BD or equivalent). The plates were incubated under anaerobic condition (COY anaerobic Chamber) at 33° C.±2° C. for 48-72 hours.

Following incubation, single colonies (a total of approximately 100 colonies) were picked from RCA and MRSA plates and further streaked on new plates for isolate purification. The plates with the streaked colonies were incubated under anaerobic conditions (COY anaerobic Chamber) at 33° C.±2° C. for 48 to 72 hours. After incubation, the pure colonies observed on plates were then submitted for DNA extraction.

Screening Fecal Isolates Using Three TaqMan Real-Time PCR Assays

The bacterial DNA was extracted using the Preman™ Ultra Sample Preparation Reagent and Protocol (Applied Biosystems). The DNA was further analyzed using three TaqMan RT-PCR assays (EPS gene-specific assay [EPS-1] and two *B. infantis* 35624 Unknown gene-specific assays [UNK1 and UNK2] as described above in Example 5. Only one isolate showed *B. infantis* 35624 EPS gene-specific assay positive, but *B. infantis* 35624 Unknown gene-specific assays-negative. This isolate was further identified using 16S rDNA sequencing.

Identification of Potential EPS-producing Strain by 16S rDNA Sequencing.

The 16S rRNA gene fragment was amplified and sequenced using ABI Full Gene PCR kit (Applied Biosystems, Foster City, Calif.).

(1). 16S rRNA Gene Amplification:

PCR amplification was carried out on a GeneAmp PCR System 9700 thermal cycler with the following program:

| Initial Hold: | 95° C. for 10 minutes |
|---|---|
| 30Cycles: | 95° C. for 30 seconds (Denaturing) |
| | 60° C. for 30 seconds (Annealing) |
| | 72° C. for 45 seconds (Extension) |
| Final Extension: | 72° C. for 10 minutes |

(2). 16S rRNA Gene Sequencing:

Sequencing was further performed on the thermal cycler using the following program:

| 25 Cycles: | 96° C. for 10 seconds (Denaturing) |
|---|---|
| | 50° C. for 5 seconds (Annealing) |
| | 60° C. for 4 minutes (Extension) |
| Final step | Hold at 4° C. |

The sequencing PCR product was further purified using DyeEX™ 2.0 spin kit and sequenced using 3130 x1 Genetic Analyzer (Applied Biosystems, Foster City, Calif.).

(3) Sequence Data Analysis:

Comparison of the consensus sequences with GenBank sequences was done by using Basic Local Alignment Search Tool (BLAST). The GenBank search indicated that the *B infantis* 35624 EPS gene-specific positive, but *B. infantis* 35624 Unknown gene-specific negative strain is *Bifidobacterium longum*. This strain is designated BL1207.

Example 7

Isolation and Screening of EPS-Expressing *Bifidobacterial Longum* Strains

Isolation of Bacterial Strains

Bacteria were isolated from bowel tissue and/or fecal samples using the methodology described in Example 1 above. In particular, *Bifidobacterium longum* strain AH121a was isolated from feline bowel tissue and *Bifidobacterium longum* strain AH1714 was isolated from colonic biopsy tissue from healthy human subjects.

EPS Gene Cluster Screen

Bacterial strains were screened for the presence of genes from EPS cluster 1 (Table 2 above) and EPS cluster 2 (Table 3 above) using the primers listed in Tables 5 and 6 below. Briefly, the following methodology was used for the PCR EPS cluster gene screen:

10 ml Modified Rogosa broth media (+0.05% cysteine) was inoculated aseptically with a freshly grown colony of the bacterial strain and incubated anaerobically at 37° C. until turbid (about 16 to about 24 hours). The broth cultures were centrifuged and DNA was isolated from the resultant pellet using a Sigma™ extraction procedure. A nanodrop was used to ascertain the concentration of DNA in the sample and samples were diluted using DEPC water to a final concentration of 50 ng/ul DNA per sample. The template DNA samples were used in individual PCR reactions with the primer sets listed in Tables 5 and 6 below under the following conditions:

| Step | Temp (° C.) | Time (sec) | |
|---|---|---|---|
| 1 | 95 | 240 | |
| 2 | 95 | 45 | |
| 3 | 60 | 45 | |
| 4 | 72 | 45 | repeat steps 2 to 4, 25 times |
| 5 | 4 | hold | |

The primers were specifically designed to amplify a PCR product of approximately 500 base pair for the 40 genes of EPS clusters 1 and 2. PCR products were visualised following agarose gel electrophoresis with an appropriate DNA ladder for reference sizing. The presence (YES) or absence (NO) of a 500 bp PCR product is indicated in Tables 7 and 8 below.

TABLE 5

Primers for screening bacterial strains for the presence of genes from EPS cluster 1

| Gene ID | Primer name | LRFR | Sequence | SEQ ID NO. |
|---|---|---|---|---|
| BI00778 | 1.01 | L | tat gtt gcc ggc att tat ca | SEQ ID No. 13 |
| BI00778 | 1.01 | R | tgc gcg ttc atg tca ata at | SEQ ID No. 14 |
| BI00779 | 1.02 | L | ggc gta gca agt tca agg ag | SEQ ID No. 15 |
| BI00779 | 1.02 | R | aat aac cgc tgc agg aac ac | SEQ ID No. 16 |
| BI00780 | 1.03 | L | gtg cag gac ggt aat gga gt | SEQ ID No. 17 |
| BI00780 | 1.03 | R | gct tcg ggt ctg gat cat ta | SEQ ID No. 18 |
| BI00781 | 1.04 | L | tgc tga caa gtg gag tct gg | SEQ ID No. 19 |
| BI00781 | 1.04 | R | cca cgt cta cga gca act ca | SEQ ID No. 20 |
| BI00782 | 1.05 | L | gaa agc gaa gag tgg tct gg | SEQ ID No. 21 |
| BI00782 | 1.05 | R | ccg gct gat ttg atg aga tt | SEQ ID No. 22 |
| BI00783 | 1.06 | L | tgc cgc tgt act ggt cac | SEQ ID No. 23 |
| BI00783 | 1.06 | R | gca tgt gcc aac agc tca | SEQ ID No. 24 |
| BI00784 | 1.07 | L | cca aca cgt atc tgg cac tg | SEQ ID No. 25 |
| BI00784 | 1.07 | R | tcg gag cca aag aag gta ga | SEQ ID No. 26 |
| BI00785 | 1.08 | L | ata ccg cgt atg ctt tgg ac | SEQ ID No. 27 |
| BI00785 | 1.08 | R | aaa cgg taa cca ctc gct tg | SEQ ID No. 28 |
| BI00786 | 1.09 | L | atg gga tcg atg cat gaa at | SEQ ID No. 29 |
| BI00786 | 1.09 | R | ttc tcg gca ata aac cgt tc | SEQ ID No. 30 |
| BI00787 | 1.10 | L | cca gcg gtt att tcg ttg tt | SEQ ID No. 31 |
| BI00787 | 1.10 | R | ggt ggc atg atc ctt atg ct | SEQ ID No. 32 |
| BI00788 | 1.11 | L | gct atc ttc acc gca ttg gt | SEQ ID No. 33 |
| BI00788 | 1.11 | R | cca gtc agg gaa ggt cac at | SEQ ID No. 34 |

TABLE 5-continued

Primers for screening bacterial strains for the presence of genes from EPS cluster 1

| Gene ID | Primer name | LRFR | Sequence | SEQ ID NO. |
|---|---|---|---|---|
| BI00789 | 1.12 | L | tga aat aca cgc aac ccg ta | SEQ ID No. 35 |
| BI00789 | 1.12 | R | aatgcgtcaaaaccgatacc | SEQ ID No. 36 |
| BI00790 | 1.13 | L | gga aag caa tga gga agc tg | SEQ ID No. 37 |
| BI00790 | 1.13 | R | gat ttg atg caa agc aag ca | SEQ ID No. 38 |
| BI00791 | 1.14 | L | gtg agt acc gtt tcc gca at | SEQ ID No. 39 |
| BI00791 | 1.14 | R | ttc ctt ggt tcc cgt gat ag | SEQ ID No. 40 |
| BI00792 | 1.15 | L | gct ggg att ttg gaa gtg aa | SEQ ID No. 41 |
| BI00792 | 1.15 | R | tgt tac ccc cgg cat aat aa | SEQ ID No. 42 |
| BI00793 | 1.16 | L | acc ggt aac gtt cag att gc | SEQ ID No. 43 |
| BI00793 | 1.16 | R | gca ata ccg cct tga cct ta | SEQ ID No. 44 |
| BI00794 | 1.17 | L | ttg tac cac cac acg tac cg | SEQ ID No. 45 |
| BI00794 | 1.17 | R | cgc gag ttc aat ggc tat g | SEQ ID No. 46 |
| BI00795 | 1.18 | L | aca tcg acc tcc atc tcc ag | SEQ ID No. 47 |
| BI00795 | 1.18 | R | ata cgt aac agc ggc tcc ac | SEQ ID No. 48 |
| BI00796 | 1.19 | L | aag tac gat gtg cgc tac ca | SEQ ID No. 49 |
| BI00796 | 1.19 | R | cat cac ggt cag gat gtc ac | SEQ ID No. 50 |
| BI00797 | 1.20 | L | cga ata cac gga cat caa cg | SEQ ID No. 51 |
| BI00797 | 1.20 | R | gag aat cga gca gct gga ac | SEQ ID No. 52 |
| BI00798 | 1.21 | L | tgg gag agg agt tca tcg ac | SEQ ID No. 53 |
| BI00798 | 1.21 | R | gta tcc agc cat gcg taa cc | SEQ ID No. 54 |

TABLE 6

Primers for screening bacterial strains for the presence of genes from EPS cluster 2

| Gene ID | Primer name | LRFR | Sequence | SEQ ID NO. |
|---|---|---|---|---|
| BI00319 | 2.01 | L | acg gac tca aaa cca cca tc | SEQ ID No. 55 |
| BI00319 | 2.01 | R | acc ctg ctt ccg gta ctt tt | SEQ ID No. 56 |
| BI00320 | 2.02 | L | gcc tac gca aga cct tat gc | SEQ ID No. 57 |
| BI00320 | 2.02 | R | cgt tat acg cgt gct tga ga | SEQ ID No. 58 |
| BI00321 | 2.03 | L | tgg aac gca ata ttc aac ga | SEQ ID No. 59 |
| BI00321 | 2.03 | R | cca agt atg gct cca cga at | SEQ ID No. 60 |
| BI00423t | 2.04 | L | acg cct gtc tat ggt tgg aa | SEQ ID No. 61 |
| BI00423t | 2.04 | R | cgg tag gac tcg ttc tcg tc | SEQ ID No. 62 |
| BI00322 | 2.05 | L | tcg agg ttc gag gtg aag at | SEQ ID No. 63 |
| BI00322 | 2.05 | R | cct gtt cga gaa gga gaa cg | SEQ ID No. 64 |

TABLE 6-continued

Primers for screening bacterial strains for the presence of genes from EPS cluster 2

| Gene ID | Primer name | LRFR | Sequence | SEQ ID NO. |
|---|---|---|---|---|
| BI00323 | 2.06 | L | atg gaa gca tgt ggt cct tc | SEQ ID No. 65 |
| BI00323 | 2.06 | R | att tcc tgg tgg tgt cgt tc | SEQ ID No. 66 |
| BI00324 | 2.07 | L | atg gcg aaa ctg ttg gac tc | SEQ ID No. 67 |
| BI00324 | 2.07 | R | gct acc gtg cct tct cat tc | SEQ ID No. 68 |
| BI00325 | 2.08 | L | gcc gaa tcg ctt ttg aaa ta | SEQ ID No. 69 |
| BI00325 | 2.08 | R | aaa tcc tca tcg ggg aaa ac | SEQ ID No. 70 |
| BI00326 | 2.09 | L | gtt tat ttt cgc cgt gcc ta | SEQ ID No. 71 |
| BI00326 | 2.09 | R | aat tcc aat ggc ttt tgc tg | SEQ ID No. 72 |
| BI00327 | 2.10 | L | atg tgc gaa tcc gac ata ca | SEQ ID No. 73 |
| BI00327 | 2.10 | R | tgc tta tct cgt ccc cat tc | SEQ ID No. 74 |
| BI00328 | 2.11 | L | gca aaa tgc ttg gct tct tc | SEQ ID No. 75 |
| BI00328 | 2.11 | R | ctg gat tcc gat gat gct tt | SEQ ID No. 76 |
| BI00329 | 2.12 | L | ctg cac gta tcg gga ttt tt | SEQ ID No. 77 |
| BI00329 | 2.12 | R | ctc ggc aga gga cag gat ag | SEQ ID No. 78 |
| BI00330 | 2.13 | L | gat cat cga cac gca atg ac | SEQ ID No. 79 |
| BI00330 | 2.13 | R | taa ggc cat cct cat caa gg | SEQ ID No. 80 |
| BI00331 | 2.14 | L | tct ggg gaa agc agg tta tg | SEQ ID No. 81 |
| BI00331 | 2.14 | R | ctg tgc ggt acc tgt ttg tg | SEQ ID No. 82 |
| BI00332 | 2.15 | L | aat tac gtc ccg atg ctc ac | SEQ ID No. 83 |
| BI00332 | 2.15 | R | caa tac acc ggc ttg gaa gt | SEQ ID No. 84 |
| BI00333 | 2.16 | L | tgt aga cct tgt cgc tca cg | SEQ ID No. 85 |
| BI00333 | 2.16 | R | gca tcg gtg acg gct ata at | SEQ ID No. 86 |
| BI00334 | 2.17 | L | gtg ctc gac aag ctg acg ta | SEQ ID No. 87 |
| BI00334 | 2.17 | R | gtg ttc cgc ata cca atc g | SEQ ID No. 88 |
| BI00335 | 2.18 | L | ggc gag tgc acc aaa taa at | SEQ ID No. 89 |
| BI00335 | 2.18 | R | cga ttc cgt cta ttg gtt cg | SEQ ID No. 90 |
| BI00336 | 2.19 | L | ata agt ccg gtg gca atc ag | SEQ ID No. 91 |
| BI00336 | 2.19 | R | caa tgg atg ata cgg tgc tg | SEQ ID No. 92 |

TABLE 7

Results of EPS cluster 1 gene screen

| Gene ID | Primer set | B. longum 35624 | B. longum 1207 | B. longum AH121A | B. longum 1714 |
|---|---|---|---|---|---|
| BI00778 | 1.01 | YES | YES | NO | YES |
| BI00779 | 1.02 | YES | YES | NO | YES |
| BI00780 | 1.03 | YES | YES | NO | YES |
| BI00781 | 1.04 | YES | YES | YES | YES |
| BI00782 | 1.05 | YES | YES | YES | YES |
| BI00783 | 1.06 | YES | YES | YES | YES |
| BI00784 | 1.07 | YES | YES | YES | YES |
| BI00785 | 1.08 | YES | YES | YES | YES |
| BI00786 | 1.09 | YES | YES | YES | YES |
| BI00787 | 1.10 | YES | YES | YES | YES |
| BI00788 | 1.11 | YES | YES | YES | NO |
| BI00789 | 1.12 | YES | YES | YES | YES |
| BI00790 | 1.13 | YES | YES | YES | YES |
| BI00791 | 1.14 | YES | YES | YES | YES |

TABLE 7-continued

Results of EPS cluster 1 gene screen

| Gene ID | Primer set | B. longum 35624 | B. longum 1207 | B. longum AH121A | B. longum 1714 |
|---|---|---|---|---|---|
| BI00792 | 1.15 | YES | YES | YES | YES |
| BI00793 | 1.16 | YES | YES | NO | YES |
| BI00794 | 1.17 | YES | YES | NO | YES |
| BI00795 | 1.18 | YES | YES | NO | YES |
| BI00796 | 1.19 | YES | YES | YES | YES |
| BI00797 | 1.20 | YES | NO | NO | NO |
| BI00798 | 1.21 | YES | YES | YES | YES |

In which YES indicates the presence and NO indiates the absence of a 500 bp PCR product.

TABLE 8

Results of EPS cluster 1 gene screen

| Gene ID | Primer set | B. longum 35624 | B. longum 1207 | B. longum AH121A | B. longum 1714 |
|---|---|---|---|---|---|
| BI00319 | 2.01 | YES | NO | NO | NO |
| BI00320 | 2.02 | YES | NO | NO | NO |
| BI00321 | 2.03 | YES | NO | NO | NO |
| BI00423t | 2.04 | YES | NO | NO | NO |
| BI00322 | 2.05 | YES | NO | NO | NO |
| BI00323 | 2.06 | YES | NO | NO | NO |
| BI00324 | 2.07 | YES | NO | NO | NO |
| BI00325 | 2.08 | YES | NO | NO | NO |
| BI00326 | 2.09 | YES | NO | NO | NO |
| BI00327 | 2.10 | YES | NO | NO | NO |
| BI00328 | 2.11 | YES | NO | NO | NO |
| BI00329 | 2.12 | YES | NO | NO | NO |
| BI00330 | 2.13 | YES | NO | NO | NO |
| BI00331 | 2.14 | YES | NO | NO | NO |
| BI00332 | 2.15 | YES | NO | NO | NO |
| BI00333 | 2.16 | YES | NO | NO | NO |
| BI00334 | 2.17 | YES | NO | NO | NO |
| BI00335 | 2.18 | YES | YES | NO | YES |
| BI00336 | 2.19 | YES | YES | YES | YES |

In which YES indicates the presence and NO indiates the absence of a 500 bp PCR product.

Congo Red Agar Screen

A Congo red agar screen was used to phenotypically screen for EPS expressing bacterial strains. Briefly, 10 ml Modified Rogosa broth media (+0.05% cysteine) was inoculated aseptically with a freshly grown colony of the bacterial strain and incubated anaerobically at 37° C. until turbid (about 16 to about 24 hours). The broth cultures were aseptically streaked onto Congo Red Agar plates and incubated anaerobically at 37° C. for 48 hours. It is believed that EPS produced as a by-product of the growth and/or metabolism of certain strains prevents the uptake of the Congo red stain resulting in a cream/white colony morphology. Stains that produce less EPS take up the Congo red stain easily, resulting in a pink/red colony morphology. Strains that do not produce an EPS stain red and look almost transparent in the red agar background.
Referring to FIGS. 6 to 12, the following colony morphologies were observed:

TABLE 9

Colony morphologies from Congo red agar screen

| Bacterial Strain | Colony morphology |
|---|---|
| B. longum 35624 (FIG. 6) | Convex, mucoid, bright white colonies |
| B. longum AH121A (FIG. 7) | Convex, mucoid, bright white colonies |
| B. logum AH1714 (FIG. 8) | Convex, mucoid, bright white colonies |
| B. longum AH0119 (FIG. 9) | Convex, mucoid, pale pink/off white colonies |
| B. breve UCC2003 (FIG. 10) | Convex, mucoid, pale pink/off white colonies |
| L. rhamnosus AH308 (FIG. 11) | Flat, semi-mucoid, pale pink/off white colonies |
| L. salivarius UCC1 (FIG. 12) | Flat, non-mucoid, clear/transparent colonies |

Example 8

*B. infantis* 35624 and BL1207 Induce Nearly Identical Cytokine Profiles in PBMCs Peripheral blood mononuclear cells (PBMCs) were isolated from fresh human peripheral blood using BD Vacutainer CPT tubes (BD catalog 362761), as per the manufacturer's instructions. PBMCs were washed and resuspended in Dulbecco's MEM (Gibco catalog 10569-010) plus 25 mM HEPES, 10% fetal bovine serum (Sigma catalog F4135), and 1% penicillin/streptomycin (Sigma catalog P0781). $2 \times 10^5$ PBMCs (in 200 µl of DMEM) were plated into each well of a 96-well culture plate.

Bacteria were grown in Difco MRS media and harvested just after entering into stationary phase. All cells were grown under anaerobic conditions at 37° C. Growth curves (OD vs # of live cells) were constructed for each growth condition, and washed cells were normalized by cell number before addition to the PBMCs.

Bacteria (20 µl in phosphate buffered saline (PBS)) were added to each well of PBMCs to give the total number of bacteria as indicated for each experiment. Three different amounts of bacteria were tested: 1.25E+07, 6.25E+06, and 3.13E+06 were added to separate wells of PBMCs. A no-bacteria control also was run. All assays were done in triplicate. After a 2-day incubation at 37° C., the plates were spun at 300×g, and the supernatants were removed and stored frozen at −80° C. until analysis.

Cytokines in the culture supernatants were assayed using a 96-well assay kit from Meso Scale Discovery (Gaithersburg, Md.; catalog K15008B-1). Human Interleukin-1 beta (Il-1b), Interleukin 10 (Il-10), Interleukin 12p70 (Il112p70), and Tumor Necrosis Factor alpha (TNFa) 25 were quantitated and reported as picograms per milliliter. Each sample was assayed in duplicate.

FIGS. 2 to 5 show the results of a representative experiment. For each cytokine shown, *B. infantis* 35624 and BL1207 induce nearly identical levels of cytokines. These levels are very different than the levels induced by the three other Bifidobacterial strains that they were compared to.

Example 9

*Bifidobacteria* with Similar EPS Genes and High EPS Production Induce a Significantly Elevated IL-10:IL-12 Ratio Compared to Strains Lacking These Genes Peripheral blood mononuclear cells (PBMCs) were isolated from healthy human peripheral blood using BD Vacutainer CPT tubes (BD catalog 362761), as per the manufacturer's instructions. PBMCs were washed and resuspended in Dulbecco's Modified Eagle Medium-Glutamax™ (Glutamax (Glutamine substitute)+pyruvate+4.5 g/l glucose (Gibco catalog 10569-010) 10% fetal bovine serum (Sigma catalog F4135), and 1% penicillin/streptomycin (Sigma catalog P0781). PBMCs were incubated ($2\times10^5$ cells per well) in flat-bottomed 96-well plates and 20 µL of a bacterial suspension (at a concentration of $1\times10^7$ CFU/mL) was added. PBMCs were co-incubated with bacteria for 48 hours at 37° C./5% $CO_2$ in an incubator. After the 2 day incubation period, the plates were centrifuged at 300×g, and the supernatants were removed and stored frozen at −80° C. until analysis. Interleukin-10 (IL-10) and Interleukin-12p70 (IL-12p70) levels in the culture supernatants were quantified using a 96-well assay kit from Meso Scale Discovery (Gaithersburg, Md.; catalog K15008B-1)

Bacteria were prepared for co-culture experiments in two formats. (a) Freshly grown bacteria were grown in Difco MRS media and harvested just after entering into stationary phase. All cells were grown under anaerobic conditions at 37° C. (b) Bacteria were grown under anaerobic conditions at 37° C. in Difco MRS media and harvested just after entering into stationary phase. Freeze dried powders were generated for each of these bacteria and stored at −80° C. in pre-aliquoted 100 mg vials Immediately prior to their use, one aliquot of each strain was removed from the freezer and allowed to reach room temperature. Each strain was washed 3 times in 10 ml ringers followed by centrifugation. A fresh vial was used on each occasion. Growth curves (OD vs number of live cells) were constructed for each growth condition, and washed cells were normalized by cell number before addition to the PBMCs. A no-bacteria control was also included in all experiments. All assays were done in triplicate.

Figure 13:
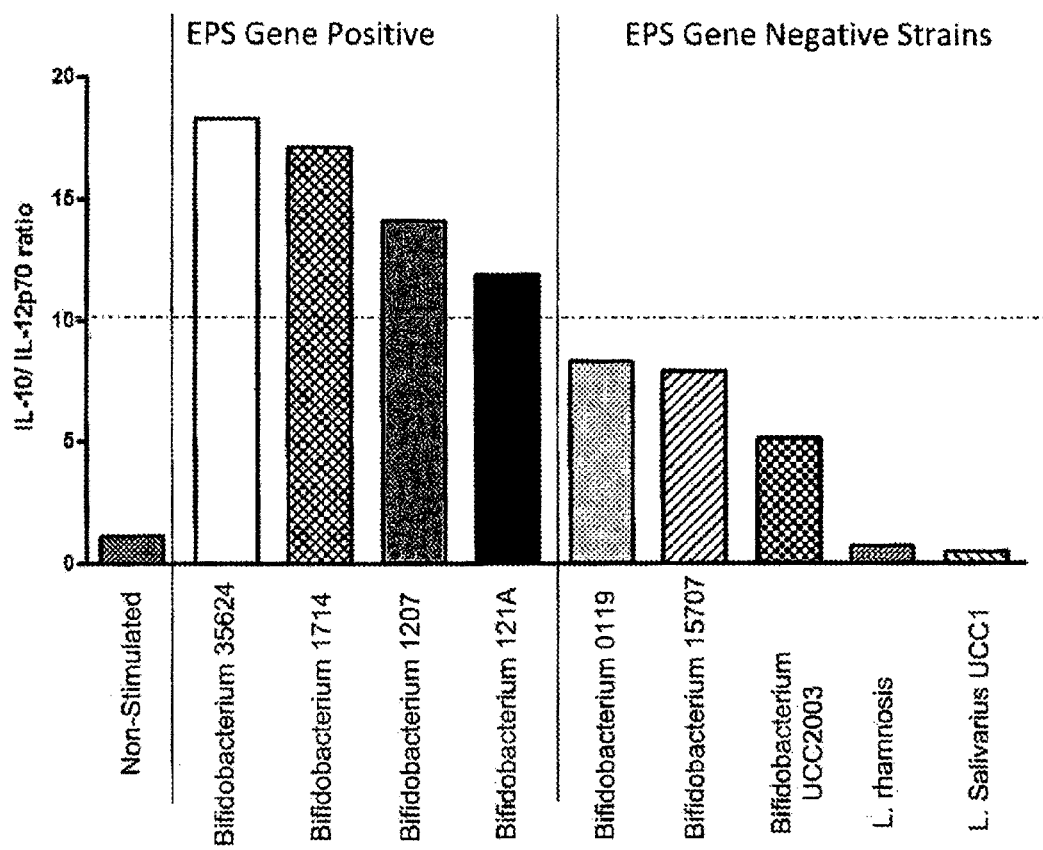
FIG. 13 is a bar chart illustrating the IL-10:IL-12p70 ratio for PBMCs stimulated with *Bifidobacterium longum* infantis strain 35624 (*Bifidobacterium* 35624), *Bifidobacterium longum* strain 1714 (*Bifidobacterium* 1714), *Bifidobacterium longum* strain 1207 (*Bifidobacterium* 1207), *Bifidobacterium longum* strain 121A (*Bifidobacterium* 121A), *Bifidobacterium longum* strain 0119 (*Bifidobacterium* 0119), *Bifidobacterium longum* strain 15707 (*Bifidobacterium* 15707), *Bifidobacterium breve* strain 8807 (*Bifidobacterium* UCC2003), *Lactobacillus rhamnosus* and *Lactobacillus salivarius* strain UCC1.

The *Bifidobacteria* which contained many of the EPS genes exhibited a similar effect on IL-10:IL-12 induction while bacterial strains which do not contain the EPS genes induced a significantly lower IL-10:IL-12 ratio (FIG. 13). Both freshly grown and freeze-dried cultures exhibited a similar effect in that the strains containing similar EPS genes induced a higher IL-10:IL-12 ratio than those strains that did not contain these genes.

The control of inflammatory diseases is exerted at a number of levels. The controlling factors include hormones, prostaglandins, reactive oxygen and nitrogen intermediates, leukotrienes and cytokines. Cytokines are low molecular weight biologically active proteins that are involved in the generation and control of immunological and inflammatory responses. A number of cell types produce these cytokines, with neutrophils, monocytes and lymphocytes being the major sources during inflammatory reactions due to their large numbers at the injured site.

Multiple mechanisms exist by which cytokines generated at inflammatory sites influence the inflammatory response. Chemotaxis stimulates homing of inflammatory cells to the injured site, whilst certain cytokines promote infiltration of cells into tissue. Cytokines released within the injured tissue result in activation of the inflammatory infiltrate. Most cytokines are pleiotropic and express multiple biologically overlapping activities. As uncontrolled inflammatory responses can result in diseases such as IBD, it is reasonable to expect that cytokine production has gone astray in individuals affected with these diseases.

Interleukin-10 (IL-10) is an anti-inflammatory cytokine which is produced by many cell types including monocytes, macrophages, dendritic cells, mast cells and lymphocytes (in particular T regulatory cells). IL-10 down-regulates the expression of pro-inflammatory Th1 cytokines, MHC class II antigens, and co-stimulatory molecules on antigen presenting cells. It also enhances B cell survival, proliferation, and antibody production. This cytokine can block NF-κB activity, and is involved in the regulation of the JAK-STAT signaling pathway. Murine knock-out studies have demonstrated the essential role for IL-10 in immunoregulation as IL-10KO mice develop severe colitis. In addition, bacteria which are potent inducers of IL-10 have been shown to promote T regulatory cell differentiation in vivo thus contributing to immunological homeostasis (O'Mahony et al., AJP 2006; O'Mahony et al., PLoS Pathogens 2008).

Interleukin-12 (IL-12) is a pro-inflammatory cytokine associated with polarisation of Th1 effector T cell responses and stimulates the production of other pro-inflammatory Th1 cytokines, such as interferon-gamma (IFN-γ) and tumor necrosis factor-alpha (TNF-α), from T and natural killer (NK) cells. High levels of IL-12 expression is associated with autoimmunity. Administration of IL-12 to people suffering from autoimmune diseases was shown to worsen disease symptoms. In contrast, IL-12 knock-out mice or treatment of mice with IL-12 neutralising antibodies ameliorated the disease.

Cytokine cascades and networks control the inflammatory response, rather than the action of a particular cytokine on a particular cell type. The relative levels of expression, or balance, of two cytokines (such as IL-10 and IL-12) is more informative than the expression of a single cytokine. In these studies, we stimulated human PBMCs with a range of different bacterial strains. All strains induced IL-10 and all strains induced IL-12. However, examination of the ratio between IL-10 and IL-12 induction revealed that some bacterial strains induced a higher ratio (i.e. more IL-10 with less IL-12) compared to other strains. This is a meaningful observation as it is the balance between each of these opposing signals that ultimately determines the immunological outcome. It is anticipated that a high IL-10:IL-12 ratio would promote an anti-inflammatory response associated with appropriate immunoregulatory activity while a low IL-10:IL-12 ratio would contribute to Th1 polarisation of the immune response. Thus, the PBMC IL-10:IL-12 ratio is a important selection criterion for identification of bacterial strains with immunoregulatory properties.

The dimensions and values disclosed herein are not to be understood as being strictly limited to the exact numerical values recited. Instead, unless otherwise specified, each such dimension is intended to mean both the recited value and a functionally equivalent range surrounding that value. For example, a dimension disclosed as "40 mm" is intended to mean "about 40 mm."

All documents cited in the Detailed Description of the Invention are, in relevant part, incorporated herein by reference; the citation of any document is not to be construed as an admission that it is prior art with respect to the present invention. To the extent that any meaning or definition of a term in this document conflicts with any meaning or definition of the same term in a document incorporated by reference, the meaning or definition assigned to that term in this document shall govern.

While particular embodiments of the present invention have been illustrated and described, it would be obvious to those skilled in the art that various other changes and modifications can be made without departing from the spirit and scope of the invention. It is therefore intended to cover in the appended claims all such changes and modifications that are within the scope of this invention.

REFERENCES

Altschul, S. F., Madden, T. L., Schaffer, A. A., Zhang, J., Zhang, Z., Miller, W., and Lipman, D. J. (1997). Gapped BLAST and PSI-BLAST: a new generation of protein database search programs. Nucleic Acids Res 25, 3389-3402.
Altschul S. F., Gish W., Miller W., Myers E. W. and Lipman D. J. (1990) Basic local alignment search tool. J Mol Biol. 215: 403-410.
Bateman, A., Birney, E., Cerruti, L., Durbin, R., Etwiller, L., Eddy, S. R., Griffiths-Jones, S., Howe, K. L., Marshall, M., and Sonnhammer, E. L. (2002). The Pfam protein families database. Nucleic Acids Res 30, 276-280.
Bendtsen J. D., Nielsen H., von Heijne G. and Brunak S. (2004) Improved prediction of signal peptides: SignalP 3.0. J Mol Biol. 340: 783-795.
Bouhnik Y Survival And Effects Of Bacteria Ingested In Fermented Milk In Man Lait 73 (2): 241-247 1993
Busch W, Saier M H The Transporter Classification (TC) system, 2002 Critical Reviews In Biochemistry And Molecular Biology 37 (5): 287-337 2002
Chevalier, P. et al. (1990) *J. Appl. Bacteriol* 68, 619-624)
Coutinho & Henrissat, 1999
Delcher A L, Harmon D, Kasif S, White O, Salzberg S L Improved microbial gene identification with GLIMMER Nucleic Acids Research 27 (23): 4636-4641 Dec. 1, 1999
Eddy, S. R. The HMMER software tools.
Eddy S R A memory-efficient dynamic programming algorithm for optimal alignment of a sequence to an RNA secondary structure BMC BIOINFORMATICS 3: Art. Nov. 18, 2002
Green, P. The Phred/Phrap/Consed system home page
Griffiths-Jones S, Moxon S, Marshall M, Khanna A, Eddy S R, Bateman A Rfam: annotating non-coding RNAs in complete genomes Nucleic Acids Research 33: D121-D124 Sp. Iss. SI Jan. 1, 2005
Krogh A, Larsson B, von Heijne G, Sonnhammer E L L., Predicting transmembrane protein topology with a hidden Markov model: Application to complete genomes Journal Of Molecular Biology 305 (3): 567-580 Jan. 19, 2001
Kurtz S, Schleiermacher C REPuter: fast computation of maximal repeats in complete genomes Bioinformatics 15 (5): 426-427 May 1999
Lowe T M, Eddy S R tRNAscan-SE: A program for improved detection of transfer RNA genes in genomic sequence Nucleic Acids Research 25 (5): 955-964 Mar. 1, 1997
Liu M, van Enckevort F H, Siezen R J, Genome update: lactic acid bacteria genome sequencing is booming Microbiology 2005, vol 151 pp 3811-3814
McCarthy et al., 2004
O'Mahony L, McCarthy J, Kelly P, Hurley G, Luo F, Chen K, O'Sullivan G C, Kiely B, Collins J K, Shanahan F, Quigley E M.: *Lactobacillus* and *bifidobacterium* in irritable bowel syndrome: symptom responses and relationship to cytokine profiles.
Gastroenterology. March 2005; 128(3):541-51.
O'Mahony et al., A J P 2006
O'Mahony et al., PLoS Pathogens 2008
Riley, 1993
Riley, 1998a
Rutherford, K., Parkhill, J, Crook, J., Horsnell, T., Rice, P., Rajandream, M. A., and Barrell, B. (2000). Artemis: sequence visualization and annotation. Bioinformatics 16, 944-945.
Salzberg S, Delcher A L, Fasman K H, Henderson J. A decision tree system for finding genes in DNA Journal Of Computational Biology 5 (4): 667-680 WIN 1998
Suzek, B. E., Ermolaeva, M. D., Schreiber, M., and Salzberg, S. L. (2001). A probabilistic method for identifying start codons in bacterial genomes. Bioinformatics 17, 1123-1130.
Tatusov, R. L., The XUGNITOR software ftp://ftp.ncbi.nih gov/pub/COG/old/util/xugnitor.c.
Volfovsky et al., 2001
Wheeler et al., 2005

SEQUENCE LISTING (172 sequences)

SEQ ID NO: 1 - DNA, 2264374 bp, Bifidobacterium longum
atggttaacgcttccggcgaccccgtaatcgaggccgcccacatctggtcagacacgctgacggtgctcaaacacagcgcttcgctcagcccacgagaaaaaggctggttggaaggcgttgttcctgaaggcgtcttcggttcgaccatcgtgctgtgtgtggacaacaacgacacgcttcaagccattcagggtgatttgaacgattccctgcttcaggcattgcgtacggtaaccggcgaaaatatgtttcccgcgttcaaggtcgtgccgaaaaccgagcccgaaccgctttcggaggcaaagccggcgcagccatatccttcggaaatttctccgactgtcgccgaattcggtaaagaatcctatggtgcaaagccggcagccgcaccgcgggaaccgatgcccgccaccgagccgcagttcccggtcggtcagcagaagatgaatcgcgatcccgagactcatctcaataagaacttcacgtttgattccttcgtgcccggcgattccaaccgttttgcccgtacggtcgcactggccgtggccgaaggttccgggcaggatttcaacccgttgtgtatctatggcggatcgggcctgggcaaaacccacttgctgaacgccatcggcaactatgcactggtcaaggatcccgggctgaaggttcgatacgtcacgtctgaggaattcacgaacgaattcattgacgcgctgcaaaacccgaaccaaagccaggggcagattgctgaattcaaccgtcgataccgacaggttgatgtgttgcttattgacgatatccagttcctcggcggcaaggaagccaccttggatcagttcttccatacgttcaatgcactgcatcaggcaaataagcgtattgtcattgcttccgatgtagcgcccaagaatttgaagggtttcgaggctcgactcatctcgcgcttcgaatccggcctgaccgtagacgtcaagccgccggatctggagacccgaatcgccattcttcgcatgatcgcctcgatgaacggctcgaaaatccccagcgatgtgttggacctcatcgccgaacgcttcaccgagaacattcgtgaactcgaaggcgcgctaacccgtgttacggccgtggcctcgctgagtaatcagccggtgacccgcgccttggccgagcagacgttgcaggacttcttcaccaccgatgtggaaatcaagcccacggacatcatcagtcaggtggcgaagtacttccacctgacgtttgaggatcttgtcggtaaatcacgaaccaaaaacgtggctgttcctcgtcagatcgccatgtatctggctcgcgaaatgaccagtatgagcctgatggatattggccaggtctttggcggacgcgatcacaccacagtaatgcatgcctgcactcgaatcagtgaccgaatgcagcaaaaacaggagatctataactacgttatggagctcacggttcgcctcaagcaaagcaacaccaactgacacaacgcttctgagagacgaaaaacggcactttttggactgactttccgaaaagtgccgtttttggttgctcaggcggattctggtggatacgtcgaggcaacggattcgagacattagattcctcatggctcccctttgtgaggggatctgtcggcgcagacgactgaggggagtttcgaaggggaacacgcaaaaaaaccatgaaacgagagaatcgattctgaggaccgattttgcgggtttgggcgagcgagacggaaaaagtgccgaaaacggtctccagaatcgattctcctcgacgaaaaacagtcttcaacacgccgtgcgaaagtgcgaaaaccaaaaaagttatccacatagttgtgcacagatgtgggtaaactcggcggataactcgtggattacccactgttttgttgtggaaaactcgtgcataaccgcgacctcgatgtggaaaactcaaattcgacgaactggctgtggaaaactcgcccacttatccacaagccatgcagaatttgtccacaattttcagggacttatgaaccgttgcagttgtagggctcagccctacttatccacactatccaccggccttattatggcgattacttactcagttacgtgaaaagcatcatcgccatagtaacagccggtcatccagcgtacgtaagttcgccacctaacggctagaatatttctcagccaatccgacgaagggaacaatcacacatgaaagtcgaaatcgatactgcagccctggccgacgccgtagcctggacctcccgagtcatcgacgcacgtccctccaacccgattctcgctggtgtcaagctggaagccattgacggaacgctgcaattctccgccttcaactacgagatttccgctcgccaccacatcgaagccggcgttgacgaagccggttccgtactggttcagggcaagctgctggccgatatcaccaaatcgctgcgttcggagaaaacgtacctggtcaccgacggctccacgctgaccatcacgtccggcaagtcgaagttcaccttgcagctcatgcccgacaccgagtacccggatctgcccgtggtaccggccatgctcggccaagtcgatgccccgactttcgttcaggccgtgaaccaggcgtgcgttgccgtctcccgcgaagaaaaccgcccggtactgaccggcgttcgcatgcaattccaaggcgacaaggtcgtcatgacctccaccgatcgcttccgtttggcccgcgccaccttcacttggactccgcagaacccggacgtcgacaccaccacgctggttcgcggctccctgctcaaggatgtggcccgtgctcttgacgagcaccagaacatccgccttgatttcgatgccgatagcccgacgctgctcggcttcgaaaacgccggccgcgtctccacctcccagctcatcgacggtgaattcccggcggtcgaccgcctgttcgccgacgaatatccgattcaggccgtagtcaacaagcaggatttgctcgacgccatcagccgtgtggctttggtcgccgaacgcaatgctccgattcgcatgaccttcaccggtcaggaagtggcgctgtccgccggatcggtcgacgaggctcaggccaacgaaacactggacatcgacatggatggcgacgacatcaccgtggcattcaacccgtcctacctgaaggagggtctgtccgccgtaaccgaaccattcgtgcgcatcaaaatgacgaccccggtcaagccggtcgagttcaatggccagcaggaagctgattccgacgagtccatggactaccgatacctgctcgtgccgatgcgctttaacaactgaaatccctgaatttccaacgattcgctaatgcacatctcccgtctcgcactcgaccactaccgctcatggagtcaggtagtggtcgatttcgtaccaggcgtgaatatcctgttcggcaagaacggtctgggcaaaaccaatctggtggaagccttcgaagtgctgtccaccggatcgagccatcgcacgtccagcacgttgccgctgatcgaacgcgggcagaccacggccaccatccgcgcgaacgtcgctgatgatgccggtcaaaccactacgtatgaagcgtcaattcatgcgcgtggtgccaaccgagcccgcatcaactcggggtcgtcgctgtatctgcgcgatatcatcggcaagattcccagcgtttccttcactcccgaagatcagcggttggtgtccggcgatccgggagcacgccgcaccatgatgaatcaggctgcggctctgctcgagcccggatacatgcagacgttgcaacagttcacgcgcatcgccaaacagcgtgccacattgttgaagcaattgaatgccaatgtcaacaatggccagccgatggatgcggttctgagcggtttggaaatctggaccggccagttcatcgaagccggtgtggcgttgacccgtatgcgcgctcatgtgatcggtctgcttgccgagccatttgccgcgatttacgccgacttggccggtgccggcgagcaggtgacgctcacttatgcgccttcattcgacgaagtgctgatgttcgacgatccgcatccgcagattagcgagcatttccaacgcatctaccccggtgaagtggctcgcggcgtgaaccttatcggtccgcagcgcgatgacatgaaccttgagttgggcggtattcccgcccgcgagttcgcttcgaacggcgagatgtggacgatggcgttggccttgaaaatggcattgttcgaaatagtgcgtgaccggttgggattgcagccgattgtgattctcgatgatgtgttcgcccagcttgacgacagccggcgcacgcagattcttgatttcgccagaaaacaggatcaggtgctgattaccgtggccgctgaaggcgatgtgcccgactatgaatcggcccatcgcatcgacgtggccgcactggacgaaccagcttccgtgatattgccaactctgggcaatttgtccaattcgcgggaaaatgagagtttgggtgggtatgacgaaaaaaccgcggtggacagcgcgtccgtagaacggaaagtgtcatgaacccgccgatcgcccgccaactcaacctggacgagaccaaactgccggccgaaatattcgagcggctctcccgtcgcggggcgaccttgaaggactacagacgccgccgtgaagaggccatcgaaaacttcggcaaaccggggcgcgatccggctgaactgggcagcgtgatgaccaccatcgccggcaacggcgtctggacggcgaatatgaagcttgcgcaattgcgcaaccattgggaccaagtggtgggtcaggccatcgccagccattcggcagtcgccgatttcactgacggcgtactgaccatccgcgccgaatccacggtctgggccacgcagctgacctaccttatcccccaactcaccgataccatccgtcgcaatctcaaaggattgaccatcaccgagattcgcgtgaccggcccggccgccggatacacacgcaaatgggctcggcggcggtagccaagataccaaacaaattcgcagaagcctcgctatggcgctcgtcgggttagacgagtaaaatcacatgcagtatggtcaaatggctagaagagccctttacgggcctcgtaagccatatcacctccgtgaatgaccttcatgacggaggttgaccctgtagtcacggaaggaagcctgttggcagacgaaaccagcaaagaggagcagctgaaggcggctgcggaacgcatcaacaatgcggaattgaccgaaggcgaacttgacgaatccatggcccccgagcattatgaggcctccgatctgagggtgctcgaaggacttgaggccgtgcgtatccgccccggtatgtacatcggttccaccggcccgcgcggtttgcaccacctggtctatgagatcgtcgacaactcggtcgacgaggcgctggccggatacgccagccatatcgagatcaccattctgccggacaacggcatccgtgtggtggacgatggtcgaggtatcccggtcgatgaggtgcccggcgagggcgtctctggtgtggagaccgtgatgaccaagctgcacgccggcggcaagttcggcggcggcggttatgcagtgtccggcggtctgcacggcgtgggcatctccgtggtcaacgcactctccacccgcgtggacatcgaagtgcgccgtcagggcttccactggacccagacgtacatcgaccagcaccccaccgcgcccttgaagcagggcgagccgatgaccgaaggcgagtccaccggtacgtctgtgactttctgggccgacccgaagatcttcgagaccaccatctacgacttcgagacgctgcgttcccgtttccagcagatggccttcctgaacaagggcctcaagatcagcctgaccgacgagcgtgagaatgaccaggccggcgacgaggtggccggcgacgccgcggacgagcccggcgcaaagcaccagaccgtcacctaccagtacctcaacggcatcaaggactatgtcgactacctggtcaaggtgcgcaaggccacgccggtggaagaggacgtcatcagcttcgaggccgaagacctgaagctcggcatctccgccgaactcgccatgcagtggaccaccgcctactccgaggccgtgcacaccttcgcgaacacgatttccaccaccgagggcggcactcacgaggagggcttccgcgccgcgctgacctcgctggtcaaccgttacgcgcgtgacaagggcatcctcaaggacaaggacgagaacctctccggcgacgacgtgcgtgaaggcctgaccgccgtgatctccgtcaagctcaccaacccgcagttcgaaggccagaccaagaccaagctcggcaactccgaggccaagaccttcgtgcagcgcgtgatgaccgacaagctcggcgactggttcgacgcccacccgaacgaggccaagaacatcatccagaaggccattgaggcctcccgcgcccgtctggccgccaagaaagcccgcgagaacacccgccgcaagtccatcttcgagtccgccggcatgcccgacaagctcaaggactgtcagtcgaacaacccggaagagtgcgagctgttcatcgtggagggtgattccgcaggcggctccgccatccagggccgcaacccgatcacgcaggccatcctgccgctgcgaggcaagatcctcaacaccgagcgcgccagcctggaccgcatgatgaagtccgacaccatcgaatcgctgatcaccgcggtcggcggcggctacggcgaggacttcgacatctccaaggtccgctaccacaaggtcatcatcatggccgatgccgatgtggatggtgcgcatatcgccaccctgaacctgacgctgttcttccgctacatgcgcccgatgatcaccgccggctacgtgtacgtggccatgccgccgctgtaccgcctgaagtggaccaagggcccgcacgacttcgtgtacaccgacgccgagcgcgaccgcgtgctcgccgaaggcaaggccaacggacgccagctgcccaagggcgaaggcatccagcgctacaagggtctgggcgagatgagctaccaggagctatgggagaccaccatggaccccgagcaccgcattctgaagcaggtgcacatcgaggacgccgccgcggccgacgagaccttctcgatgctgatgggcgatgaggtcgaaccccgccgcctcttcatccagcgcaacgccaagaacgtgcgttggatcgatgcgtaacggaatcctccaacctccctcgtcagagggaggtacacaacggacttagacaactaaaggaacaacagtggcagatgaaaacaacaccggcgacgagcagttcacgccggacggctcgatggagccgttgagcccgcaggaggcggacactaccgactacggcctgatggacaccggcgaacgcatccagcgcaaggacctgcagcaggagatgcgcgagtcctatctggcgtatgccctctccgtgatcgtcgagcgcgccctgccggacgtgcgcgacggtatgaagcccgtgcatcgccgcgtgatctacgcgatgtacgacggcggctaccgccccgatcgcggctacaacaagtgctcccgcgtggtcggcgacgtgatgggtaagtaccacccgcacggcgactccgccatctacgacactttggtgcgtatggcccagtcttggtcgatgcgcaacatgctcgtcgacggccagggcaacttcggctcccccggcgacgacccggccgccgccatgcgttacaccgaatgccgtatggccccgctggccatggaaatggtgcgcgacatcgacaaggacaccgtcgacttcgtgcccaactacgacggcaagacccaggagccgaccgtgctgccggcccgcttcccgaacctgctcgtcaacggctccgccggcatcgccgtcggcatggccaccaacatcccgccgcacaacatgcgcgaggtggcggacggcgtccactgggcgctcgaccacccggacgccagccgcgaggaactgctggaaaacctgatccgcatcatcaagggaccggacttccccaccggcgccaccatcctcggccacaagggcatcgaacaggcctaccgcaccggccgtggcctgatcaccatgcgtgccgtggtcaacactgaggagatcaacggccgtatgtgcctggtggtcaccgaactgccctaccaggtcaacccggaccgcctcgtcgtctccattcgtgaggccgtgcgcgacggcaagatccagggcatcgccgacatgcgcgacgagacctccggccgtaccggccagcgcctcgtgctcgtgctcaagcgcgacgccgtgccgaaggtggtcctgaacaacctgtacaagcactcccagctgcagcagaccttcggcgccaacatgctggcgctggtcgacggcgtgccgcgcacgctgagcctggacgccttcatccgccattgggtgaaccaccagctcgacgtgatcgcccgccgcaccgcgtacctgaagcgcgaggccgaagagcgcgaccacatcctgcagggctatctgaaggccctcgacatgctggacgaggtcatcgccctcatccgtgcctccgaagacaccgataccgcacgtacgggccttatggggctgctggacatcgaccaggtgcaggcggacgccatcctggccatgcagctgcgcacgctgacccgcatgaaccgcgacaagatcgtggccgagcatgaggaattgcagcgcaagatcgccgactacatcgacatcctcgccaagccggaacgccagcgcaagatcatcggcgacgagctcgacgagatcgtcgccaagtacggcgacgaccgccgcaccaagatcctgccgttctccggcgagatgaacgtcgaagacctgatcgccgaagagaacgtggtggtcaccgtgacccactccggcttcattaagcgcaccaaggccgacgaataccgctcccagcaccgcggcggcaagggcatcaagggcaccaagctgcgcgaggacgacgtggtggatcacttcttcctgacctccacgcacaactggctgctgttcttcacgaacaagggccgcgtgtaccgcatcaaggcctacgagctgcccgagggctcgcgcgactccaagggccagcacgtggccaacctgctgcagttcgcgcctgatgagtccatccagaccgtgctgtccatcccgaactacgaggtggccaagtatctggtgctcgccacccgttccggcaaggtcaagaagaccccgctggccgagtacgattccccgcgccagggcggcctgatcgccgtgcgcctcatggccgacgagaacggcgagaacgccgacgagctcatcggcgccgcgctgtgcaacgccgaggacgacatcatcctggtctccaaactcggcatgagcctcaagttccaggccgacgacgagcagctgcgcccgatgggccgccagaccgccggcgtgcagggcatgaagttccgtaacgacgacagcctgctggccatggatgtggtccctggcgactccgacaaggacctgttcgtggtcaccaacgagggcttcgccaagcgcaccgccatcagcgaataccgtctgcagggccgcaatggcctgggtatcaaggccgtgcaactggtcgagggccgtggtgctctggtcggcgcgctcgtggtgtccgaagacgatcaggttatggccatcatgaagtccggcaaggtgattcgctccaacgtggacgaagtcaagcgcaccgggcgcaacacccagggcgtgacctttgccaagcccgacaagggcgacacgattctctccatcgcccgtaacgaggagaaggacgagcccgaggatggcggcgatgccgcggcgaacggcaccgccgagaccgcacaatccggcgagaatgtgaacaacgcggacgaggcgtgagcagcgtcctgaaaagctggtagcctcgcatacagcagaggctaccgccaagcctgttaaggagaaacgatgagcgagaatctcgaagacaacgagccccggaccataccgccggcagtcggcaatacgcagaacgagcatgtcgagccgctgatcggtactgagcacgctccccgcgtggcacgctccgtgtccagcgatccggaagaatccgcgttgccttcttcaggtgccgccactcccgtgcgtccggcacctcgccgtagcgcccccagggctcgccgcatgagcttgtcgctgacccgcgtggatgcttggtccgtggccaaggtgacgttcatgctgtccatcgccgtggcgattattcaggtcgttgcctccgcgatcgtatgggtgctgcttgatgtggtcggtgtattcagccagattacgcagattgtgtcttccaccggtcttgatgcaggcggtttcgatctcaagaacgtgttgtcccttaccaccgtggtctccggcgtcaccatcttctcgattgtcgaagtggtgatcttcactctgctggccaccattgcggcactgatctacaacgtggtcagctctctggtcggcggtgtgcacgttacgctcggcgacgactgatatagctatactgacggaactctcctcagtgaaccgcaccccggttgttggactgaagtaattcagattcgatgatcggaggtgcggtttcttatgtgtggggatcgcaggcgtcgttgctgggccgagacttgggactccggcgacgctgggggtggcaggcgtcggtgttgggacagattttgtatctctgacgacgctgtggagggcttaccgtcgtcagcggtacagatcttggagttctgccgacgctgagggtgcgttctgtgtcgtatgcgtccaattcttggccctctgccgacgctgggcacagcaagcgtcgttgctgggccaagttttggactgccgccgacgcagagaatgcacacagtggtgttggtctgccagcgtgtggcagcttggcgccgctggggggggagtcatgagtcccattccaactcccccttattgaccacttaggggtgcatcccaacacatggggtgcaccccttttttcttgttgtgctacggggttccagtcgcatttttttcggtgatattttgaacgcgaagacaggctgggaaatgcccgatagtcgtgttcccctcagcaggtgaagccctgctttcaggctgcaaaaccgactcgggtgttccgaaagcggctttcgttgttgtacatcgatacataagagagaacacccatgaaaaacaccattattcgtgctgccggtgtgctgttggctgcaagcatgatatttggcggtgcggcagccactgcatcggccgcggaagcaacgtcgccgagcaccggcaccaccagcagcacgcaagccgcggaatccatcaatcgcgaatgggtgctgaatcctgcgaacaacactgagctggcggctctcggcactatacaaggcggatcccagacgttcgacgggctgaccatcgatgccactgcaaacggtgccaagtttgcgccgcgcgccaatgacacccagatcaacgccggaaccatcatcagcatcccggtgccagcccacaccaatacagccaccatcacccttgcgttgtccggcggcaccaccactattaccgcggatgccggtgaagtgagcagcgacaacacagttatcgccttgcctgctgcggagtcggctcgtacggtaaacgtcaccttcactgcccagacctatctcaacggcatcgcccttgccgaacagcagccggaacccgagttccccggtacgcccacggtcgcggccaaagacacgaactgggacttcacggaaaccggcatcgatcgaccggccgtgcagggcctaccgacaactaccaaggcgtcgccatcgacgctcgggcgcaaggcgccaagttcaacccgcgtactaccgcggcaagcggcggcagcgatactcaggtgaacgctggaaccatcctgtacattccggtcgcacaggccgagggcggcgctacagtcaccgtgaagggccagctgtacggtcctacgctcaagctcgacggtacggacatcaccaccggcactgctgtaaccatcgcaaccgacagcacgcgctacgtgccgctctccgttgaaggcacgggcagcctgtacctgaccggcatcgccatcgactacgcggccggctcccccgccgccaccagccacacggtcaccgtgggcccgaacggccagtaccggaccattcaagccgctctggatgctaacgactcttccgaaaccgaccgactagtgctgaagatcactccgggcgactatcgcgagaagatcaccgtgaccaagccgggcgtcaccttcgccaacgccgacgtgaccgccaagcgcgcggtgacgattcgcgccagctactattcgtccaacacattcgatgccgacggcaagtttgtgccgcaggatgaattcgaccttggcaccaacaagtgcgccaccgtgaccattggcgcgggtgccacaggtttctccgcctacggcatcaccttccagaacgattacaacgtggtggatcacacggcggcgggcgagcagacgccggccgtggcgctgaacacccaggcagacaaggtgtacctgaagaacagccgcatcatcggccgtcaggacactctgtacgtgcagggcgccggcaaccgcgtgtacgtggacggcggctacatcgaaggcacggttgatttcgtgttcggcgacgccaacgcctacttcgccggcaccgagctgcacatggccgcgttcgccggcaagaacaacggctacttcaccgccgccaacaccaagaagtccggcgtgggcctggtgtttgaccgctgcaacttgaccgttgccgcagcatatgacgacgatgccaagctttcgctgggccgcccgtggcagacgttcgcgcagtacacgcaggtgcgtaagggcgacggcagcagctatgtgaccggcgtggatttgggtacgaagaactcggcgtatacggacacttcctcggccgtgacctacctcgacagcacgatgtccagcaagatcaccaagaatcgttggaatgtgtggaccagcaagaaccagagcggcaaaagcgtggacgtgaccttccacgatgatgtgcgattcgcggaatacgccagccacgatgaaaccggcgcgctgcttgatccggctgattataagaacgtcgtgctcggctcgatgtctgctttggatgaggctcaggtgcaggcgaagcgtgctgaattgctcgcggcactgggcttcggctcggcggctggtcagtgggttgtgccggatggcgcgtggccattcgcttacgacccgaactactcgaccggcactgatgtgcagccgactcagccgggcggcaacgcctcgcctaacgcggattcggcggccaaggccgacaccatgccggaaaccggctcggccatcattgcggtggttgtagtcgccgtgccgctgctcgttgctggcttggcgctggtagcagtgcgccgcaatcgccagcagtgattgaaagcgttgctgcgaaccggacctggtgaccttgtagacggggggctatctccgttgaaagaggtacattgatggctttgcagaaagccaactgctttcaaaggggtacctgaaccacgaaacctcgagtataagcgttgcaatgacggcgtttatactcggggtttcccatattcagtacccctctgaatgcagttagcttggatcgatgatcatatccaagaattcactcgtatagtggtgcgtaatgcttacgtatttgggatagcacttgttgctcgttgtacatatagcaatgcccttgcctcctcacggggaagcaagggcattacgctactgcttagtactgcttagtattgctcagcactgctcagcgattgctcagcggcaagcgtcacagcacgccctgggcaaccatggcgttggcgaccttgacgaagcctgcggcgttggcaccgagcatcaggtcaccctcgtgaccgtattccttggcggcggccagggagttggcgacgatttcttccatgatggacttgagcttggcgtcgacctcttcgaaggtccaagacaggcggtagctgttctggctcatctccaggccggagacggccacgccaccggcgttggcagccttggccgggccgtacagcacgccgttcttctggtagacctcgatggcctccggggtggacggcatgttcgcaccctcgacgaccacggtcacgccgttgtccacgagcttctgtgcggattcgccatcaacctcgttctgggtggcgcacggcagagcgatgtcgcccttgacggtccacacgcccttgctgccctcgtggtactcggagcccggaacgcgctcggcgtattccttgatgcggccgcgctcgacttccttgatctgcttgacgacctcgacgttgatgccgttcgggtcgtagatgtagccgttggagtcggagacggtgacgaccttggcgcccaactgctcagccttctgagcggcgtaggtggccacgttgccggagccggagatcacgacggtcttgccctcgaaggagtcgttgcgcagcacgcgcagggcttcctgggtgtagtagcacacgccgtaaccggtggcctcggtgcgggtcagggaaccgccgaattccagacccttaccggtcaggacgccggagtactcgtcgcggatgcgcttgtactggccgaacaggtagccgatctcacgaccaccgacgttgatgtcgccggcgggaacgtcggtgaactggccgatgtggcggctcagctcagtcatgaaggcctggcagaagcgcatgacctcagcgtcggacttgcccttcgggttgaagtcggaaccgcccttgccgccgcccatcggcagcgtggtcagggagttcttgagaatctgctcgaagccaaggaacttgacgacggactcggtcacggtcgggtggaagcgtagtccgcccttgtacgggccaatggcggagttgaactggatacggtagccgcggttcacctgaaccttgccctcgtcgtcaacccaggccacgcggaacttgatggtgcgctccggctcgacgatgcgctccagtacaccggccttctcgtactccgggtgcttctcgacaaccggctgcagggtctcgaagacctcgcgaacggcttgcaggaactccggctgatcgccgtcacgggcaacgacctggtcgtagacacgcttgatgtactcgtcagtgagcatgattctcctcgatttgctagggaattaagacggttttattctatgcgcgcaggcccttgctgcatagagtctcgctcggataacgggaaagctatcggcgtggttatggggtggttcaagtttccgtttgttagatttttcggcgattgctggatgtctgtctgtgcgtgaatcgggtcgaaatggaagctgcatcacaccgaaggtgcgttcatatagtggacataaaggtggacttgggtgatgtcggatgtgcccgttgggaatcgtgcgccgtaggggccgaggtcttcggcgcgcaggttaccgggttcgcggtcagtgcgcgaagtaggtctgcagaatcatcgtggtctcggtgcttaccggcaccgtgcggtggatgagattgagcaattcctcaagggcggtgggggaggccacgcgtaccaccagtacgaagctgggggcgccggccaccgaatagcaggagacgatgccgtcgatattgttcagcttgtccggaatcgaggattcggctgagtagtcgagcggggtcacgttgacgaacgcgctgatgggcaagccgcgctgctcttggtcgatgatggccttgtatcccttgatgatgccgcgcttctccagcttctgcacgcgcgactgggcggcggagacggacagtccggtcgcctgggccagttgcgcgagcgtggcgcggccgtcggcctccagcatggtgaggatgcgctggtcggtctcgtcaatcgcggtcatggtgtcttctccgttcgttgtgctctgtgttcactgtacctgttgccggaatgcgatggctttccgattttgcctggtaatttcagtagttcttcctgtgttttctgttgtgtggtggaatgtttatgcctaaagtcctaattgaatgtaataattccttctaaaataagagaacgacgaaataattccattgaggagggatgatatgcagaagttttccaacatgcctctgtccgaagttgcatctgctgctgtgcctgctgccagacgggttgctgtgccgaccgccaagcccgcgagcttgtccgccgaagccctgaatatcccgcgctccggcatccgagacgtattcgaccgtgtagagcgcgtgcctgacgcgatttcactgaccgtgggggagcccagcgccacggccgcgccgcatatcgtggcggccgcttgcgaggccgcacaggctggccgcactcggtacaccaacgtgctcggcgtccccgaataccgcaaggccgtggccgattactccgcccgtgtgaagggactcacttatgatcccgaaaccgagattcaagccgttgacggtgccacgattggcctgtttctggcgctgaaagccgtggtaggcaccggcgatgaagtgattattccctcgccgttcttcacttcctatgacgccgaagtgatgctgtgcggcggccgcccggtcaccgtggcgctgcgtccggagcacggcatgcgcgtgaacgcggcggacatcgaagcggcgatcaccccgcgcacccgcgccgtaatcatcaactcacccggcaatccgaccggcgcggtaacttctgccgctgaactggcgcgtattgccgaagtatgcaagcagcacaatatttgggccatctccgacgaggtttaccatccgttcgtgtttggggaaacgttcggggaaacgcttgggggagaggcagccgtggcaccatcgattgccgcggtgccgggcatgaaagaccgcaccattgtggtggaaagcctgtcgaaaacctacgcgatgaccggctggcgcatcggctacctgctggcacccgaagcggtcatcgaacagaccggtaaaatcgccgaactcatgcactcctcggtgaactccttggcgcaatacgcaggcgtggcagcactggccggtccgcaggatcatgtggccgccatgcgcgaggaataccgcgccaagcgccagatcgtgctggacggtctggccggatgcccggtattgcgcttgattgaaccgcaaggtgcgttctacgcctttgtggacgtacgcctgactggccttgactccggtgaattcgcagaccgtctgctggacgaagagcacgtggccgtggtccccggcgaggccttcggcgaggaggggcgcggcttcgtgcgcctctcctacgccggagatgccggcgagctgcgtgagggcgtcgcccgtctgcgcgcattcgccgaacgggtatggaaccccatcaccggacaccacaccgccacttatcaccccatggaggtgttggcctgaggcttaaagcgaggctaggccgccaattcagactcgtcggcgcgagcgatggcctgctcgtaatccttggtgcctttgaacacttccttggtccacgggttgatgccctgcttcttggcgcgtagcaggatgtagccaagtgccagcacattggccgccaacgcgattaacgagactgcaaggttcacattcggattgttcacggactgggtggagaacatggaatagtcctggaacatcgggaacacctgcgcgaacatgcaccagatggccagcgtgttggcgcggttctgaatccaaccgcccttgttccagaagaagttggccacggtgggtgccagcagcagcgccaggccgcaataccaggcgtgggtgggcaggcagttgtaggtgtagcagaagttccacaggtcgtaggccacgatgaacacccaggtcatgtccggccagagcatgtcgtccttcttcttggaggcgtagatgccgaaccagccggtcatgcagaagatgttgagcaggccggccacgccgttgaagacgttgtgccagccaccgtacagggtcacgccttcggtggagatccacgtggtgccccagccgcggatggcggattcgaagtcggacactacggcaatgaggatgttgatggccacgatcacgaacgggaagcacttgaaccagtgcgatttgccgatggatccccacttgtatttgagggccatgaaaccgatgcagccgatggtggccgcgtacagcttggcatagtggaaccagctggtcatgtgtacgtaggtcgggttgttgagggcccagtcggcacccatggcggcggccgtgtagatggtgatgaagtagacggtcagcacggccggtatgacgaggaaggcgataacgccaccggttttggtgcggcgggccagttcgttggcgccgataagacagcagaagacgagtatccatccgatccattggtagatggcgttgtcgccgtagacctgaaacagcataagcggtcctttccgtgtgtgcgctgtgcgcctcgcagtcctccattgggttgctgagacgcctatagacgccgctatgttgacgcagcgtcaatttctctcacggcacagtctagcctcaagttgacatcgcgtcaaaacaaccgcattaaggctgccgcgtttcgtatcgttacgcgtaggggctggctgaggcgtaatgctgaagagtaacattgaagcaatggcaatcaagccgatttgaggaagagaagcacacgatggcgtactgcggccactgcggaaatagagttgataggccggcacgattttgcccggcatgtggagcgtctgtagacagcgcaccagttgcggcggcaccagtaccggccgcatcgccagccgtatcgcctgcgtcgataccggcacctgctgtgccggcgtctgcggtaccaccatcgataccagccgcgccggttgccccatcggtttacgccgcgtccgctgccccacagccggcaccaaccgttcccctgccggctttgccgattcccgctcctgccgcatatcaggcgactgatgcaaccgccgtcctggcaccgcagcgcaaatccagcaagaagctgatcgccgctctctgcgcattgcttgcgacgattctggtggcggccttggcgttcatcatccccaacttcaccgccgtcaaagcgatgctgggcttccggcccaccaatccgctggtcgtcaccttcgacgcgatcaactcgctgtccactctgcgcagcaccaaatacgaactcagaacccacagcagcactgacgactcccttgacgcgcggatgtctggcatgtattcgctggggcaaaaccaccaatgactcctccgcgtctgtgaccatcaagacagatgaacaggcaacaaccctcgcttggcacaaaggcgcattcgccgggaaaaacgtttggtatgatgacgacccctactacatctactacccggccgaccaatatgaagatgacttaaggaacggcgttggtagtgatgtggcggacttgatattgaacgtcaaggatgcgttggtcaagaacggtgcttgggacatcaccggcgcggagcgaacgttctacgatcagctggacaagatgaacgacgatgggtactcgaacgacatcgaccgggccaagggcacgaaaacgtctgccgaggtgaaggccgaggccagcaaattcatccaacaatatctcggcgtggagctggaagataagaatgtgcgcagccagctgttcccgaatacatcgtctgccaagtctgccggcaacacgcagctctcgtatcaaatcgatgtcaaggcattggcccagcactttgtgaattactggatcagccatgaagcgcagtatccgcatctgaaatcatgggtgattcagcagatcgaggataccggtgtgggcgatgctgaaggcgagtaccgtcaggcgctcgacaatgtgcgcaactgggacttcggcacggatgaagagccggatatgccgactatcaccgtggatctgaactacggcaggaagcgtctgatgagctcgattgccgtaagcgtgtccggcaaggacgaatacggcgactcctacaaaggttcgctgtcgttgacgctcagccagcagaacgcggtgtctgtggacgaccccgatttgactgatacggtgagcaaagccaaggacaacaacgagctggatctgtcttgagcagaatcagaatgtgcggaacgccgtgaacagatcatcgacgtgacgtcgcatgtgattcacagaacgggttttggggcttttccgttcgtcaggtagccgaagcatgcggattgaccgagccggcggtcatataccatttcaagaacaaagtcggcttgctgattgccgtgctggagcatcgtgatcgggaagacatggctacgtttgcccattctcttggcgttgaacctgaggatatgtggagcggcaacgcgcagttcggcattcgtgatatctgtgctgcccttatggagcgcaatgcggctcagccagagatggtgcggttgtatataccgtgctacaaggcgaatcgttgaacgagcatcatcctgcctatgagtattaccaaaaacgagaacatcgcgtgatggacaccttaacccgagcagtcgagcgtgacggtttggcagatcctcgtcgcgaggcgcggactgctttgtcgatgatgaacggcattcgggtccgtttggctcagggatcgggcatcggtcgatttagtggccgattggaatgcctatgccgacttccggtggcctcgacagtcgtgaggcaataagacttttctcgtgagatacgctatcggcgtgtcgtcatctttttgttgcaatacgcagaaaatgcaagaacaaaaacccttggaatcggactgattccaagggttttgttgtgtctgtggagctagccgggttcgaaccggcgaccctctgcttgcaaagcagatgcgctaccagctgcgctatagccccgtgagaaaaaaagagcggctcgcggccgcttcatttttcctgtgggcccgggaggacttgaacctccgacctcatccttatcagggatgcgctctaaccagctgagctacgggcccgatccatacgcttcaaaagcgcacaagtgattacaataccattgaacggcggtatgtcaataacggcgtgtcgcgattgtcgcttgcgccatgattgccggcgcagcggagcatgacgagtgcgatgaggctgttcgcgtggtggaagccgtaggccatgcggatggtgaccttgatcctgttgtcggacgcctcgagcctggcgttggagtagcccagctcgatggtcctgaggatgtcgggccacgacggcggatcttccgggatggcttgccgctctcgtacaactgcacgatctgccgtttgaacgcctcgtcgtagtggcggggatgtttcgggtcggccatcgtcggcctccaatctcatgtcattcgtccctcatcggactgtctaatacgttgtagccaatccacggcgtcacatcgtcaggctgtccgggtcgaggaggaaatcgtagacgctcatcgtgaggatgccgtgctcgtcgcggacgggtttgaccacgtcgcgtacgaggacgatcttctggaagctgtcatcgatctcgagcagcgaggcttctcctgcgcgaccttctccggtgtgggcagttggtacgcggattggtcagggcgccgatggaggaggccagcacgtcgaccaggtcgtcgagctcctgcgacctgcgcagcccgttgcgcatgcgcagcagcccgttgatcaccccgtacagacggggcggctcctcgccgcgcgtacgaacgcagttcatgaagaattacgagtgattcgtcgaagtcttcggcgttacggccgccgcctgagccagggcggcggccacttgttcgttgacggctccctgctgtgcgatggtgacgcggatgcctcgactggcatgcgcgtccacgcccgcaccggcccccgcgtcggctccggtggcgtcggcgctgatacgcaggctcggcaggaacggcttgccggcggccacacggatgccctgttcggccagcagtcgcagcgccgccggctcgtcgcgcaccggaatccacagattcagtccgtcaccggtatgcacgtccaaactttgacgcagcagcagcgcgtgcatcgtcttttgccgggtggcgtagatatgccgggcgttggtcaccgtgtggaacgcctctttgtcggccagcatttcatacagaatctcttgcaggaaccggctcacccatcccgatcccaagcgtcgttgggtgataatcgcctccacggcatcctccggcccagacagcgcagccaagcgcagatccggcccgtgcgacttcgaaaaactgcggatatgcaccacgtgttgcggcaatcgttgcgccaacgatgtcgcatacgcattggccacatcgccactgtgatcgtcttccacaatcagcggcataccaacgccattcgggtagtgcgcgagcagcacgtccgccaaagcgtcgatgcgttgcgggctgaagctggccccggtagggttctgggcgcgcggctgcagcaggatcatactgacctgatggccgccgtgcggcaccgccagacgctgcgattccagcatggtcagcgcacggtcgagtgcgtcgggcagcataccgaacccgtccatcggcacgccgaacgccatcgcgccatgtgcctcgatcatgtcgagaatcagcggatattccggtgcctcggtaatcacaaaatcacccggctgaacaaaagcgttcatggtgtgcgccaaaccgtcgcccgcgccggatgccatagtcatcgcctccggctcatacggccagttgcgtcgcaaaatctgttccagcatgggcaggatggtcggcccgtcgtatgaattgacgaatgccttgtgcgtgccgagcttgccgagaaacgggcggatgtccggcagcagcgaaaggtccggcgtgcccttggacaggtcgataatcggtcggtccggcgcggtggccggggcttcggccagcaagtcgccggcatcgtagcgatgcgtgcgcgactgccgcagtacgaatgttccggcgcgcccgcgggagcgcagtatgccggacctggcgagggcatggtaggcactggagacggtggccggactggtgcgtagcagtcgggcgagatcgcgtacggtgggcatgcgctggccttccgcaagtatgccggaggaggtcagcgaggtgaccgattcgacgatgcgttgcggggtggccgtcgcctcggtggtgaggatgagtgaggataactggccggcatcaacggccaggtcgtcggtggaacgcaggggagcggccgtaatgcttggctcatcgttgtagccgacggcatgtgcggttgtatgcggttgatggcgatggcgtatccatgatctgcctcccggatcttggcggcgagcgtgatgagcgcgcgtctgcgtgaatgttgccgattgccgccggctgatgatcgatggcggttgccggcttgttgctggctgcttgactgccgatagtaacggtcactgtggcaacggtagtcaaatgttagcgccgcattgtgcaatgagtatgtttttgaataacataaacattacataatctggatacaattattgttcttgttcctatgtttcaaaatgatttcgtattcgccactactgtaacattattaaatgttcgagtttgacgcgaaatgttcaactctcataatgacattcacagcgcgttgctgccctgacccgatccacgggagacggcatcgggcacttcgagaaaatatcgaggaaaggacacatcatggggcatgatctttcgcaggatgcggaaatctgggacgacgcttacaagctggaccgcgcacacgtattccattcgtggcacgcacagcgcaacctggatcccactgaagtggtaaccggttacggcgtgtggctgaagtacggcgacggccgtgaaatgctcgacttcaccagccagcaggtcaacgtcaacatcggctaccagcacccgaaggtgatcgagggcatcaagaagcaagcggaactcctgtgcaccgtcggacctgactacgcgaacctagcccgtggccgcgccgcctccctggtggcccgccgcgctccggaaggcttcgacaaggtgttcttcaccaacgctggcgccgacgccaatgaaaacgcgatgcgcgccgcccgcctgttcactggccgcgacaagattctgtcttcctaccgctgctaccacggcaacaccggtgcggccatcagcgccaccggtgactggcgccgtaagcccaacgactactctcgcggccacgtgcacttcttcaccccgtacctgtatcgctccgagttctccgcaaccacccaggaagaggagtgcgagcgtgcgctggctcacctcgagcacgtgatccagttcgagggcccggacaccatcgccgccgtgctgctcgaatccgtgccgggcaccgcaggcatcatcattccgcccaaggactacttcaagggcgtgcgcgagatcaccaagaagtacagcatcctgatgatcaccgacgaggtcatggccggcttcggccgcaccggcttctggttcgcactcgacgactacgactacacgccggacatcatctccttcgccaagggctgcaactccggttacgtgcccgccggcggcgtgattatgagcgacccggtggcccaccgcttcgacgacatcgtcttccccggcggcctgacctactccggtcacccgctggccatgggcgccatcgtggccacccaggaagccatggaagaggagcacatcgtcgacaacgcctacaccatcggcaaggacgtgctcggcccgcagctcaccgctctgtacgacaagcacccgaagatcggcgaggttcgcggcaagggcgtgttctgggccgtggaaatggttgccgaccgcaccaccaaggagccgctggacgacgccacgatgaagcagatcgtggccgaaggcgacaagcgcggcctgattctcggcgtgcacaacaaccgcatccacgtcactcctccttgcgtcatctccgccgacgaggcgacccagggcgtcgagatcctcgaccaggtgctgaccgcggccggttgctgattgggtgactcaatggctcggtgacggtttgtagccgttgccgacagcaccgttcattgctgatggcggcccgttcggaacgttaggttccgggcgggccgccatcgttgtccgccgttgtgcgagaatgacttgcgtgccttatcgccgtcgtcaatccaccgctccgaagtccggtgcgccgaaatccgttcggtccgctgccgccgggcagtcgttggatattgatggcatccatctgcacctgacgcgcaaacccatcaaaaacctgtatctgcgcatcaaaccgccgagcggccgcgtcgaaatctccgcaccgatgcggatgagcgagagtcgcattgcggatttcgtcaaagagcgacattcgtggattctcgcccagcagcagcgcatggctgaggcgcaacggcgctccatcatggcattgaacgagggtgccggcttcgagaacggaggtcgtggtgtagctggtgccagcggccatgatggaggcgttgccggtcgtccgaaaaccggtgatatcagtcgtccgggaattggtgacgccgggccaggccaagccggtacgaatgtccaaccgtattttgaccgctcccaaatctggaccgacgaacgcaaacgacaagcggcggccgcgatcaacgccgcgttgccacagctgctggccaagtgggggccggtcgtcggccggcagcccacgcatatcacgctacgggtcatgacctcgcgctggggatcgtgtacaccgcgaaccggccgcatccgtctgaaccttcaattgggactgatggaaccgcaattcctggaatacgtcttggtccatgagatgacgcatttgtgggaaagcggccacggtgccggattccagcgccgcatgaccgcctacctacccggctggaagacgctgcgccgcgacctcaaccgccgcgtggtgctgtgacgatgacgggtcaggcttcagtgccggcgatgtggctgatggcctgatcggattcgttcgcatggtccgaatgcgccaccatctcgatggccgccggacacccgctcaccgacgaagaccgctggccttggctcgacaccatcgccgcgtggatcgacgagcgcgtggccgccggcgatcccgccgtggtcacctgctcggcgttgaagaagatctaccgcgacaagctgcgccgtcaaggcgtggtgttcgtctacatgcagggcacattcgacgaggtgatggaacgcctttcccaccgccaaggccacttcatgaagccgagcatgctgcaatcccagtccgacattctcgaagagccgggcgatgacgaaattcacgtcaacgtacacatcggccaggccgatcccgaacacgaggccatggccgtggccggtgccctcggcctgtgagccatctctcggctccccttagtctcacttcgccacacgtgcggcgcatcgacgaactcgaacggcgcatcagcgaacttcagctggagctgaagcagtgtgaaggccagcaagggcgaaccggatcggtccaaacgggctactcaggccgaccagcccagccagtccgttcagaccgacctaactgatcagagcgggccctctgaccagtccgaaccatctgaccgacatgtacttgttgactaagtgtgcggcccgtcattcgttatggaacatgccggccatgtatacaggcaggtaggttacattcccttcgactgagacgttgcacgggccaagcacatagcctgtattgagatggtattcagggtgggcgagcacgttgtccattgcgcgatggcgtttgtaggatttgccggacttcacctcaatcggcagcacgtgatcgttgcggtcttggatgaggaaatcgagctcgccaagcttcttactgttgtagtagtacaggtcaaatccgtgagcgcgtagctcttgggccaccgcattttcatagattgaaccgtagttgatatcagggttgccgtcgagtacgtcgagcgcggttttcttgagaaacgagccggtaagcagacccacgtcgttgtaaaagagtttgaagaggttacgttccttgctcatctccaacggtgtgcacggttcgtccacgttgtacgcggcgacggctacatccgcattgaccagccaatcgaaatcggaagcaaccgattggaatctcatgttcttttcgattttggcgaaggtaaagcgcttgtttgggttatttaactcgctgggcaccaaatcgtagatagcgcggatatgcagccggtcttctttgcgcgcgtattggctgatatcgcggcgatattcacgctttatgttctcttgtatagtgcgcacgtccgcaacgctgccgtttgccacgaacgagtcgactgcggcaggcatgccgccgatgaccagatatttggagtatagctccatgagcctttgatgaatgaactcatccacttcctggtgcttggcaaagcattcggcaagcatatcgaatacgtcgttgccgatatgctgcgaccagcagaactcttggaaatccagtggatacatatccagctcggtcaggtacccgaccggtaccgagcgtatatcttcgagctcgactccaagtagcgagccggaaagcgcgtaatcgaaccgaccatcatctacaaggaacttaattgcggtgaccatttccttgcaacgctggacctcgtcaaagaaaatcagggttttgccgggtactaatggcgtatttacggccagttccagcctcatcagtaggtttttggcatcgcggggccgatcgaataatgcaacgaggtcagggttctcgatgaaattgagctcggcgatatggtcgtaatgctgttgggcaaagtgcctgatgatataggttttgccaatctgacgggctccggtgaccagcagtgcagtgcgtttcggcgcggatctccaagcttccagctgtgtctcgatttttcttcgcagcatgagaatctccagtcatttgtaggccttgcatctatgctgggcacgttttccaactgtttatagcgcatattttacacttttccaaccataagaatgcggttttggctacgttttccaacctcaaaatggggagttttatacacttttccaacttatgtatgtggagactctctatttcacgtgagacgaaagtggctcccctctttgaggggagccacggaatactgcttttacttatgccaggtgagagcgcatgaaccactggaacttttcgagttcctgcacgtggtcctggatgatgttggagctgatcacatccagctcgtccagctcggcgatggccttgcggtcgtcggcgatgaaggcgtcatagtactcgatcagcgccttgagatactcctcggtgcccacgcggccctcggcgtcgaacgacttccacgtgcggttgcgcacgatggcgtccgcgcggccgtccggggtgccgcccagagtggcgatgcgctcggcggtctcgtcggcctgagccagcacggcctcgacctcggggtcaagcatctcgtgaacggcgatgaagttcgggccggtcacgttccagtgtgcgtgcttcaggaccagagcggcctcctgctcctggctcagtcggttctgtaggatggcgatggccttctcactggccgcttcatcaaggcccggcacaacaaacgcaagtgtcataatgttccttctttcagtaggtggaacctgtccatataattctacgatttttggttatgccccgggccgaacgaataggtggtgaatatcacgtggctagttggcatcgtcgctttgtgattcggctggcagtggcgcatggtccggggcaccggctttgcggacttcgatggtttcgatgcggcggccatccaccttggtgacgaccatgttgtagccgtcgtcggaatgcagcacgtcgcccaccgcacccatcttgccggtcttggacaggaagtagccggcgaccgtctcgtacgggccgtcctccaattcgatgccggtcagatcggcgaagtcctcaatggtcatgctggcctcgatcgtggccacaccattgacgaacgcggtgcgggtggtgcgttcgccgcccttctcgctgggcagatcgtactcatcgcgaatatcgcccacaagttcctcggtcatatcctcaagcgtcacgatgccgtccgtgccgccgtactcgtcgatgaccacggccagatggatgccgcgcttacgcagcagttccaggctcggcagcagcttggaggtgccgggcagggagatgccttcgcgcaccacatcgcgcacgatcttggcgttcggatcgcgcacgtccagcagatcgcgcacatgcacgaagccgatcacgtcgtcgaaatccttgccggtcaccgggtaacgggagtacggctggtcgcgtacgaacgcggcggcctcggccaagggctggtcgccctcgatgaagaccacgtcggcacgcgggcgcatcacctcggcgacgatggtttcggacgcgtcgaacacatcgtccagaatcgtgcgttcgtccttggaaaggttggtgttggagctgaccagcacgcgcagctcgtcgtcggacacctcggactcggtctgctgcgggtcgaagccgagcaggcggacgatgccgttcgtgttcttgccgatgagccagatgatcgggcggcagacggcggcgaaggcgtcgatggcgggcaccacggcgcgcgcgatctgctcggtgcgctgcatggcgatgcgcttgggcaccatctcggagatcacgatggagcagtaggagatgatgagggtcaggatgatgttcaccaggccgccggcgatgccggggtgcacgccccagctttcgaccaccggaatcaggtagggggcgatggaggaggcaccgaacgaggcggacaggaagccggagagcgtcacgccgatttgcacggtggagaggaaggtgttcgggtcacgtgcgattttggcgactttggcgccgcgagcgtcctcctgctccatttgctcgatctgcgagccgcgcagagagaccaatgccaactcggtgccggagaacacggaaccgataacgagaaatacaaaaatcaggaggatgttcaaaccaagtgacatggcttcaactctaggggagcggcacgtcaaattggggtgtgctggctgggcagtaagaaactcggcaaagggaagggcactcttatcattaccgcggccgacgtgtcgaccggtgtttccgatgcgttgctcgccttcgacgatgccgtatgcgctccagcgctggacggcattactagtgcagagaggctgtttctcgcggctatggccaaggattcgccaaatcccacgcaggttggcgatgttgcggatcgcacgctcagaagctcagcacttctactttgccggaatcgagctgatagcgggcgccgacgatcatgagcttgtcagcggcgagggcctgctggatgacaggagactgctccaccaaagtttcaataatgtgggccacatgcacgcgctcgatgtcttcatgcgcgtcgagctcggcttcgcgcgcctgccagacggacatgccggcctggcgcagaataatcgattcggcggcggcgatgtgctcgtcgaggtcgtccatcgcatccgcggcctccagtgagccgtcggcttcggaagtgatggtgtgcatcaggtcgtccagctcctgctcggcggcctcgattgcgccgcagtgctcgtgaccgagcacacagatcaggctgacgtgcagtttcttgaccgcgtactccagcgaggcgataaccgcgctatcgatgagttgcccggcggtgcgcacggtgaacaggtcgcccaggccctgatcaaaaatgatttccggaggtacgcgcgagtccgagcaggagagcaccgcggcatccgggttctggccatcaagcaacgtttgacgggtctcctgatcctgccatggatggtcgggcttgccctcggcaaagcgccggttgccttgcagcatgcgactccacgttgcgtttgcggtcgattcctgttcaaagtctgactgagccatgaaacctccattatcagcgggctgctgattgccatattagcgagtattcgcgcatagtcgtgattggggcaacggccatttgggcacaagggttgcgggtggtgtgataaggctcatacgttacacccgcgcgagccgtggctcaccacattacgataggtggtggtaaacgcttgaagattaacaattcccgaaaggaccgatgatgactcttctgcagcatgaactgaccgatttcaaggtgaacgcattccagaacaatgagttccacgaagtgaccaaggacgatgtgctcggccactggtccctgttcttcttctacccggccgacttcaccttcgtgtgccccaccgagcttgaagacctggccgagaactacgccaagttcaaggaaatcggttgcgagatctactccgtctcctgcgacacccacttcgtgcacaaggcttggcacgacgccaacgagaagatcgccaagatcgagtacccgatgcttgccgacccgaccgccctgctggccaaggatctcgacacctacaacgaggccgatggcgtggctgagcgtggcgacttcatcgtgagcccggagggcaaggtcgtggcctacgaggtcatctcctccaacgtgggccgcaacgccgaggagctgctgcgccgcgtgcaggcctcccagttcgtctacgagcacggcgaccaggtctgccccgccaactggacccctggcgaggaaaccatcgagcccagcctcgacctcgtcggccagctgtgatcgacactgaataggcggtaaccttggctcccctctctgaggggagctgtcgctgaaagcgactgggggagtgctcgcgagagctagcctgatccgatatgctcccctcagtctcactacgacagctcccctcagagaggggagccagtgtatgtaagggagttttcatgactcagaccaacaatctctatgacgtcgtcgtcattggtggcgggcctgctggcctgacggccggcctgtacctggcccgcgctcgctaccgcgtgctgattctcgaaaaggacgatttcggcggccagatcaccatcaccaacgaagtcgtcaactatccgggcgtgggccgcaccacgggccgcgcactcacccagaccatgcgccagcaggctcaggacttcggtgccgaattcctctccgccgaagccaccggtctcgacgtggatggtgacatcaaaaccgtgcacacctcacgcggcgacctcaagaccttcggcatcctcatcgccaccggcgccagcccgcgcaagctgggtttcgagggcgaggccgagtacgccggccgcggcgtggcctactgcgccacctgcgacggcgagttcttcaccggcaaggaagtactggtggtcggcggcggattcgccgcagccgaggaatccgtgttcctgaccaaatacgcctccaaagtcaccgtgctcgtgcgcgaaccggacttcacctgcgatgccgcagtggccgccgaagccaagaacaacccgaagatcgacgtgcgttatcaggttgagctgaagggcgtcaccgccggccaaggaggcctgcgagaagcctcaatcctgaaccttgccaccggccagaccgaaacgtggaagcccgccgacgccggcaccttcggcgtcttcgtgttcgccggctatgtgcccgccaccgatttggtgcgcggcgtggtggagctcgacgaccacggttacgtggtcacgcacgactacctcagaacctcggtgccgggcgtgtacgcggccggcgatctgcgcgtcaagaacctgcgccaagtggtcaccgccaccgccgacggtgcgattgccgccgtggaactggagcgttacgccaagcagatgagcgagaaaaccggcttggtgccgccgcgtcccactgcttccgcttatgaggagtccgaggccaaggccgcctccgccgcctcggccgctggcacgacgcccgccccggctcccgccaaacgcagcgccgatgccgcagccgcagccagcgccgccaagaagcccggcgaactgttctccgccgccgtcaagcagcagcttggcgtggtcttcggacgcatgacccgcccggtcacgctcgctctcgagctggacggcactccgctttcggcggaattgcagggtttcatcggcgagatggttgcgctgtccggcggcaagctgaactcggttgccgttgatgccgcagggctgatcacggcggtggatggtgcttctgtgcctacttctttggtggtcggcgaaccgctgtccgtcaccttgccggacggcaccgaactgcccacttatggttcgttggacgattccggccgcgccacattcgacgtcgccggcgtcctgccgctcgcccgtccgaccgtgcgcatctgcgtgccggctgagggcgacggcaaggccggcaaggacggcaatggttcactggtcttcaccggtctggccttccacggcgtaccttccggccatgagttcaactcgttcgtgctcggcctgtacaacgcggccggtcccggccagccgctgggcgacgacctgatcgaacgcgcgaagtccatcacagacccgctgaacatcatgatcctcgtctcgctcacctgcacgatgtgtccggaaaccgtgcttgcttcccagcgcattgcctccctgagcccggccgtgcgcgccgaagcctacgacgtctcgcacttccccgaactcaaggaccagtacggcgcgatgagcgtgccctgcatcgtcatcacccacgccgacggcacccagcaagttgaattcggcaaaaagagcatcccccaaatgctcgaactggtcggcgcgtaagccgcacgacctcaggtactcaacagcaacaacaacgattctgccaaaatcgtgacgtacatcgattgatgcgatcgatgcgcccgactccggcagaatcgttgttttgcggcagctcagcctcggtcttcgacggccttcgtgacgtttctgtcgccgaggtacttgaccaagctgatgctgatcagggccacaacgaacaggccggtgagcaccgggatgagtgcggcgtagcggtgggcctgatcaggcgcgtgggcaactacgaacgaggccaactggttgccggacagaccggcgaacgcccaggcgctcagcgtcagaccgtgcgtggtggagacggttttggtgccgaagtgctgatcaagcagcacgggcagcgttgagaaaccgccaccatagcccgcgttgacgaggaacagcatggccagcacggcccacagcagagcgttgccgatgctgttggtgaagatctgcagcaagcacacggcaatcgacatgatgaagattacctgatagacggtctcgcggcgcttcaggtggtcggagagtgtggagaagcccacgcggccagccgtgttgaacacggagtccacggcgagcaccagtccgatgatgccggagatggcggcggcaaacttggcggggctcaggttggcatactgcgggaaggccctgagcacatcgtgcaggatgtccttctcttggctgatgagggccaggccgcaggtgatgttgatatagaaggctatccagatgccccagaacacgggcttcttgaggattgtcttgcggctgacgtgtgaggtcgcgggatcgtacacccagccggccggacgcttgatgagcaggaagccgacgaacatcatcaccgcgtagaccgcggcgaggatgaagaacatgctgaccaggccaaccgtgccgatgagatattccatcagtgggctggcaatggccttggccaggccgaagccggcgacggcgatgccggtggcgaggcccttgttgtcggcgaaccaaagcatcaggttcttgaccggagtcagataaccgacgcccaggccgatgcccatgatcgcgccataacagatgaacacgcccggcaggaagttcagggcgatgctcacgcccgtgccggcgaagccgaccacgaagcagaccatggatacgagtgcggatttcttgatgtttttctccaccattggcccggcaaacgcggcggacatgccgaggaagaagatggcgagtgagaagccccattccacggaggcggggctggcgtggagacggtcagcgataagctgcttgaacacgctccagcaatagacggtaccgattgggatatgaatcagcagtgcgggaataatcgcgctggtccaacgattctcggtaaaccttgccatatatggacggatcctttcgtaactggtgtacgatgacctgccgacccgaacgagagtcgtatcgcccatatccacgcacatcacgacggcatgccccccgtgaaccatccgggctgcacgaatcgaatcaaatcgaatcgtgcgaactgcgaacaattcgctaaacatccttggtgtgcatttcatcggcgctgctggctcttgtcgacgccgacaaacagaactataacgctgttatggggttgctgtggctgatttctgtggtcggaagctatgagctttctcacatcgaaaacagttatatgacggtatcggcgtgattgatacgtgacgtctgcccgtggacgcggcatatccctctcggaaaacaatgactccgtcatgtccatttcttggtttgacatgttttcgtttgcagcgtcggtgctcaccacggtgaccgcggcgttcgagtcgccgggcagggcctcgaccgagggtctcatcctcggctgagatgtgggcggtactatggattcttatcgataaggttcgtgatatgcggagatggtaacgatggtgaccttaaaggatgtcggcgaactggccggagtgaccgccaccaccgcctccgcggccctgcgaggcaaggattacgtcaagcccgaaaccacgcaacgcgtgtgtgacgccgcccgcaaactcggctacaaaatcaacctgtctggccggtccctgcgttctgggcggtccgataccatcaccttccttacctcgggcctcgagggcgactatttctcccatctggccatgtgtgtggctgaggaagtgcacaagcgcgactcgcacatgctcatcgaactgtcccggtatcttaccgacgacaacgatctgtcgtacacgttttcggacggcatcatcgccatcaatgcgccacgtgcggtcgatatcctgaagcggcacccggccgtcatgctggaaaactacgacaccagcctgcccatcgacaccgtgaacgcgccgagcgacgccggctcacgggcggcaatcgaacaccttatcgcgcgtggctgtgcgcgcatcggcatcgtcggcgacaatcgcgatcccaacaatcccaacatcattcccggctcgcgtgatattcgtatgcgggccgccaaggagacgattctcgcggccggactgccgtttgacgagcgccgcgattacatcaaatcctcgtggtcgattgacggcggtatcgaggccgggcgcggcttggctaagaaaggcaagtgcaagtacgacggtctgtactgcctgaacgacggtattgcgctcggtattctgcgtggtctggcggatgatggcgtgagcgtgccgggcgatgtgcgcgttatcggcttcgacggcctgagccagggtgcgtacagcgtgccaatgctgaccaccgtggccacggatttcaagggcatggcggataccgcgctgaccttgcttatgcggcgtatcgagaacccggacgatgaattcttcccgcagaccgtgaacgtgggctataagctcatcgagcgtgagtctactgcggcgtgaaatggcgtgaaacagggaagtcccactctggcgagtgggactttaccgatatgcgcgggtaaaaggaaacccccgctgagtcgcgggggttgctgtgctgcgatatgttttgcgcgcgcaaagctattgcgcaaaacatatcgctacgttttggccttgggaagcccaccgggcttcccaagcggtgttgggccgcacgcgcggcccaacaccggccaaaacgtcagcctgtgttctgcaggccagcggcgacacctgaaacggtgcagaggatcagatagatgaaccctgcctgctggctttgcgagagctcttccttgtccaccttcttgcgcagcgacttgagcgccagcacctgagtgacggacagcgcgtccacgtacggggagcggatgcggatggcctggccgagcacgtgacggtgctgcagcggccacttgtcgcccacgatggccagaacccacttgcgggtgagctccatctcctcgagtaccttcttgttgaggtcctcgcggtcgccgagggcgaggtacatcttggcgatgcgctcgtccgtcttggcgatggacatctcgatgttgtcgatgaaggtggagaacagcggccattcctcatacgccttgcgcatggtctccagatcgccgaacttctcgcatgcggtgccgagaccgtaccaggcggccaggttgatgcgggcctgagcccaggagaagatccacggaatcgtacgcaggtcgtcgagcgacttggcgccgaggccacgcttggccgggcgggagccgatcggcagcaggccgatttcggtcagcggcgtgacgatcgagaaccacggggcgaagccatcggtgttcaacaggtcgaggaagcggttgtgcgcggcctcgtcgagctgagcggccatatcggcgtacttctcggtcatctcggtgttgcgcttctccacgctcggcgcggactgcagcaaggtcgccgcagccacggactcgacgtggcggatggccagcaccgggttgccgtagcgggcgaagatgacctcgccctgctcggtgagcttgaagcggcacttgacggaaccgaccggctgggcgagcaccgcgcggttggcggggccgccgccacgaccgacggcgccgccgcggccatggaacagggtcaggtcgatgtcgtgcgactcagcccacttggcgatgcgctcctgagcggagtgcagggccagcgtggcggaggtcgggccggcgtccttcgaggagtcggagtagccgagcatgacctcgagcttgttgccggtggccttcagacgagcctggacctcggggatcttgatcatttcctcgagcacatccaccgagttctgcagatcctcaagctgctcgaacagcgggatcacgtcgatggtgggcacgtcctccgggtgagagaaggccaagcggttgagctcgtagacatccttgatgttctgggcgctcttggtgaaggagatgatgtagcggcgggcggccttgaggccgttgcgcttctggatggcgccgagggcgcggaaggtgtcgagcacctcgtgcgtcatcggctgcagttcgccgcgctcgccatgcaggccgtgctcgcggatatccgcaagggcgcgggcgtgcaccacggagtgctgacggaactccatctccaccatgtggaagccgaaggtctcggtctgccagatcagatcctgcagcgggccgtaagcggaacgcttggcgccggcggcggccagcgaacgctggaccaccttgaggtcggcgaggaagttgtcgcaggagtggtacatgaggtcggcatcgcgttcgatggtgtagtgcagacggtcggccatcaccagcatgaccgcgcggtgcatctccttggtggagatcagggcggccttgtcggtcagacgctcgctcatttccttctggtggctccagaggttcttgagctcggcgctcggcggcgtggtctcggcttccatcgtgaggttgcggccgacggtgcgggtggcttgctcaagggcggcgatcacgtgatcggagaacttgcgggccacggcgcggctcaccttggcggtgacgttcgggttaccgtcgcggtcggagccgatccagctgcccgggtggaagaacgcggggcaagcgggctcgacgagaccggccttatcgcccaggacccagtcgtcgaagcgacggtaaaccttggggatggtgttgaacagtgtgttgtcgaagatgtcgagaattgtgtccgcttcctcaaccggggtcggcttcttcagcgcgattggagaagtgcggaacagggcgtcgatctcgttgtagagacggcgcaggcattccttcttatccgagccgccgaggcgcttgtactcctcaagcaattcggaaacgcggcgaatcttgccttccacggccttacgacgggcctcagtggggtgcgccgtgaagacggggtggaattcgagctggttgagcagttccttggccttggccgggccagtctcattgatgagctggtggtaagcgacggtgagctcgttgatcgggtcgaccgcctggtcaacgggcacgttgttctcgcgctcgtggagcacggaaacgcggtagttctcctcggacaggtttgccagatggaaatacgtggcgaacgcgcgggccagcagctgggcgtcgtgcaacgtcatgttgtcgatgacgttcacggcctccttcaggccatcctggtcggggttcggatccttcagctcggcgaaatgctcggcgctggcctccaccgcgtaatgacgcacggtgtcgaacgtagacagcagttcggggttgtattcgcccagtacgttacgcaggatctcaagacacagatccatgtcgtacttcaggctttcgggaagatcatgctcctccgggccctttcggccggtcccggtagtgacgatggcggcgtcagcgggagtgatctgttcttcaggtgttgccatataacctcctttgccgaataacaggttgctcggtctactggtcgtctgcggctcctccgcagttgttgagaccagtcgttgcgagcccacagcccatattcaacgtggttgttgtgtgggcaatagtgtatccccgcgaaatcgctatttacgttacgaagtccatatagtgcgccaagttgtccacctatagagaccgaatatcggacagcatatgagacactgtccgattcgcggaagatttgagcgccttacgattgctggcggggaaggcagggagtagtaatgaaggatgtgagcgaacagaagaaaaaaagtgcgcccgaagcgaaaggcgcaacggctgtacgtaaattccacacccactccattccgctggacatggaagatattgcacgcgattgggaaaaaccggtggtggacgccggtatcgccgccaaagccagcgtgattgtacgagtcggcatgttggacctgggagccggcaccggctccttccgcgtgcgtgaaatgatgcaccgcatcgcctacccgctgggcgtgcacgtacgcgccgacgtgaacctgacggatatcgaggccacctgcacggatggtcgtaaccgcatcaccgaagtcgtggatttgccgaccaccggcgtgaacaccgaacgtatctggctgctggaacatttcgccgactggttctccgtgaatctcggcaaggggtcgatgtatcacgtcgattcgcaactgtccgatggcgtggtcaagcatttggacgaacgtgacgcttcgcagtattctgccgatctggccaagcgcctgcgcgaacgtgccaaggccgaggttgaggcggccaacggcagcgtggacgaggcgctggatcttgcgttgaaaaccaaggtactcgtgacctccgtggccaagtccttggacgatgacaatgaagaagcccaccgacttttggcggacagcgcggaagtcactccggtcgaagacaaagcggccgaagagaaggcctacgacgatgccgaagtgtttaccggtgactccaatgagtcggttgaatcggcgaacgcgacgaacggcgcaaccgccgaaagccctgctgcaagcagtacgaagcgtaagaatcgcgtgcccaaggaatacgccgaacacttcaacgagcgctccgacgaagagaaggccaagggcggtatcaccgtgcggcaggcgcacgagcgactcgatctgattgagcgccgcaagccgctgtacaagccgtggttctccggtctggcctccgccctagcctgcgcggccttcgtgttcctgctcggcggcggcccatacgacatgatcggtgcgttcgtgggcgcgggccttggccagtggatgcgtcgccggctgtttgcataccatctgaaccagttcttcgtcacctttgtgtgtgtggccgcggcggcgctcgcctgcaccggcaccctgcgactcatcggcattttcgacccagtcgcgctctcgcacgatacggcctacatcggcgccatgctgttcgtgatccccggtttcccgctcatcacaggcggactcgacatggcgaaaatcgacttcccctcgggcatccagcgcgtggcgtacgtgctgtgcatcatcctgatggccacgctggcaggctgggccgtggccgtgatggtgcacctgcacccggaaggctttgagccactggggcttgacccgtgggtcaacggattgctgcgattcgtggcggcgttcgtcggcgtgtggggcttctccgtgctgttcaattcgccgcagcgcatgtgcctgaccgccgccctgatcggtgcgatcacggacacgctgcgcttggaattgcaagacttcaacgtggcacccgagatggctaccttcatcggcgcgtttctggcgggcattctggcatcggtgtggcgttcatccgtgcgacgtggctggctaccgccgcacctcggctacccgcgcatctgcctgaccgtgccgtcgatcgtgatcatggtgcccggtctgtatatgtatcgtgccatgtggtacctcggcagcttccagaccatgaatgcgctggactgggcgttccgtgcgttcatggtgattatctgtctgccgatcggcttggcgatggcccgcgtggtgaccgacaagtcctggcgctacgacatctgaccgtcatcttggctctcctcaggtggggggagctcggataaaacagcgtctcagtatggaaacggtggaaggtgcttgagcccttgtatccactaccatcaggcgaagtgcgttgcggccgtattcacggctgtgacggtctgtatgacgccgctccggcgtcaatcgcatatcagcacatagttctgccatggcggtagccgcttggcgtcatgattgaggaggggcgcagttggccaacgatttctggattctgctggccatggtcatctattttgcggccatgctgtccatcggattcatctactccaaacgctccaactcctcctccaaggaatactttgcgggcgggcgcggcgtggggccgtggctcacggccctgagcgccgaagcctccgacatgagcggctggctgctgatgggcctgccgggcctggcctacttcactggtgcggccgacccgatgtggaccgccgtcggactggcgctcggcacctatctcaactggaagcttgtggcccggcgactgcgccgctactcggtagtgaccgacgatgccatcaccattcctgacttcttcgccaagcgtttccatgacaagaagggcgtgatctccaccatcgcggccgtgatcatcctggtgttcttcagcgtgtacgtgggcagctgcttcgtgaccgtgggcaagctgttcgccacgttgttcggtttcgactaccacgtcatgatgatcatcggcgcggtggtcgtgttcgtctacaccgtggtgggcggctacttgtcggtggtgatgaccgacttcattcaaggcatgctcatgttcttcgcgctcgcggtggtgttcatcggcaccgtggccagcgcgggcggtgtcgacaacaccgtggaattcctgcgtgccatccccggctacctgtccggcacgcaggtggccgcgcccaagctggacccggccaccggccagcagctcgtcgaggcgggcaaggccgtgttcggcgcgccctccgactacggcatcatcaccatcatctccatgctggcgtggggcctgggttacttcggtatgccgcaggtgctggtgcgcttcctgtccatccgcagcgtggaagaagtgcgcaagtcccgaatcatcgccacctcctggtgcgtgatttcgctgggttgcgcagtgtgcatcggcttggtggggcgtgcgatgatgcccaccgaactgctgacctccaccgatgcggaaaccatcttcatcgtgctagcgcagaccctactgccgagcttcatgtgcggcgtggtggtctccggcattttcgcggcctcgatgagctccagctcctcgtatctgatcatcggcgcttcggccatgggcgagaacatcttccgcgggctgctgcaccgcaaggccaccgacaagcaggtcatgattgtggccagggccacgctggtggtcatgttcctgttcggcattctggtggcatacgaccagaactcgtcgatcttccaggcggtgtcttacgcgtgggccgggcttggtgcctcattcggcccgttgatgctgtgctcgctatactggcgtcgcgccaacaaggccggcgccgtggccggcatgctgtccggcacggcggccgtgctgatctggcacaacctcgtcaagcccttgggcggcgtattcgccatctatgagctgctgccggcgttcatcatttcgctgctgttcatcgtggtggtttcgttgctgaccgccaagccgaacaagcgcatgctctacgaattcgaccactacatggacgatccgctgcccggcaccctgccgtccggcaccgtgctcgtcgacgagcccatggaagccatggagtccgaggtccgcagcggcaaatgacacgtgcctgctgtgcggtcggctcgtatggcagaggagtggcttttttgtggttcggcaggaaccattgaggccaaaacggacttcgaggggctgatttgacgttctggagagatctacttccgtttcaaggggctgatgcctgagtagacgcggctccaaaacggcggaatggcgttgacgtaagggcattgatacacgtggtctaccggatgatcagccccttgaaacggaagtagacctccggcggaggccaaatcagccccttgaaatgggttttgaataccgtagcgcggtgcggacggtgcggactgactctaccgggcttattattcctgcgtcgtcggaataattggcagcagaggctcgaatttcagccgtttgtacagtggaatacggcgtagctttcggacatcgctaatttgctgggtagtttgccgcatcgtgagctggaccgttttgcccgtaacctcctgtatcctttcggcaactcttcgggcaagggcctcttctcccgcttcgtcgccaatatctaatttggtgacttgaatgtacttccagccagcatcttcgatcatctggcggcgtctcgcgtcattcagccattgcccggcatgatgagagccttcgtattcgatacatatcttgaattcagggtatgcaagatcgagatatatgggtctggtgttgtttcctacgaatattggataattcacctgcgggcaattcagaccgtatttcaagagaaccaaacgagttcgtgtttccatggaggaatctgtgcccgcgcgcgccaaaagtagggcgcgacggcatttgttatacccgcggaacaaatacgaattggtgccattctctttgtcggctcgcacctgggcctcggcctcatcgagatacagagaaagggcgtcgatggttgttctgcagagccttcgatctcgtcgcatcatggaatcagcgagaacgatgagttcttcaagttcgagatacgtggagaacatggcccatgtgcaagctggtgaagtgcatgtgaattgtccctcgattatgaccgtgtctagtggaaaaggccatacaaccactttgacccccacaatgtgccgtttgtcattggcgtgtggaaccgcaacaatggttgtagttgcaaggcctctgtgtttgcttgatatgcggggtacttcaattgacaaaagctccaacgctgttgtcagggcatagggtgggcgccatgcgcttcgtcgttgaacatctgcgcacgtctgcattcgttggtacttctgcattgtcagctcggtcaatgccgttgagctacccatgatgatcaccccttcgtgatgttcgctttgtcctcgcagtgtagagtccggctaccggccttgtctaccgccccaatttttcggtggataaatgtggataagtcggtggataaactatgggtgttcatcgcagttgcaggccatcccgcaattacatggaacgtaggggtttgcaggcagccagcgggaatcgccgccgacggcgcgattcagcttgaacgaatctccatggcgttcatgcaaaggtggcatgatggcgggtatgagtagcttggtgcgtattgtcaatgccggtgttccggggtctcaggaccgcgtggatgtggtgcttcgcgatggggttgttgcgtctgtcggccctgctggaacggtctcggcttcggacggcacgatgcagactaaggcgcatacgacatcgttggcatacgcgacgaatgccattgcttctggcggcgtctcaatcccaacgtcggcctccgcacccgccgacgaaaccaccatcgacgccgacggcctgtgggttattcccagcctgtgggactgccacacgcacttcacgcaatgggctaagacgctgggccgactggacctcatcaatgcccgttccgccgccgaagcgatggacatgttgcgccgtcatctggatgagcgccgcgccgccggcacgcttgacccagatgccttcgtggtgggcatgcgattccgtcactcgctgtgggccgacgacgagcagcccacactggccgcaattgacgccgtgaccggcgaacagccggtggccctctccagcgcggacatgcactgcggatgggtgaattccgccgcggcccgcaggcttggcgtacatgtggacgaatccggtctggtcggtgaactcgaatggttcaacgcctacaccgccttcgacaaggcgccgggcgctgctgaagagactgaccgtctgctgcgcgaggccgaacaggacgccgcaagcaagggcgtggtgggcatccgcgattatgaaatggccgaaaacatcgatacatggatcaatcgtttcgcggctggcattaacggtttgcgcgtggacgccggtgtataccccgagcggttgcgagccgccattgatgcgggttggcataccggcaaggaattgccgggcagcgccgggcttggccatgtgggcgccatgaagctcatctcggacggatcgctcaacacccgctccgcctactgctccacgccgtattcgggcatcgagccgctgacgtatggcacgctgagctacacgccgcagcaaatcgaagactatatgcgcctagccaccgagcatggcttcgacattgcctgccacgccattggcgacgaagcgaacaccattgcgctcaacgcagtcgccgccacgcacgcacatggatcgatcgagcatgcgcagatgctcaaacccgtcgatatcccgcgtttcgccgagctggggctcacggccagcatccagccgcagcacgccatggatgaccgcgacgtcatcacccgtttctgggccaacccggccggcatcccttatccgttcagggccctccacgacgccggtaccacgctgcgcatgggctcggatgcgcccgtggccccgctggacccgtggctggccatttccgccgccgtgctcggcaccgaaagctctgaccgcgagccgttccagcccgagcagtgcctcgatgtgcatacctcgctggcagcctcgaccgccactggccgtgaccgccttgcatccggcgacccggccgatgtggtgttgctggacgccgacccatacgccgccgatactccggaagccatgcgcgctatgccgcaacacgtcgtaatgacattgctgtgcggggagcgtacgtattgatgcaagccatcggcatgaagtgaacagaggtccgtcttgatagccgcgttgcacggaaaaacaagaaatccgcccctcgaagtgaagataggacacagcagacgccgcaatacaaaaacgccgtgtcagttgcccagttggggctgacacggcgtcttgctacgagcggcgggaaaatcagtacttcatgcccatggcctcgcgcacctggtcgagggtctcctcggcgatggcgttggcgcgcttgttgccgtcgtgcaggatgtcacgaatggaatccatgtccttggccagctcggcgcggcgctcgcggtgcggggccaggaactcgttgactgattcgatgacgtatgccttgagcgcgccggcgccggaatcaccgatctcctcggcgatgtccttcgggtcgcggccggtcaccaggccggcggtggtcagcagggcggagacctgcgggcgggcaaccgggtcgaaggtgatgcggcgctcggaatcggtcgggctcttcttgatgagcttggcggtttcctcggcggtggcgcccagcatgatggagttgccgtacgacttgctcatcttgcggccgtcgagacccggaatctccggtgcctcagacagaatggcggccggctccgggaacaccgggttcttcttggcgtaacgctcgttgaaacggcgggcgatggtgcgcgtgatttccacgtgcggcaggttgtccttgccgatcggcacgacattggccttgcagaagaggatgtcgcacgcctgatgcaccgggtaggtgagcagcagaccggtcagcgcgtggccggacgcctccatctcggacttcacggtcgggttgcggtgcagctcggcctcggtgaccaaggacaggaacggcagcagtagctggttctcggccggcacggcggagtgggtgaacatcatggtcttgttcggatcgatgccggcggccatgtagtcgagcaccaggttcagcacgttgtcttggatgtgctcggtggtgtcgcggtcggtgatcacctggtagtcggcgatgatgatgttcgtgttgacgccgcgctcctgcatggcgacacgctcacggatcgagccgaagtagtggccgaggtgcagccggccggtcgggcggtcgccggtcaacatggtgaaggacgacggcttggcctccagcttggcgagcgtttcgtccgaacgctttttggccgcgaggaagctcgcgctcatctcattgcctgccgctgtcagttgctgctcgtcggtcatgcgaaaatcctttgaatatgccctaaataaacgctttttatggtaaaagtgtgagccgacaacgaacaagccactattagtggtactctctattgttgatgaatcgaacagcacagtaatcgcagggggtcagatgggccgcggacgtcaaaaagcaaaacagcagaaaattgcccgaaagctcaagtacctgaccaccgataccgactacgatgagctggcaaaagagctgagcgagcaggagccgggaatgggctctcctgacccgttcgccgacatcgatgaccagtatgcggacaaggatgtggattccgctgctgatgaccacgcttccggtgccgccgaggcagctcccgctacgcaggaggatgacctcgacgagtacgccaagtgggctgccgaagccgccgcaaaggcgaccagcggcgagttcccggcctccgcgcctgccgcaccgaagccggccccgcgcaagccgattccgatgcccatgccttccgcgctcaagcccaagaagagctgaacgccggtcttctcgtaataatccccttgtgcttggttgagcacaaggggatttgtggttatggctgatggtgccgccgctggtggcttacttacgcttcgcgcctcacagcggcagcaggtcgctcaggtcgtcgcgctcgccgaccgcgctgatgtggccggcgtccttttcctctgcccatgtggtgatgccgcaggccagccgcagccagacttccgggtccagctcgatgacgtccggcggggtcaggttatgcgggtccgattccgggccgtccaagattttgaccgccccccacggcgcgacacgcacctccacgccagggccgggtgcgcgccgctccagcagaaacagcgagtagcgcacggccatcgcccacaccgggcgtggcaagacaggggagacggtcagacgatgtggtgtgttgtccgccagctcccgggccgcggcacgccattgcaccagcgcgtcatgcccgcgtttcaggtctttttcaagaattactgccatgtatcccatcatggcaccggagccggaagatcttccataatgcaaacgatggcatacggtgtgatgcggaatatcggggcatgtgctacgctctaaatgagaacgtatgcaagaacgctccgccatcgtcgttacggagagttcatgcttacgtttgtgcgacgatacctatcgcgcggcataataaacacgggcacttatcccggaaggaaagtcagaatgaccgaaatcaccgcaccgaagtctcctgtcacggcggaacaattcgccgacgagattcgtgaacaactgaaatacactcagaacgtcaccaccgagcaggctacccctgctgacgtgtatgtcgccgcatccaaggccgtgcgcaaccaccttgccgactcctggttcaagacccaggccgacaccgtgaacggcaacaccaaggccgtcggctacctgtccgcagaattcctgatgggtaagcagctgcgcaacgcgctgctcaacgccggtctgaccgagcagttcgacaaggccgtggaagccctcggcttcaaggtccaggacgtcgtcgacgccgaatacgagccgggcctcggcaacggcggcctcggccgtctggccgcctgcttcatcgactccctcgcctcgctgggcgtgccggccttcggctacggcatccagtacaagtacggcatcttcaagcaggagttcgacaaggacggcaagcaggtcgaaaccccggactactggctggccaacgaagagccgtggggccacatcgactacaaccgcgaccagaaggtttccttcggcggcaaggtcgtcgagaacgccgacggcaccaagacctggcagcccgcatggtccgtgcgcgccgtgccggtggactacctggtccccggctacaagtccggccgcgtgaacaccctgcgcctgtggagcgccaagagctacgacgagttcgatctgctcgccttcaaccgctccgagtacatggaagccgtgaccccgcaggtcaaggccgagaacatctccaagattctctacccggaagactccaccaaggtcggcaaggaactgcgccttgagcagcagtacttcttcgtctccgcctccctgcacgacgccatccgcgtcttctacccgggccaggacaagccggatctgacgactttcccgaacaagatcgtcttccagctcaacgacacccacccggtgatcggcatccccgagctcatgcgcatcctcatcgatgagtacggctacgactgggataccgcgtggtccatcaccaccaagaccttcaactacacctgccacaccctgctgccggaggcccttgaggtctggccggccagcctgatcggcgagctgctgccgcgtcaccttgagatcatcgagaagatcaacgcgcagttcgaggacgagctcaagtccaagggcgtcgacaagaacaccatcaaggacatggccatctacactggcgacgccgtgcgcatggcctacttggccacctacggcggctcccacgtcaacggcgtggccgagctgcactcccagctcctgaaggacgtcaccctcaagaacttctccgacgtctacccggacaagttcaccaacgtgaccaacggcgtgactccgcgtcgcttcgtcaagctcgccaacccgcgcctgtccgacctcatcaccgagggcctcggcaccgacaagtggctctccgacctggagatgctcaagggcctcgagccgctggccaaggacgatgaattcgtcaagaagttcgccgccgtcaagaaggccaacaaggtcgacttcgccgcctacgccaagcgcgagtacggcttcgagctcgacccgaacaccatgttcaacaccatggttaagcgcctgcacgagtacaagcgccagtccctgaagatcctgtccgtcatctccacctacgccgacatcaagtccggcaaggtcaaggccgaggacgtcaccccgcgcaccgtgttcttcggtgccaaggccgccccgggctactacctggccaagatgaccatccagctcatcaacaacgtctcccgcgtggtcaacaacgatccggacgtcaagggcaagctggccgtgtacttcccgtggaactacaatgtgcgcctcgcccagcacctgattcccgccaccgacctcgacgagcagatctcgcaggccggcaaggaggcctcgggtaccggcaacatgaagttcgccctcaacggcgcgatgaccgtcggtacgctcgatggcgcgaacgtcgagatccgtgagcgcgtcggcgccgagaacttcttcctgttcggcatgaccgtcgacgaggtcgagaagaagtacgccgagggctacaatcccgcctcctactacgaggccgacccgcgcctgaagcacgccatcgatatggtggccgacggcaccttctccaacggcgaccgcaacgcctactccccgctcgtggccgactggctgaccaaggactggttcatgaccttggccgacttctccgcctacatggacatccagtccgagatcgaggccctctacgctgatgagctcgaatggaaccgcaaggccctgctcaacgtggccaactccggctacttcagctccgaccgctccatggaagactatttggaacgtatctggcacactgctcctctggcctgacggccgccggagcggcgcgccagctacgtgctggtttctacctcgcggctgtcgccgctcggcgtcgcctacgggaagcccaccgggcttcccgcttaacggctccgcgtatctggcacactgctcctctggcctgacggccgccggagcataagaagccccgcaaccgacatccatcggttgcggggcttcttgcgttgaaagaccgccctatcaggcttcggccggggcggctttcgcctcgtcatcggcctcatcctcggccttattcagacctaggtcgaccggcgaggagctgttctcccacggctcctcccacggatcgtaatccgggttctgctgcttgtagatgtacaggccaacaagcgcggcgagcaatccgccgaacagcagcgcgaagaacttccaaccgttagaagacttgttctccatgacggctcctttccctagggatcgtctggtcggtatgcccattcagaccgactctgctccctattctaggccgctgtttgtgacgattgggtggaatgacattcgtgggcgattcatccgcgcccgtctgcccttggccggctcggcatcttcgcggcgcgtggaacgcatccgagaccttcgatacagtgggctgcatgcatattcctacacaacgggagattcgataccagtgggagcgcggtggtccggtgatgacctgggcgctgattgttgcgtgcgtggcagtgtggctactggaggtattgttgggatttattgccccgggcctgagggcttggttgatgtacctcggcatggcggctccggtcagactggtggctgagccgtggacgctcatcacctcgatgttcctgcatgcgccgaactcgctattgcatatcctgttcaacatgattgctctgtattccgtgggcccagtgctggaacgaatgatcggccactggcggttcttgggactgtatgtgatttccggccttggcggctccctgggacttatggtgtgggctgcggtggctccgggaggcatcggctggcagatggcagcctatggggcttctggagccttatttggcctgtttgcatcattgctggtggtatatcgccgtatcggcgccgatatccgctccatgttgatctggatggcggtgaacttcgccttgccgttcgtggtcggtggcgtggcgtggcaggcgcatgtcggcggctttgtagtgggtggaatactcacatggctgctggtgggtggtgtgccggcgtggcgcggtaaaagcctgaaatggcgcatgcaggtgtacggctgggccatggtggtgctggtcattgcgttgattctgttgtgcaatatggccaatccttacgggtggatgagtttcggctccctgcactgatatggcttgatatggcttgatatggcttgatatggctgtaaaaaaaaacgattgatgccgggtattgcggaacatgcagtgcccggcatcaatgtatgtgcggaaagcgacgatgtggatattagcgatgtggatatcgtcgttcggcgagtgggtgtgtgccgtatgaagatatccacagtaatgagatgcgcgcaatgacgagttatccacgataatgagttatccacaatggtgacttgtgcacaagtgtgtagaaaagtgcataagactgtggataacttatgtggataagttaggaatgccgcggtattattgggtttgttgcagtggataactcgggtgtataactgttccctcgctgtggcgatgtatgccaagccaaagttatgcacgagatatacaccgagaaacgccgcttatccaccacttatccacatggttttccacattcggtggaaaactacatgggtgtaattcatccacaggctgtggataacgtagtggataagtcgtggataagtggtggatagctgtggatgaacaggctaaggcacgaaaaaggccgacctccgcatacgggaggtcggcctttctcataagaattaaggacaacctaacgatagaaaaaaacaatctaccgatagataagcgcaacgagccggaactcagcgccatcccatcgtcatcaggaatccgatcatgatcagggcgaagccgatgccgaggttccacgcaccgatgttcggaatcggccaggaaccggacggggagaggtagtacaccacgcaccaaatcaggccgatgatcataaacgcgcagaacagcggcacgaaccaacgcgggttcgacttggtgcccttaatggtttcttcaacgcgcttggtgttctccgcctggcggttcatcatacgctgcatctgcggggtcagcgtggccttatcggcagtggcgttgagcacggcctgcacctgctccatattcacgccgtaagccgcgccttcctcggcagaagcgttctctgcgttctgctcggtgtctttgctggcggtctcgtcagcaacggtgctggatgaggtctcgctctgccagtccttctggttgttcgagtcggtttcgtgcagctcttcgtcagccatcagcatagtctccattcaataggctaaaagtcataatagtggctacactcgaaagcggcgaccagagtcggcaagaagacaggaaattcatggccagacatgtaggtaagcacggtgcacggcactccctatggggtggtgtcgcggtattcgtcgtcattgccttgaccggttttctgctgagcaccaacgtgagggtcaatcgtacggttgccgccaccaacgatacggccgatctggtggagcaaggcgtggacgaggccaaccagctgcagcaggacgtcagcgatctgaccaaacaggtcgccaatcttacggacgcgctcaaggccgatggcaccgacagcacacagaaccaaggcaaggactccagcaatgtggattccagcctgatgctgcccgcgctcagcggcagcggcgtaacggtaacgctggatgattctccgttgtgggagaacgcagtcaacaacaacggcacgaccgccaatatcaacgattacgtgatccaccagcaggacgtcgaatcggtggtgaatgccttgtgggccggcggtgccgatgcgctgatgattatggatcagcgggtgctgttcaattcggcggtcatctgttccggcaacgtgctgtcgttgcacggtaagaaatactcgccgccgttcaccatttccgcgattggtgaccctcaaagacttcgcgcagcgttgaacgactccgaagccattaccattcttaagcaatatgtgaccgcgtttggcattggctacaaggtggagaatgccgaggaccttcagttccccgctaccgccgccttgctgcagcagttgaaatatgccacggtcgatacgtcaaagaccacagatgaggagcagactcagcaatgagacacggcaggcacaacagcggcgtaccggcgcccattgatctcgcgtccgtgtcggacgtacagcccttccccgaggacgatgccgcacgaatggcggcagacccggccaacgccagtagggcaaggtcccgtcgtgccgcagtacgcggcgcgtcttcgccccagcggagcccggtctggcaggcactcggcatctgcgccgaactgctgattaccgctgccgtgatttgcgccctgtacatcgtctggcagatgtggtggaccggtgtcgaggcggagcgagcccagaacgaaaccacccagtccgtcgactggagcgaccccagcaacaacgggggaacggtcaccatcgccaaagcccaggagggcgatgcgccggtacagccgaaagacgcgaaatatggcgacttgattgcgcagatctacattccgcgcttcggctcccaatggcaccgcaacatcgtggaaggcaccacgctcgagcagctcaatcgccacggtctgggccattacgacaccacccagatgccggggcaggtcggcaacttcgccgtcgccggccaccgcaacggctacgggcagccgttgggcgatgtggacaagttgcaggaaggcgatcccatcatcgttcgtaccaaggattactggtacgtctaccactacacccggtacgagattgtgctgcccacggacgtgcatgtgatcgcccccaatccggaagactccactgccaatcccaccaaacgcatgatcacactgaccacctgtgagccgaaatactccacccccacccatcgatggatcagctatggtgagttggcgtactgggccaaagtgtccgacggtgtgcccaaagagctggctactactgattcgtccggtgcagtgatgttctccaccaccgaaaccccctcgatcgcttcccgcattggctcgctggacaaggtggtattcggcgcgctggtagtgtggctggttctgttcattgccgctgcggtggcatggcgctggccggtgctgcgcgagattcgcgcgggtgagcgtcgccgtccggatgccagcatctatggcggactgttgcgtctgcagcccggcgtggcaccgattcgatggttgctgctggctctgctgctgttcgcagccgccgcggcgctgttccagtggggattcccttgggccgccgccaatatcccattcctacagcagatgtcgaacttcgtggcagcgagctgacggcatcctagtactatggcttgcagtacacgtccctcaaggagagccctatgaccgattccgcgcatattttggtggtggataactacgattccttcgtctacacgatcgtaggctatctgcaaacccttggcgccactgttgatgtggtgcgtaacgacactatcgacccagccgcgccgggtgtactggacggttacgatggcgtgctgatttctcccggccctggtgctccggccgaatccggtgccagtgaggatatgattcgcctgtgcgcggccagcggcgtgccgatgtttggtgtgtgcctgggcttgcaggcgctcgctgaggtgtacggctgcactgtggaccatgcgcccaccatcatgcatgccaagaccagcttggtggaacatatcgatgacgagattttcgagggcgtggccaaccccatgaccgccacccgctaccattcgttggccgtcgagcccgattcggtgccggatacgctggtggttaccgcgtggacgcaaggcgaccacattattcagggcgtgcgtgtcaagggcaagccgatgtacgccgtgcaattccatcccgaatccgtgatgacccaggacggctaccgtctgctggccaactggcttaaggtctgcggccaagacaacgccgtggccaagtccgccggcctccagcccaaagttacgaagtagcttttccgcgcggcgatactctccccggaatgtgtcgctagaacgaggcttgcgtactggttttgcgacgcttctcgggattgttgcgctgggatagctctttatacagcaaaggggaggggcgcagaagcccttcccctttgtgttgcgtgtatgtgttgcgctatttgcgttgcatatgcgcaacacatacacgcccggcgcttacttgctactcaccggttcactcaccggttccgcccccgttgccagtaccgttgccaccgtctccggtaccggtaccgccgccagtgctgccggccttcgtggtaatggtgacggtcgatcccgcatctacctggctgccagcgccaggattgatgctgactaccacagcggtgctgccggttggaccattggcctgagccttgaggcccacggccttgagcatgagttcggcggtgacgtagtcagtgccagcggtgatattcggcacagcgaccttctccttgcccgtggacacccaaatggtgatgaacccgccctgtgcgatggaagagcccgaatcagggcttacacgggtaatcagaccggcctccaccgtatcggagctctcctgctccacagtgaagctgaacttgccctcatactgctgtagcacgctgtccttcgactgaccgaccaaattgctcggtacggtggtcatgccggaagaaacatatatggtgatggtggtgcccttgggaaccgactgaccggcggcaggatcggttttcgtcaccatatccttggcgatgtcggcgctgtcttcggttttgacggcggcgttcaccttgaacccggcgctttccagaatgctgcgcgcctcttcctggctgcgttccttgacatccggaacctgagtggactgcgggcctgcggagaaccacaccttcacggcagatcccttggccaccttggagccggcgtccgggctcatcttggtgcaggtgccttccggctcggtggagtcggtgtcttgcttttcggtcatcttcaaacccgatgccttgagtttgagctcgatgctgtccttggatgtggaagcgttgcacacctcagggatggtgacggtgtcttccgaggacttgttgccggagccgttcatggcgaacacgatgcccacaatgacaagcactgcaacaatcgctgcgatcaccgaaccgatgatgatcttcttgcgcttcttggccttggccgccgccgcacgctgctgcgcacgggactgcaacgccgctgagttggcaccattggccggtggaatctgctcgaactgaccggtcaccgggttgaatgcttgggtgggttgctgatgcggttccaccggcgtggtgggcaaatcacgttcggcttccttgcgggccttcatattcgacaggtccgtcaacgggttgaacgcggccgccaccggcacgccgccgttcatgtaggtcaggatgtcggtcttgaattcggaggccgtggcatagcgattctggcggtccttggccatggccttggcgcagatcgaatcccacatcttcggcagccccggcaccacggcggatggcggcgtggcgacttcggaaacatgctggtaggcgatggccacggcggaatcgccggtaaacggcgggcggccggtgagcatctcgtagagcacgcagccggcggaatacaggtcggaacgcatgtcgacggtctcgccgcgcgcctgctcgggagaaaggtactgtgcggtgcccaccacgccctgcgactgggtcatggtggctgcggaatcgtccagagcgcgggcgatgccgaagtccatgaccttgaccacgccctgctcggaaatcatgatgttgccgggcttgatatcgcggtggataatgcccatgcgatgcgaatagtcgagcgcgttaagcacgcccaacatcacctgttcgcagtcgcgctggctgagtgcgccgttgaccttgatgatgtcgcgcagggtctggcccttgacgtattccatgacgatgtatggcagacgctcggcatcgccgctttcggaagaaaccagttcttctcccgaatcgtagatgttcacgatgttcgggttgttcatctgggccacggcgtgtgcttcgcggcggaaacgggccaggaagatgtcgtcgttggccagatcggcgcgcatgattttcacggccacggtacggcccagacgggtgtcaagagccacgtggacctcggccatgccgccacgaccgatgagctggccaagctggtagcgtccgccggccaatgcggtgggcatactggtgctcattgcttattccctcccaatcttgaggccggggcctccaaaacaatgcgtggcgtgctggtcactcggcgcggcagtcgattgccggacgtggccatggcggtgtcggccatttcggtctgctgatccagcagacggcgttcgatgcgtgccagcgtacgggacaccaccagcgcgtctttcgggcgatccaacgggtccttggccagcattgacatgacaaattcgcgtaactggacgtccaccgagtccggcagcggaggcacgggattgttcacgtgcgctgcggcgatatcgaccggagtggtgccggtgaacggacgatgcccggcaaggccctcgtacgccactacgcccagtgaatagatgtccgattgcggcgtggcctgctggccctgcgcctgctcgggggagatgtattgtgcggtgcccaccaccatgccgtcctgggtgatctggccctgacccgtggagtagctcacaccgaaatcggtgattttcacttcgccggtgtcggaaaccatgatgttggccggcttgacgtcacgatgaatcacgccgtgcgagtgggccacgaacaggcctcgcgcggtctgaatcaggatgggcagcagttcgatgggatccatcgcgcccttgctgtggaacaggtccgccaacgatttcgaggggacgtattccataatcagaaagccgatgccgtcatgctcgtagtattcgaacaacgcagcgatattcggatgcgccagattggcggaattatgggcttcggcacgcagacggcgtagcttggcctcggcgttggtcatgtccgagcgcagcgccttgatggccacttcacggccgagctgaatatcgtagcctttccagacctcgcccataccgccttgcgcaagacgcgaatcaagacgatatcggcggtgaataagctgtccttcgataagtttcactgctgcaaagcctcctgcatcatcgcgcgcatgatcgggccagcggcgagcgaaccgtatacatctgtgttatgcaccaacaccgcgacggcgatttgcggatcgtccgccggcgcgaaaccgatcacccagccgtcgatggcagagttgtcggtaccgatttgtgcggtaccggttttggccgccaccttgatgccgtcgatggccagctgcggattggcctcggacaccacgctttccatcatcgtggtgagcttgtctgcggaatccttgctgaacgcattggccatggtctgcggcttggtctgcgaaagcacggtgagatcggcggcgcgcacacgatcgaccagcgtgggctgcatcagtttgccgttgttggcgattgcctgcgcgaccatcgccatctgcaacggcgtggccgtggtgtcgccttggccgatggacgccagcgcaagcttgtcgtcggtcggatcagaggggaatgtggacgcggtggccgtcatcggggtgcccgtggattcggtgccgtcaatggtgatggtgctgccgaaaccaagcttggtggccatgtccgaaaccttgctcgcgccgagtttcacgccaagctgggcgaacgcggtattggacgaccatgcgacggcctcttgcagggagatctgcccgttgacgccatcggcctgtgcctcggcgttcggcaactgtgtggcggttcccggcaaggtatagctggcgcccgcaggaatcttcgtgtccgtctgataatcgccggtttccagcgcagccgaggcgacgatggtcttgaacgtggaccctggtgggtacagctgcgaggtggcgcggttgattagagggctattttggcccgcagaaagttcgttgtaggcctgagacgcggctttggtgtcatgggtcgccagtttgttcggatcataactgggcgtgctcaccatggcgaggatacggccggtgttgacttcgatggccaccgccgcaccatcgcgcgtaccgagctgatcgtaggcaacctgctgcagcttggggtcgatggaggtttcgatggacgcgccctgattcgtagtgccggtgagcatggccttggcccgctgccagatcaatgaatcggcctcaccgttgagcagcatgctgcgggaggcttccaggccgcgatcggcggtctggttgatggagaagaagccggtgaccggagcatacagaggaccgttggaataggtgcgcaggtatttgaacgcgtcgttgaccggttcggatttggccatgaccgtgccgtccgaggccagaatggcaccgcggtaggcaccgagctggtggtacagcgaacgggcgttgcgcggatcgttgttcagcgcgttggcccgtaccgccatgatgatggtggacgacaggccgagaatcacgaacagcgctaccacggcggtgaaaagctgacgaagatatttgttcatacgcgagtgcctccgttaacgggaggaagcgggggaatcgtaccggtaggcgtgtacggttcatcggcgccggcatacgccggagtggtggcatccacaatgggctcggcgatgggggccgcagcagagcccgcagaggtcacaattgcgggcacttcgggtgcctcaagtgtgtctggcgcgtgcttggtgatgtccacaatggggtcgtcaaacgattccgactcggactgcgacgccgtagccgacgcgctgcgaggctgaacgatcggctcagtggcgcgggcccgggcctcaagttccttgttgcgcagcacggccaaagcctcgtactggaacgtatccgaggtcagctccggctcgggcgcattggccgaattcgagatgatgatgagcagggtcgcgagaatatagttggcgatcagactggagccaccggccgccatatagggcagggtcagaccggtcagaggaatcaccagcgtgatgccgccgaccacggtgaacacctggaaggccatggtgaacaccagtccggaagcgagcagcttgccgaagccatccttgattttcatggcggtgataaagccggaggcaatgatgagcaggtagagcatcaaaatggccaggacgcccatcagaccgagttcctcgcccagagaggcgtagatgaaatcggagttcgcaaacgtaacgagcgaaggatggccttggccgagaccggtgccgagcatgccgcctgatgccaggccgaaaatgccggtgaccagctgccaggagccgccgggggtcttgttgtattgctcgttgctgaacgggtgcagccaggcatcgactcgctgacccacgtggctgaacatgcctgcggccagcacggcacccgcggcgaacgcgatcagaccgatgatgatccagcttttacggccggtggccgtgtacagcatggccacgaacatggcgaagaacataagcgaggtgcccagatcatgctgcatgatgagcacgcccatcgaggcgatccacaccacgatgatcgggccgagatccttgatacgcggcagctgcagaccgagcatcttcttaccgcccacggccagctggtcgcgatggtcgaacaggtaggcggcgaagaagaacgcaaggaacagcttggcgaactcgcccggctggaactggcccagtcccggaatcctgatccaaatgcgcgcgccgttcacttcctgaccgacaaacggcagcatcggggcgagcagcagcaccaagcccaccaccatcgacacgtaggagaagcgccgcagcacgcggtagtccttcaggaagatgatgagcagcgcggaaagcacgatggcgatgcacagccagatcagctgacgttgggcaaccgcccaaccttcgctctggtcaatgcgagcgatcatggtcacgccggtggcggtcagcagtagcacgcaaggcagaatcgactggctggcgtacggctggaagcgcacaatcagcccccacagcaccagaaacagcactacggccaatgccagcatgccggcgtattgcatagggaattcgccggcggcgcgctggaacatctggatgaacgccaacgcactgattgccatggcaatcagcaacaaagaaatctgacgtagacgggtaacgatcattgagaatctcccgtggccgcgttgtcggccgctccgataccggatttatccgaggaatcggatgagcttgacgaaccggacttgtctgacgaggagccggactggctggacgaatcctcggtgctgtccttggaatcgctctgggagctgtctttggaactgtccggggaattggacgcctcggccttcttggcggcgtcggcttcctgctgcttggccagtttgcgcatttcggtgcggataatacccacatgcgactgcgcttcgtccaacgaaccgactgtgatgccttggctcagctggtcacgccatgtctgaggcaggtccgcggtggcgatattggtggtctgcacttcgtgcgaaagctcaagtccaaagagattggtcggcacgccacgataaatggccacggtgccgttgctatctcccacgtagtagtgcgtctggctccacgtgtacacgccccagccagcgccggccaaggccagcacggcaagaatgcaggtaataatcaccgcaagcttattgcggcgcttcttggtgcgcgtggccttcttctgctcgatctgctcatcgcggatggctttggccacatccgggtcgttggggtcggcggacaggcgcccatccggcttttgcaccaccggaatctcaccggtatcgggattggctcgttcaccggtctcctcgcggacggtggacggctgcaccacgcgtgtggacgacggtttggccgtggtttgcgtggtctccgcctcgtgcgcgctggcgggctgaatcaatgctgcggcgcgctgggcgggggaatcatcctcacgcagtgcgggcgcggtagccaccggctcgttgacgatgtcggcaatcggctcaagattacggctggcggcaccgccgaccaacggcgtttggtgcggcaggtcgaacgcatcggcatccaacgccaacgtggcatccgcaataacggccgtgacattatcggtgctgcccgcccgcagtgccatctgcaccagacgctgcgcgcattcgccctgatcggacagcgtggtcatcgtctcttcgatggtggaatcttccagcacaccgcacagaccgtccgagcacagtagccaacggtcggcggggtgggctcggcgaaccgaaatatccgggcgcgggtcaatgtcaaagtcgccaagcacgcgcatcacgacgttgcgctgcgggtagttcttggcttcggacggggtgatacgaccggtgttgatgaggtgctgcacgtagctgtggtcgcacgtgatgcggctcaggcgtccgtcgcgcagcaggtaggcgcgcgaatcgccgatatgggcgatgacccagtagccggccaccaatgccactgcggtaacggtggtgcccatgccggcaagcttgcgttcgcgcttggccttgccgacgatggcgtcatgcgcggccataacggaggtttccatcatgcgggagatcgtctcgacgttgccaccggtgtcgtcctgctcgatgtgggccagcgaccggatggcgatggaggatgccgtatcgccgccggcgtgaccgcccatgccgtcgcacatggcgatgagatgctcgccggcgaaggaggaatcctgattgttcgcgcgcacggtgcccacatcggacaccgtggtggaatacaggaacagcggttgtgaagcggcggattttggcatgcggctacctcagttcgaaggtggtggcgccgatgcgcacaggaatacgagcgggcaggatggtggggcggctgatgcgctgctggttgaccacggtgccattggtggagttcaggtcttcaatggcccactgcccggagcgcgtgtcacggtagacacgggcatggtgggaagacacgaattcgtcatcgagcaccacggtattcgaggcggcgcggccaagcgtgatgtcggcttcggccagcggcacggagctgccggcaagcggaccatcgatgatgaccaacagggtaggctgcgccgaggcggcggacgacgcggaagcgctgggctggcgatgcgggcgcggcgcagctgcctgcggcgtttcggccttggccttatgcgcttcacgctcacggcgacgacgcgcgcgcgaaggtcgcggactgaacgtctcgatgtccttgcgcagcgaacgtacggccagccagatgaatatccacagcaggatcaggaatccatacttgagcagggcgaatgtcagttcggtcataagtggacgactttcgggcgtgtgctcgactactcctgggcttgggcggaggcccagtacaggatgcgggtacggccgatggtgatggtgttgccgtcgagcagcgtggcggcgggcacttggtggccctccacgtacgtgccgttggtcgaacccaggtcgcgggcgatcacgccgttatccgtgatgtcgatttccaggtgcttgcgggagatgcccggatcgtcgatgacgatatcgcaaccggaaccgcggccgattaccgtcttgtctttggtgagcaggtactggttgccgttcacctcgagcaccgggctatcctcggtctgcgcatcggtggtgaccggcacggcattgccctgcacggattcggaggtgaggttgaagttgcccttggacaggtcaaggtcttcctcgaagatcacgatcaccgggcccacgaaggcgtaatgctggctcttcgcgtactcggtgaggttatcggccagttcgttggccagggtctcgctaccccatgcctcgatacggtcgaagtcaggagtactgagcttgaaacggtattcattcggggccaccgtgcggtcacggcccacgggcatggcctcggcgtcaatctcgcgctccaaggcgctggaaagatcgacaggctgcaggtctttggagccaaacttggcgaatactccgttgactgcaccctccacgcttttttcaaaacggtcgagaacgctcatagtcctccctttctaatcttcacccatcctacgcggtgatgggaatatgagacaaaaaaccggtctttcacgtgacgatgagtgcaaaatatccaaaaattcagggcggaaatgggtgcggcgcaccacccgaggtgctttaccggtggagcacctcgggtgggatgcgcgtgttatcgatttgtcaggccagcgcgtcgcgcaggaaatcgcgctggagggtgagcaggttttcggccacggtctcgtcattggtcatatgggtgatgcccgtcaacggcaggaaggtgtgcgggcgacccgccgccatcagggcttgcgagaggcgcaggctgtgggcgatggtgacgttgtcgtcggcgaaaccgtggatcagcataagcgggcgctcgagtttcggtgcgtcctgcacgatgccgtttcggtagtagacatccgggtcgaggcccagatagcgctcggtgtagtgcgtgtcgtacagcgtccagtcggtgggcggggcgccggcgcatgcggccttgaacacgttcggcgcgtccagcacggccagtgcggacaggaagccgccgtacgaccagccgatcatgcacaccttgtcgaggtccggcatgggaatcgcctcccgctggcgggaggtggcgcgaagcgccggtgggtggttctcggcgtctgcctgatcgcccgcagccggctgtgccgcacgtgattccacatcggcgttgagccgggcgacggcctcgggcagggcgttgacggcctcgacctgatcggccagcgttacgtccttcatatcctcgaagatctcgcggtcccatgccgggccgcggccggtggtgccacggccgtctgccgtgaccaccaggaagccttggtcggcccaccactggccctcccagtagaaggactgcgaggcgatgacctgctggaagccgggcccgccgtacggcttcatcagcaccggcagcttctcggcgtgcgcgtacgggctttccgggctcggcgcgatgatcgccgtgtacagctggtgctcgcccagtcgcgtaaacgtgacgttcggtgtaaagccgggttcggccgccgtggacgcgatagtggcgctctgttctcccagaatatgccgcatctgggcgcgggcggaacgcatatcgcggccggagaccacgatgccgcgctcgccgcgcgaggcggtccactggccgggatcggtcgtgaccggcgtgatcgtgccgttgtaatcgatactcaccacgtcgaaactgcgggcgtcgtggtcgccgaatacggactcggtggcggccgcatcggcccaagcgtccggcacctcaggcgcgatttcgggcgcgcgctgcaccacggccagcacatcctcgtcggtcacggcgagcaccgtgcgcacgttccagccagccggcgtgaacgggcggccgtccattgtcagacggttggtgtccgtggccatatcgttgagcgagcacaccagacgaccatccggcgtgtaggcgggcgtgccgtgaaccaggtcgatccactgctcgttcgcgtgctcctcaagcacacgcgtggcacccagcgcggccccatccgccgcgactgccacctcaagcacctgatcgcgggtctgacggcggttctgcaccagcaccagcggatcgtggccgcgacgccagttcacggcggccacatactcgtacgcctcgcgatcccaatccacatcggcgttgccggtgatgcctgcgtaccggtcgttctcatcgaacgccagcgtgatcacggtcagatacacgtcggcattgcgggtcagcgcgcgcgggtaacggcggccggcgtccggcttctcggggtcagccggatcgctgatgtgccaggtcggctcgtcggcggtgtcgaaggactcgaacagcacgtgctgcgaatccggggcccaccagaagccgtcgtatcggtccatctcctcgccggccacgaactcggccagaccgattttccacgtgttttcggccggattgccgtcctcatcctccacgctcacgccgtagacggcggtgatgcggtcacctagttcgccgccgatatcgaccagcatcaggtagctgcccgtggtgtacagcacatgttcgccatccggggcgatgcgcgggttcagcaccggcgtgtacatcgccgggtcctcatcgagccattcgccggccagttcacgggtgtgcggctcgggtgcgccggtctcgtcattccaatcgatgtcggtcaggaacaggcggccgttgatggtgaacacgatgcgattgccgtcgtcatctgcggagtatccgacgatgccggtgccgccttcgcgcgcacgctcgcggcgggccttctcctcggccggcacgtcctcgctgtcggcggttgcgcccagcagttcgcgcgggtcggccagcttggtctcatggtgttcgccggactcgtcgaaccagctcagccacagtgcggtcaccagatcctcggggccgtcggagcgcaggaacagggcccgcgagccgtcgcccacggtctgtgcggagcgcggtgcgccgcagccgaagcgcagcgtgcgcgcccggaggcgtgggaaatgcttgattgcgtcattgacatcattggtttcgctcatacctcacaacctacgcgcctgtgcggtcagtggcgcgcaggcttgcgacgcattcccgggaatgtgtcgtggtgtgggtgcgaggtgtgggcgtgaggcttgtcctaagatgggagccatgcaggtgacgatgatcgacgaaaacaagtacgccgaaacgatgaccgacgtggtgctgcccgcgctcgaacaatgctgcgaggagggctggttcgatccgtccgccgccgaacgttcggccgggatcgagccgctgtccggcattatggacaccggcggccgctcgggccagctgcactacctgtgctacgactccgccaaattcgacgcgattcgcgagcaaggcgccaccgccaccttccgcggggccatcgtcatcagccacggcttcaccgagttcgccgaaaagtacgacgagctcgtctggtacttcctgcttgccggctactcggtgtgtgtactcgagcatcgcggccacggcaagtccgcgcgcgacgtggacaaccgctgcatggtgtggattgatgactggcagcgctacgtggccgatctggccggcttcgccgaaaccatcggccagcagtacgcggccggcatgccgctgaacctgttctgccattcgatgggcggcggcatcggcgcggccgtgttggagcgataccccaccctgttcgacaaagcggtgctctccgccccgatggtcgcccccgccaccggcatgccgctgggcgtggcccgtgtgctggtcggcgcgctgtgcggactcggcttcggcaagaagcgtgtgttcgggcagtcggacttcacgccggagttctcgatggaaggcaacgagggcgcttccgaggcgcgtgaacgctggtacttcaagctgcgttgcgagaatagcgaataccagacctactgcgcggcgttcgaatgggtgcgccaggcgttgaagctcaaccgggccatactgaatccgtccgcctgcgccgaagtggagacgccggtgctgctcttccagtccggacgcgacatctgggtactcaataagccgcagaatcacttcgtccaactggtcaaggacggcggcggcgaggcgaacatcgtgcgcttccccgaatcgcgccacgaaatcttctccatgcccaacagcacttacaagccctacctcgaaaagatcctcggcttctacgacgaccccatgattgcctgcgccgcgtactgatgtagctcttcacccattgttcaccgtgcggtcaccttgtggcccggcccgctttagatggcgggagagccatggaattatgggcataatgtcttctctccgccgccgcgccgccgtggttgcggccgcggtatgcgccggcgcgctcgcgttgaccggttgcacggcgttcaataattccgatgacggcacagcggacggcaacggcacgtccgccaccacgcagaccttccagccgtccggcggcaaaccgactgccaccctgagcattgcctccggctccgaaaacaaggaagtcgccgtcgccatccagaaagcggccgaccaatccaacgtagccgtgacgatgcactacatgggttcgctggagattatgaacgcgctcaaggccggcggccaggatcacgacgccgtctggcctgcctcctcgatgtggatttcgatgggagacaccaagcacatcgtcaaagacgcggccagcacctccaccacgccgatcgtgttcggcatcgccaaatccaaggccgtcaaactcggctgggctgacgacaccggcgccaccaagcccgtctccaccgcggacatcctcgccgcggtcagcgacggcaaactcacgttctccatgacctccgccacggtgatcgacagcgcgctcaacgtctaccagaccgcgctcaggaaacccagctggaccatttgggtggtcgattactccggttcgatgtctggagagggcaagaacggcgtggtcaaaggcctgaacgcggcgctcgacccggaccaggccaagaagtcgtacatcgagcccgccagcggcgacgtgaacattctcatcccgtttgaaaccgaggcccaccgcccggtcaaggccactggcacaagcaccagcgacctgctgcatgaggccgatgccaccgatgccagcggcggcaccgatatctatgaaggcctgctgagcgcgctcgacgagctgcccagcgagtcggaagcctcgcaatacaccaccgccatcgtgctcatgaccgacggccgctccaactccgatcatcaggatgaattcgaaagcgcctataagtcgcgcggccgtgatctgccgatcttctccatcatgttcggcgatgccgatcccagccagctgaagtctctcgccaccctgagcaacgccaaggtattcgacggccgctccggcgacctcgccgccgtcttccgccaagtcaagggcttcaactgatgctccaggtaatctgtggattcgttgtcggactgctgctcgccgggctcggtttcggactggtcggcggcggagtgcccggcctgatcgtggccgtggtactggccgcacttgggtatatcgccgcctccacgctcaccgagccggagcgacgcatcggcaaaatgctggtttccgccttgcccaacggtcagaagaccgccgatacgatcgacgcggcgaacgctcgactcaactcggtcgccatgctcaccaagcaagtacgtgacccagccgtcaaagccgaagccaacgacttcatcgccgctaccaaagatttagtgcaatacgtgacccgagacacctccgcctacccgacgttgcgccactacatcaccgtgtacggcgagcagaccgagaaactgttgcgctcctacgtggacgtggaaagttccggcgcacgcgatcagatagccacggcacgaatcgaaaccatcgaggcgctgcaagtgctcgaacagaccgccgccggcgaactcagccgggcggtaagtgccaagacgttgggcattacggccgactccgacgccatccaacggttggcccgcatggatggatacgacgacgtcgcaccttcgcctgtgccttcctcggctgctgatgaaggacggcatgcacccagtcagactccatctggcggcccggctcaccagtcggaccagaaaacggacgcacaatgaaactctccaaatcaaaaatcatcggactgatcgccctgcttgcggtagtgggcgtggtctgcggcacgctggtgtggcggcaatcgcaaccagcgccggccgaaccgaccgaacaggtgagcatcaccggctacctgggcggcgagaaaatcggcctgttcgatgacgccaagttcaaggcgctcgccgccaagcaaggcattgccatcgactatcgcaaggccggatcgctggccatgatggatgcggaccggaaaggcatggattacctgttcccctcctcgcgcgcggccgtcgaatacggcaatgcgaaaggcgtcaaggccccccccaaagcgacatcgtcttcaactcaccgattgtgctatacacgcacaaggccgtggcggacgggctcgtgaacggcggacttgtgaccaaggacgattctggcgcgtaccacatggatatggccaaagccgtggacgcgatggtcgccaacacaacatggccgacgtcggatacacggcaggctacgggcagttccgcatcgactcgaccgatccggtgaagtcgaactcaggcaacgaatacgcggcgcttcttgccacggtgctcaacggcgggcagccggccatggtcgattcggtggcgcgcgacggcaagaccatcgcctccatcttcgccaaatccggctggatggagacctcttccgaggattcgttcaaccagttcctgaccttgggcgtgggctccaagccgatgatggtgggctacgaatcgcagctgcttgatttggccgtgaaccagccggatgcgttcaagcagatcaaggacgacgtggtcatcgtctacccgacgccgaccgtgtggagcacccacacgctgatggccttggacgagaaaaggcggcacactgctgaacctgttgaaaacaccggcggtgcagaagctggcgtgggagcgccatggcttccgcgcggccaacttcgccggcaccgattcgatcagccgattcggcgtggccggcacgctcgaccagatcccggccgtatccgaactgcccaacaacgatgccatgcaacacctcatcaccaccctccaatccgcgcaagccaaactcgtggccgacatctccatgtacgacacgatgtacacgcagaacgcccagcaataccgcgagctgaaaatgaccgtactggccggcaagaaggcgctcgccgacttcaacgccaaccagctgccagcgctggaggccgaggccgccgccagtggcgacgccatgcaggcgcaagtgctgaagaacttcaagtccaagctcgaccgttttgccaagcgactcgacgacctcgaccgcatcagcgtggttaccttgcagaccgcgccgcagatcaaaatcatccagaacgcggaccagaccatcgtggacaagatcgacaccaccatctccaccacgattccggtgtggaagagtcagatggtgatcgcgctgggcctgtccaaccagcgcaaggttctcgacctgcagaacaaggccgacgatgtgaccaacaagctgctggcgcgtaacgcggccgccctgcacaagggtgcagtggacgcggaaaaggccaaccagcgttccgtggtggaaatcgacacgctggagaagatcaacgccgaactcatcgccaccctgaaggagaccgtgcagatccagaaggaaggcgaggccaaccgcgaggccgcccaggtcaagatgcgccaaatcgagtccgacctcaaaaacgccttgctcgaaaacgcccagcagatgtgagccgttcgcgcgccagcatgctcccgttggcggagtttgcgggaacgtgcaaccatgctcccgttggcagaggtatatgagtacgcctactggtgtgcgtatatatgctcccgctggcgggagctggcagccgtaagactggctgagggtggtcacggcgctcggctcggccggctttaccggcagccattcccgccgcaatttctctgtgggcataatcccggaatgattgccgcgctcgggaattggatgaagtgaaggttaaaggttgagagcccgggagggttccggaaccggccacgataaccgctgctagccccgcgatacgggttggcggccggcagccaagccgattctctcctaatcaaggagtaccgattatggcaatgtttccggctttgatgaatgacacgatgttctcggatctgttcgatgatccgttctttgagggttggcgcaacacggacaacacgatgagtgccgtaatgcccgccaacatgatgactaccgatgtgcgcgagaccgacaagggttacgacgtcgacatcgatatgcctggctttaagaaggaagatatcaaccttgagctcaacaacggctatctgaccgtgtccgcctcgcgttgcagcgagcatgaggacaaggctccggccgctgaggacgaggcttccgacagcaagtgtgcttgcgcgtccgattcgggcaagtggctgcgtcgcgaacgctacatgggctcctgctcgcgtagcttctacgttggcgaggacgtgaaggagtccgacatccacgccagctaccggaacggcacgctgtgcatccaggttccgaagatgcaggcccagccgcaagtcgagtccaagcaccaaatcgcgattgagggctgacgatacttgattcgtcccgaagtcccgcttcgagtagctttgccccctctgacgagggggctcccgcgaagcgggtgggggagagataaatcgtaaccaaaccatgcttcccacgccgtctgccctacgctttcaacgccgactaacctgacagacggcgggaaacatagccaatgcaaatgccgggtagggatttaccctacccggcattttgctgtttcaatcaccgaaccccaccctgttcgcgcgccggtcgcgtgccgttctgccgctgtacacatccgatgggtagagtgacttcgaaacgatgcgagagaggcggacatatggcgaacggcgcacagaacgcaagcggcacaccggcaccggcggcaagccgttccggcggccacgtcgtatccgcgcgcgccacgaccatcggcctgatggcaatcctgctgtggagcttcatggccggcaccgtgcgcatcgtctccgaaaacttcggcgccacgcttggctcggccctgatctacacggtcggcggcatcctgctgctgatgttccggcgcccggccccgattcgcgagttccccaagaaatacctgattatcggcggcctgttgttcgtattttacgaatcgtcgatatccctctcgctgggtctggcctctaccgacgcatcctcggtggaagtgagcctggtcaactatctgtggcccacgatgatggtgctgctgtcggcgggcgtatcccatcgcaagcacgcggtcgtcaaggtgttgccgggtgcgatcgtggccactgccggcgtggtgctggcggtcggcggcaattccgggcttgactggcatgcggccgtgcagcatatcgccaccaatcctttgccctacgcgctggcgttcgtgggcgcgcttgcctggtcggtgtacgcggtgttcacgccagccatgagtcatggggtggacggcacttcattgttcttcccctgcgtggccgtggcgctgtggattatccactttgcgtccgggcagggatggccggccgagccgccgagtctggtcgcatggctgtttgtgctgattgccgcggcggcgattggcggtggttatgcctgctggggatacggcattctgcatgggtctatggagcggctggctattgcgtcctatgccacgccggtgctgtccaccggggccagtgcggtgttgctgggtttggcgctgtcgctgccgttttggtgtggcgcgctgctggtggccgccggatcggtgctcaattacttggtcagtgcgcgcaaatagcggggtgactttgctcatggggcggtaataatcccatggggcggtaaaaccctcatggggcggtatcccaaaatgactttattctgcggtttcacaatttcttcaaaccgccccatgggccttttaccgccccatggataaattaccgcccgatgggcagcagcaacttactcgccgcggcgctcggacgggcggcgaatcgggtcaagcagcgtattcggatcggagatgccgaacatgctgcgcccgccggtggattcagggtgcttggcgagaacggccagcgaaatcgcccccggaatcataatgatcaccaaaagggccgccaatccccagttcacgaagaatccgagccccagtacgatggccaccacaaccaccaccgtgacgataatcgtcaacagtgctcgacgtgggttggtttccctggcccaagaggtgctggctgcgggttttgctgttgaactggccgcggcgtttgtggctgttgtgccatcagccgtgacggtcgtgggccttgccgccgcgctcgtcgcggggccagtaggggcgtcagacacgttatcggcggcattgccggtcgctgctggacgttgttcgtttgcgtgagtcatatccaccagcatattccctgcttccggctgaagctgggacaagcctgcgcgccgctaatccagcgctgacactggccttgagctgcggacgtccagaccggatgtgaacaggtgctgaacggagtctggggaaaccatgagaactcgcgacaatttttgtgaaattgggtgacgctctatgaatcgcgcgctagtgttgcgtgagcttacaaggcgaggagcctggagcgcgggggggtgaaggatgaagaactccgtttggaaaacgttcatggaattgtctctggtccgcggaatcgtgccacggaccgtgttcggactgaccgcgatcgcggcaatcatactggttattggactggcgctgagcaagagcaataagcgcggccgcctgcacccgctgattgtctcgctgattgccgccgtgctcgccggcgcggctggaatgctggttgcatggctggtgtccgacgtgtttatggtgtttggcgtatcgctgggctggccggtgatcttcaccatcgcgggcggcatcgccggcgtcggcttcgtgatcgccgcagccgtgaccatgcgcggagcccgccgtgtgctggccatcgtgctggtgccgctggtgctgctgtccaccgcgctcggcgtggactcgatttacggcgaataccagaccatcggcaccctcgtcggctacacgccgtacgcctcgctcggctcaatcgaggtacacaaggccgcgatgagcgtcagcgactggcgtagcaaggcgcagaagggcagcctgccgtccatgcccagccaaggcaaggtgctcaccgtcgacattccgaacgccaaatccaacttcacggcccgcaaggcgatgatctacctgccgcccgccgcgctgtccgaccgtccgccggccttgccagtgatggagctgttggccgggcagcccggtagccccagtcgcctcatcgacgccggcaacatcgccgccacgatgaatgcgtacgccgccaaacatgacgggctcgcgccgatcgtgctcgtgcccgaccagaacggcgaggccacgcacaacagcctgtgcgccgacaccacgcaaggcaacgccgaaacctacctcaccacagacgtggtgaactgggccaagaagatgctgcccgtggccaagtcggcccgcatgtgggcgatgggtgggttctcgcaaggcggcacctgcaccacgcagctcgtcccgcgtcatcccgaaatctacggcgcgatgttgccggtggacggcgaactcaagccgaccaacggcagcgtcggcaagatggtccaagagtatttcgccggcgaccgcaaggcatacgacgaacaggtgccggtcaacgccatcgcctccagcggcacatctgagcaggcgctgttcaccggtgctggcgaacgggacaaggaatcgattagcaacatgcgcacgattgccgccgccgcgcgcaaagccggcatggaggtcaccgagctgatcgtgcccggcgccggccacgactggcacgcggtgcaggcggtctggcggcccggtctcgactggtttggcgaacggaccggcttgggcgagatggcgaaatcgttgaaggagtacccacaagtggaggtgttgcaatgagcgaagaatcgcgtaagcacaacagtcatgcggcggaaagctggcgcgaactggccggcgacgtgcgacagtgggcggacggtcatcgactggccatcactgccacggtggcgctggtggtgctgaacttggtggtgtggctggtggtcgcgatggccggattcgcgttcccgctgcggctcgacaccagcatggccgaattcgatttcggcaaactcttctgcacgctgttcttggcgcgcggcgtcatccagctcattcttgatgccgtgctgtggctcgtcatgctgtcaatcgccgagccgtggcttggccgcgcacgtaccgtcggcaccgcgctcgcctgcgcgctcggcggcgtgatcgtgggcctgatcttgtgtgcggcggccggatggctgttccaggactcccaattcgtctcccgcatgcagttcgccctgagcccgctggtgttgccggtcggcgcgcttatggcggccagcgcgttctgcagccatctgttgcggcggcgtattcggctgatcggctacgtggcgattctggtcgcgctgctttacagcggcaatcctggcgattactgcattctcgccgccgcgctgatcggacacgcggtcggccgcgtgatggccgggtcgcccgcgcacgccgaaaccggatggcactggctgcgcagcacctccttcgaggcgcggcgcatgttcgcggccatcgccgtggtgctggcgctggggccggtcatcgccatcacctcgcataatcacgcggggccgctcagcacagtcggcctgctcatgagtccggtctccgtcgacgacggcacgctcgcgcgctgcctggccggcgccacgcacagcggctgcttcctgcaattcgacctgatgcgcgcctcgatgcccggcgcggtactgcgctcgctgctgcccaccgccgtgactctggtgctggcgtggggcctgtatcgcggacgtcggttcgcggccacctgcgccgtggccatcaacctgttcacggcgggcgttgccatcgcctattacctggtcgtgccgctgagctttgcgccggatggcatgacctccctgctgcagcacggcgcaatcaccgcctgcgtgacgaacaccttgccaccgctgatcttcgccatcgccttggctgcggcaatgaagcacttcccgattcgcgtcggctggcgccggctgatcggcggcgtcggcgccatcgtgctggttctgctggcgtgcgccgccgtgtacctgatgtacggcattgcccagccggacgccttctcgccgcgcgccacggcctcgtcgctgttggccgaactgccggggcgcttcctgcccatcggcttcctgagccatatgaagttgtcgttcgtgccgcgtaccccgatggcctcgatcgtgtatcagggcgtcggcctggtgttctggatcgtggtgctggtcgtggtgatccgctggatgagcgacgtgagcgaatcgaacgagcgggcgcaggcacgcgccgagcggctggtcgaaaccggcggcgaatcgatgagcttcatgactacgtgggaaggcaacagatactggctctcgcccacgggcaaatcggccgtggcatatcgcgtgctcaacggcatcgccttgacctgcaccgggccgttcggcgagccctccgagtggatggacgacctgaccggcttcacccagtattgcgtggagcggtcgctttcgccggtgttctacagcgtgcatcgcgaacagcgcgacgcgttgctggaggccggctggagctccatcgaggtcggcagcgaaatggtcgtggacccgcgcggctggaagacgaccggcaagaaatggcaggatgtgcgcaccgccatcaacaaggccaagcgcgacggcgtgaccgatgtgcagtccacgttcctggaagcgtcgctcgatgtgcgcgagcagatcgaggacatctccgaggagtgggcgcagctcaaggcgctgccggaaatgaagttcacgctcggcggtgtcgaggaactgcgcgacccgcgcgtgcggctgctttacgccatcgacgcggacgggcgcgtgctgggcgtcaccagctggctgcccacctggcgcgacgggcgcatcgtcggctggacgctggacttcatgcgccatcgcaccgacagtcccaacggcattatggagttcctgatcgcgcgcatggccgagcgcctgcgcgacgaggggcttgcggatcctgagcatgccgtggagttcatgagcctgtccgcggcacccttggccggcatgaaccccgagcgagacaatgcccgggaaggtggggtggcggccggcgaaggcacgcaggtgctccaacacgcgctgcagatcgtggccgactggatggaacccgcctacggcttccactcgctgttcaacttcaagcgcaagttccagccctccgaagcgccggtctacgtgtgctacccggacccggcggcgttgccgcagatcgggctcgcggtggtgcgcgcctacgtgcccagcgtgacgcccgccgaagtggccggcatgctcagtacgctgcggtcgtgaaggtgtgcacacgggtacgcaggctagccgattcgagcctgagacgggctatctgctttcaggaggtacatttggcctcttgcggacagctaactgccttcaaagagatacctaaactctgaaatcccgagtatgagcgttgcaatgacggcgtttgtactcggggtttcccgtattcagtacctctttgaacggagaaagcattctgcagaagcccgaatgtacctctttgagcggcgaaagcccagcgagaagggcgcagaaggcgctatctccgtttcgaggggctgatttggcctctccgggaggtctactcccgcttcgaggggctgatggccgagtattcacgctccaaaatcggcggaatggcgttgacgcggatgggcttttacatgcggtctagctgccgaccagccccttgaaacgggagtagacctcctgcgaaggccgaatcagcccctcgaaagcggttttgccggtgcagaggtgtcgttgactgcatcgcgagccgcctcgacgtagtaacgtggggcgcatgagcgaacgtaacgaacacaatgacggcaatacgcaaaccgcatacttcgccggcggctgcttctgggggctggagcgctacttccagaacgtcgacggcgtcacggacaccacggtcggctacgcgcaatccaccgtcgaatcgccggcctacgagcaggtatgcgcgggcggcacggatgcggccgaaaccgtgaaagtcgagtttaacccggcacaggtcagcctgcggacgctgacattgctgttcctggaggtcattgacccgttctccgtggaccagcagggcgaagaccgcggccggcagtaccgcactggcatgttctacacggacgagacgcagcgcgccgtgtatgtggcggccttggagcagctggtcgaccgccagccgcagcgcccggccgtactggtcgaaccgctgcgcaacttctacccggccgaggcacatcatcaggactatctggtgaacaatcccggcggctactgccatgtgccgatcgccgcaatcgcgaacgtaaaacgccgtcagaagtacgtggaacgcatctgggatctgacgcttgagcagttcgcggtcacacagaacgccgctaccgagcgcccgttcgtcaacgagtatgacgaggagtttgagcccggcatttacgtggacatcgtcagcggcgagccgctgttctcgtcgcgagacaagttcgattccggctgcggctggcccgcgttctctcgcccgattgccggtgacttgctgaccgagcatgaggaccaccgcattccgggccgcgaccgcatcgaagtgcgcacgtcggacacacagattcacttgggccacgtgttcaccgacggcccggccgaccgcggcggcctgcgctactgcatgaattccgccgccctgcgcttcgtgccgcgctcgcgcatggccgaggaaggatacggcgactggatttcggttgtggatggggatgagcaggcatgagcatggagaatattgcgggcgctcgcaagcccgccaagcgtgaggatgagcacacggtcgccggcgagcatcgcatgatgcgccgcgcgtaaccgtggcatcgccgccacgttcgtgtcgcataattgctgcccggccacgtcataattcgccgtgccgcgtgggagcgctgtggcggctacgacgagtcgatgcgcggcgacgccaccgccagtcaagccttcatggcccaccccacctacggcgacggcggaatggccgccgccgtacggttgaggagctgatggtcagccggctaaatgccgatagagctctggatcgattggccgggccaaacgcaggaccgacagggtgaccttcacactgccctgtccggttgcgtcaggcttggtggtgagctgaggattctcaaacgcagcgacgtggccaacgtagtagtacttgccatcggcctcttccgccttgcgcatgacgaatagcgggacgaaatgtgtgtggtcccaattcgggccaatgccgctaagcgcccatcggaattccggagactgcggagtgcgtccgttcttgctgaagtatttcatttcctgtgtgctcaggaattcatcctcgtattggctggccgcgtatttcacgaagatgggcatggtgttggtttccttgtcgagcaggtaaccacccacgttttgcggagtgttttccttcttccatccgcacaggcgcatgacgtcagccatggaatatttgcgctcgtacaagaacatgtggtcgaagacctgttgcctggcggcggcctcgcggaacatatctcggcaattggccataccggtgcgcaaagtgtccgcgaagaagatgcggaacgttcggttcgtggcaagtatgtcggcgaatctgctgctcaaccgatatgcggtgtcgcttcctgtgccggtgctgttcaaggtttcgaccaatggctggttgccaaaacgattgcagttcgggccggtgaaatatgaataatcgagcacgctgatcgcagagtcgaattgcgcgtctgaaccatcggccagcgggaattcagtacgaatcgcatcgagcagttcgctgcggccgattgacgagcccgcactccaatgctgaggtacgtcgtcgtcgagccgttcgctgacgaaatggcatagctgagcaagaatgaccaattcgtgcggtcgcaatccgggcagcagcagctccgctgccatcttgagtatcgcgtcttcaacgtcggtcaccggctccaactgatcctcaaatgtcgcttcatgatgtttgcctttgcccaggcttttttcacgggaacgcacgaaatcaagatagttgctgcgcttcgatgcgatggtatacggcagtgaggggtcgtagttatagatgtccgtaagcatggggatgcggcccagctcgtaacggacttggcgatactgttcggacagctttttcatgtcggaccagtcggcggtgtccaaagacttaaggatgcgctccttggcgatcgggtcgaaactgatggacgacaggccgattgactttcgctgcaggttcttgcgagccctgtcgcggtcgccagtgttgccgtataacgccaccggaatcagatagttgttgttgtaattgccgatgaaatcgataaccacaacgctttctttgtgagggaatttgcgcagtccgcgcccgagctgctgcgtgaagataatgctggattcggtgctgcgcaacatgacgatttggttgacggcgggaatatcgactccctcattgaacatatcgacagtgaagagatagtcgagttcgccttcagtgagcttgcggacgtattcgtctcgctgcgcttgggacacgggcctgccgtcatcgtccgtgctggtaacggcagcggtgcgataggggcgttcatcttgttgattccactgctggttaaacagctgggacagcttatgggcttcctcctgtcggctgcagaacacgagtccggtgaccggaatgttgaactgcccatattcctgcaacttgtcaatgatgtagcggactcgcttttcggtggcaagctgctcgatctcgtacttgagctgtttcgagtccttcgcatcaagacccttggagacatcgagacgatgggcgattccattcggatcgtcgtcggagccaaggtattccgcaacgccgtagtagtggaatggacagagcatgttctcgtccaacgccttttgcaagcgaatttcgtacgcgatgttatgcccgaatagctcgaagatgttgatgccgtcggtgcgctctggcgtggcggtcatgccgagcatgaagtcggcatctttgaaatgattgatgacgcgctgatatccttcggctccagcgtgatgaacttcgtcaaccagaacgtagtcgaattcatcggatttgaattgcgccaaaacctccggctgccgcatcgtctgtaccgtggcgaatacgtagcggcggtcctgttgcttgctggtacctgaatacaatcccaattcggattcatcacagccgagcaccttttggtaagagttcattgcggtttgaagaatcatctgctgttgggcgatgtacagcatgcgcttcggctggcattcgcgtacgtcgaatgcggaaaggtacgtctttccggtgccggtggccgacacgataattgcgcggtgctcgccttgttcacgaagtttcttgagattcgccaacgcctcctgttgcatggcgtttggctgaatgtcatgcccctcaaacgactgcagaatctcatgacgcggtggggcgtatttcttgaaatcttcctcatactgtttgatccactcttcggtcagcggaacggaatcggccacctgtgagtcgatttcatcctggaactgcccgaccagctctccatccgccagcgatgagactttgagattccattcgcgttgcgtggtcaatgcggctccagtgagattggaactgccaacgtacaggtcgtaatagggcgtaccgtctttcatgcggcgagaaaagatatatccctttggatggaatggctgtccttgagccattgcggccactgaggcattgcgggagccttcccacacgcgaacgtcaacaccagtggtgttctgaagatgcagcagctcccagaatgccctgggatcgttgaaatgatttttcgttgaggtaatcagtgtgcccgctcgggtcgctgtttcatggtgacttctgaagtcttcaaataagctgagcacggcctcagccgagacgaatgcgacagaaatgtcgaaggaatcgctagtagccaaggaattgccgatttcctcgcgcatggtcaatccaccggggcgatttgcgatgagggtcggcttatattcgccgggagcatctgagcgcggctcgatcagacctgagatgacatcttcgaggattgagggtgtcgggccaggatcactatgttgcgtgttggccggagagcttgaggtgctggccagattgatagacatgttgtcttgttcccttgcgattcgaattgtttgttgatgactgcatgactgcatggctgcgctatggcgcattcatcggagcgtcagctgtttgctggcgataatcgcgactgcttcgcgatctaccggagcccagttcaatgtcggcatatcggcaggattcagccatcggatatcagtatgctcggtgagatgcggtgtgccggcgatgaggtgacagacgaatgtagtgagccgtacggtcccaaagtcgtaggcgtattcgctggtgcacacttcttccgcgacttcaacttcgcataacagctcttcttcgatttcgcggtgtaaagcctgccgcgctgtttcatgaggttcgattttgccgccggggaattcccagtatccggccaacgacttccccggaccgcgttgtgcacatagtacggtgccgttggtgacgattgcggctcccacgacgttaatgattttgcgttccggatccatgaacaaccaggatacaacgcttcaagatccacaagcgatccacgatcctcgacagtttcgcaagaacgatcctgattcaatcggaactactggaatcgcagtgttctagggcatttgtggaacgaaaagaaaggctgatcaatggtgaatgaacggcagaccgatacgtgtgcggacgtgatgtacaggcgtgaacggcagagaggctgtggcgaagcagggctggacttcgcccctttcattccctcacaggatgaagttgatcagcagatgagcgcattggatgacaagcttgtgtccaaggctcaggaacaatacgcgaaccgagaaatctatcctttggacgagtgctatcagttggacgggtcgacgtttatctcagccgaggcgtttgaagagattcttggcgacgagcaaacgcattatatggcttggaaaaacggctgtattgataagctgtccattgattattgggagatgccggatgtgatggcctatcttgtggagcgcagcattgcggaaggtgacggcggtgaatgctgttatacggatgctcagccgattgattatgcggaagattgtgcgtactcgcccagcgagatgttggagtgcttaggcgccaattggcaagagcagggtgttgccgatgatggtttgagttacgcgttgtacgggcacccgaatatcaatgtcgagaacgtgtccggttcgatgatggtcgtatcgacggagcagcctgggctttcggtgatggttgattatcgcagcggaatttgggtggtccagccgtttgcccatgacgagtcatttgggtctgcgattcagtttggtgagcggcttgcgcccgttgaggctggccttttgcggcccaatgtctatcagcattttttggaggcgaaacatgtgtttgattacgcaatcgcgtggattgaagatgttggggaaggcgctctcgactattgtggtagccaagagaagcgatccgtttccgaggtgagattcgggagcgatccgactctcggcagtgattcatctacgcagacaagccaaaggagcctcgccatgattctcgtcaccaccaccccgtccgtcgacggatacaccatcaccaactaccagggcatcgtcttcggcgaagtggtatccggtgtgaacatgttcaaggatcttggcgcgggcctgcgcaacatgttcggcggccgcagccagggctatgaggaggagctgatgcgcgcccgcaacgaggccatcgccgagatgcagcagcgcgcggaggcgatgggcgcgcacgccgtggtcggcgtggacatcgactatgaagtgctcggtgccgacaacggtatgctgatggtcaccgcgtccggcaccgccgtgcagatcgcgcgtacggcctgagctcatcgagcacaggccaaacctgggccagaactcgtccatcaagccgcactctgtcggttatcgtgacgcattacactggcgctcatgaccatacgaatcgaagcatacgaccggctgcccgacgcggcccgcgccatacgcgagcaggtgttcatccgcgaacgcgactggcggccggaattcgatgaatgggatgccgtgtccgtgcatctgctggcgttcgattcgaacgatgcgcccaatcgccccggcctgtccgcgcaatcggcctcgtctattcagtccggccagcccgaccaacccgggcgatacatcatcgcgcgactggcggtgctgcccgaggcgcaaggcaggcacatcggctcgcggctgctggccgacgccgaacgccgcatcgcgcaagccggcggagccatggccgccgtgcactcggaaaacgaccactacaagttctacgaacagcgcggctaccggctcactgacgaggtctatgaaggcggtcgtcacggctggctggtcaaggacttgattcttggctccgagaattaagggccgctgtctgtcccgcgccgtgttcaaatcgctgcaatacagcgagttcgaagcatcctgtatgaattgctggacgactacagcgcgcagacaatcagataaatcgccacgacgtggcaggcgtacccgatgaccgtgcccaagtgaaacacctcgtggaactcgaaccagccgagaacggggttcggcttgcgcagcgcgaagcatacagcgccggcgatatacgcggcgcctccgcatgcgatgagtatggtcgcagccggacccactgcgggagccgtccatagctgcggaataagcgtcaccggcgccaatcccagcacaacatacacagtggtgaacacccagttcggggtgcgcagccagacgatatgcagtatcgtgccgatcgccgcggtcacccaaatcaccgtgagatatggccggcgaatcgccgggctgagcgcgaacagcacgggtgtgttggtgccggcgatgatgaggaagatgttcgaataatcgatgccgcacagtacgcgagtcaccttcgcgctgcgccacggcacgacgtgcagcagcgcgctgttgccgaacagcagcatggccgaggcaccgtacactgcgcaggccgctttgaccgagccggccggcgcgatgcagatgagtacgatggacgccgcgatgcacagcggcagggtggcgaggtgaagccatccgcgcagtcgcggcttgcgattgccgaatgcatccacggggacgatctggcgcttgatcgccttcagtgcggccttggcttggcggtagcgcgattgcgcggccctgtatcgggccgatgcacggtccagtgcggtggggttggcgcttgcgctggatttttgactcgcggttgcggaaggcgcaactgttgcggcggaagccatggttcgtccagatggcgtgctgatggaaacgctcatactgatcacctcgctatggccggcgacgctctcccgaccactaacctacgctaccgtaacctagtataggcccgcgcaataatcaaggttgatttcgtaatgcttacagttcttccgtggtgtggtattcggtggtgcggttgcggaatacatcgccgagtctgtgaactcgtattatgcgtgtctgctgggtccgacttgtgtcggttcctgatttcggattgctgcgaatgatgctcccgacgccgccccgccagttgccggattcgtacggctcggccgttcggccgagctggtcgtcggtgactccagatacttcgttggtttcgtctcggttcatgatgttatgtaatgctagtttatggcggatggaaagttgaggaaagttaaatctgcttcatgggcttctctctgatctgtatttgtcccggttcatatgtcaatcgtttgacctgtcgaccggggcagaatccgctgtcccggtcggcgatttcggcttgttttcgtgaaccgggacactccggtttcctcaactcatatcgtctggcagacggaatcggcggaataaggccgattctggaattggcacgttgtcccggttttcgcataaatcgattgacatttataccggggcaacaaaaattgtcccggtttgcaaagatcgcccgaaatcgcgaaccgggacagcggattctggcctggcttgaacgtcaaacgattgatgcaggtaccgggacattttccgccacgaaagttgggccataagtctcaagtcctaaagcccccctgaaaaacggcgcttgcccggacaaagcaaaagggctggaaccttccgattccagccctttagttgctggtgcgagtggggggagttgaacccccacgagcatacactcactgccacctgaagacagcgcgtctaccattccgccacactcgcagacaatcgactaacttacacccggctgggtaatcatgcaatcttcggcgtgtcgcatgggaggcagggatatatcgcttgtgggtctcctgcgggcgccgtgatctttgagggtggcggcactcccctcagtcacttcgtgacagctcgtccgcaattaaggacgggccttgcctgcaacctgctggttcgactatcgtctcaccttcgactacaacagcccactgggctgtttgcttaacgtctcagcctcagcggggggagcagagagaagttcggcacaagccgcaacgaaggagaaaaactcacaaccctggccggcgctcgccgttgccgtagaagtgggccaacgcttcgtcgcggaactcatcaaagtatccgccgtcgatcgaggcgcggatgtcgtccagcagcttcacgaagaaatgctcgttgtgaatcgtggccaacgtgaagccgttgaattcgcgggcgcgcagcaggtggtcgacgtatgcgcgcgagtagtgacggcacgtgtagcagtcgcatccttcctccagcggcccgaaatcgaacttgtgctgggcacgcttgatgttgtaccggccggcgcgcgtgtaaatcgcgccgtttcgggcgcagcgtgcgggggccacgcagtcgaaggtgtcgccgccgttctccacgcaagcgaaaatgtcgtccacagaggcgatacccagcacgtggcgtgggcggttttccggcatcgcgtcgcagatccatgcgcaggtgtcgccgatgatgcgcttctcgatcgcgccgccgatgcccacgccgtcgaagtccagagaggcgatctgcgaggccgcacgtcggcgcagatcctcgtaattcgcgccctgcaccacgccatacaacgcctgatacggcttcccgactcgatcagccgtcagccgctggtgctcgtccacgcatcggcgggcccagcggaaggtgcgctccaccgagtcctcctggtaggagcgggtgttcatcagcgtggtgagttcgtcgaacgcgaacatgatgtccgcgccgattttgtgctggatgcccatcgaaatctcagcggagaaacgatgtgcgtcaccattcaaaggcgacttgaacgtcacgccgtcctcatccacccaggccatgcgctccttgcccttggcgatgatgtcgtccgacttcatgccggtcacgtccatcgccagcgtcttcttgaagccgacgcccagcgacatcacttggaaaccgccggaatcggtgaacgtgggcccatcccagttcatgaaacgcgccaagccgccggccgcgtccagcacgtcctcgcccgggcgctcgaacaggtggaaggcgttggccagcaggcactgtgcgcctagatccttcatctgctcgggcaacacggccttcatcgcggcttgcgtgcccaccggcacgaaggcaggcgtgcgaatatcgccgtggggcgtgtgaatgatgccggtgcggccgtatcgggcaccgtctcgcccaagcccgctggccgtggatggcaggcgggtgatcgtttcgaaatggaaggcgctgcggtcgccgggctgtccgggctgtgcgcccaacggatgttcaagaaggctgatcgtcatatgttcactttaggcagaagggccagaaaagggccggaaattgtgaagaactcggtttcgaggggcggatttcgccgctcccgaacgtctacttccgcttcaaggggctcccggtcaagtaggccggctgcaaaaatggcggaatggcgttaaatgagggcccttgatactcggaattgaccgcgcgaacagccccttgaagtgcaagtagatgttcccgaaacaggaaatcagcccctcgaagccgagatgcccataagactctgcgatgattacgcatagactttcaatcaacgttcagaaaacctccagattgactgcctttactactgaggtagcacacgagaagtggcaatgggcaagtgcccgaatagccgccgaacagacgtgataggaatttaggaaaaggagcagcaatggctgacgaatttaacccgcagggcgtcgaccagaccccgcggaataacgaaaaccccaatagtactgccgataccggcaacgccgagccgaagaacccgtttgtgggtggcgactcggttgatgccggcaacgccagcgattccagcgagcagcaagccccggtttcctcggccgccctcgctgccgatcagcagcctacgcaagccgccaccgagcccatcccggactacgcctccgccaagggcgagagcacggtggtctcctcctcgccggcttctccggcagcgccggccgcagaccagacctcggccacaactccgctgtaccgcccggccccggaatacggcgcttatgggccgaccccgactcaggcacagggccagcagggcggccaggccggcaacaatgcccagcccacgcagcaattcccgttcggccagcctgcacagcaaaccccacagggccagcagggcaaccgcaacccctactacaccaataacccacagccgcagggtaacggcaatccgttcaatccgcccacgcagccgcagcagaacaacggcaacccgtttgccagccagtccggtcagaatggccagaatggccagcagccccagcagggcggtctgttcggtttcggcactcccggtaccggtacgccgaacggtcaaggtccgacccagccgggacagcccggtcagcccggccccgccaagcagggcatgtccaagacggcgagcaacatcctcatcgccgtggtcgccgccgttctggctgcggccctctgcctgggcctcggttacggcgccctcaccagcggcctgatcaccttgccgaccagcaattcgctgtccaacgtcagctcgaataagtccggctccgggtccgccaccgccaagagcggcgaagcccccgactggcagaccgtcgccagcgatgtctccggctccgtggtctccatccagaccgcgttgagcaacggcaccgccaagggctccggcgccatcatcgacaccgaaggccacatcatcaccaacaaccacgtgatctccggcgcccagcagattcaggtgacgcttgccaacggcaacatgtattccgccacgctcgtcggcaccgacaccaccaccgatcttgcggtcatcaagctcgacaacccgccgagcgacctcaaggccgtgaaattcgccgattccgacaagctcgccgtcggcgagaacgtgatggccatcggcaacccgctcggctacgacgacaccgccaccaccggcatcgtctccgccctgaaccgcccggtgaccgtgaccgacgataacaacaacgagatcgtcaccaacgccgtccagatcgacgcggccatcaaccccggcaactccggcggcccgaccttcaacgcggccggccaggtgatcggcatcaactcctcgatcgcctccaccgccacctcctccgactccgccggctccatcggcatcggcttcgccatcccgtccaacctcgtcaagcgtgtggccgacgaaatcatcaaggacggcaaggtcaagcacgttgccctcggcgtggtcatcaagtccgacacggttgaagccgacggcgtgacccgcggcggcgcgaccatcaccaagtccagcgccaccggcagcgcggtcgtctccggcgtcccggccgacaaggccggcctcaaggagggcgacaccatcgtggccttcaacggcaacgccgtgaacaacaactactcgctgcttggttacgttcgtgccgcggctttgggagacaaggtgacgctgaccatcgtgcgcgacggcaagaccatggatgtggacgtgacgctcgatcaggaggagtcgtcggtgaacggttcgtccagctcagattccaacggcaacagccagaataaccagaacaaccagaacggcaatggccagaacggttacggcaatggcaatggcaacagcgatggcggcaccggtgacggcggcggcttctccgacccgttcggcctgtggtaaagccgacccaacaacgtcacacggtgttgagcggtaaccgctgaacaccgtgtcagacaagcaaaggcccgtggcagtgagcaaactcctgccacgggcctttcgtatgcgcgattgtgccccgcgcccatgccgccaacgcagtttcgatatccggcatgtcgcgcaacgctcgttgatagggtaggccaagcactgagttcgggcgacgtcctgaacacagcgcataattcaatacaaaactgaatacatttctttacgccgtgtatcggaaggttgcgcgggagccgagcaaagcgaagccccaggcaaagccgccggtgggttaacaaggcgtgaccgtagcgccgattgcgcgggccacgcttgccgtaccgcaatcgactccgtatacgagcgtaaggagcaatgatgggcgcactcatcagattcttcaccaaaattctcgacatctgcaagcttgtgccgatgcttccggtcgtcgtcatcgccgcaattccgttggctttactaggcgattggcgtccgtggggcaatgcgatggcgattccggtactcggcaatccgggcttcggccagtggctggttatcgcactggtgctgattatcgtgattgacactgtgcgcggcatgattgacgatttgcgtcatgggcaggttggagtcgatgtgctggccgtggtcgcgatcctctccaccgtggccgtcgccgaatactgggcaagttgggcggtgacgctgatgatcacgtccggcgaggccattgaggaatacgcccaagccaaggccgagcgcagtctgaccgcgcttatggaagccgcgccgcagaccgcacacgtcgtcaacctgcctggtgtggggtgtgggtttgctaccgataagggcgattcgtccgatggcttccggcgtgtgggcttggcgtcggctgcggccgccgcgcaccgcttcgacacggtgccggtcgagcaggtgcagctgggcgatgtactcatggtgctgccgggcgaaactgtgccggttgacggtgagctgctgtccggcacggccacgctcgacctgagcaatatcaacggtgagccggtgccgcgtgaagtgttcgccggcgcccgcgtgatgtccggcgcggtgaacggctcgactgcattgaccatgcgtgccacccaggtggccgccgattcgcagtaccagcgcatcctcgagctcgtggcctccgcgcaggagtcgcgcccggccgtggtaaaaaccgccgaccgcttggctgtgccctttaccgtgctctcgctgatgattgccggcatcgcatgggcgatgtccggggtgccgacgcgattcgcccaggtgctggtgctggccacgccctgcccgctgctcatcgccgcaccggtggcgtacatcgccggaaccggacgcctcgccgcagccggcgtgcttatcaaagcgcaggacgtgctggaaaaccttggccgcgtcacgcaggtgttcttcgacaagaccggtacgctcaccgtcaagcagccgcaggtcgtgcgcgtcgagatgctgcccggtgccgcaacccgtctcaacgaagaccatgtgctgatgatggccggcgtggtggaaagctactcggtgcacatcctgtccaaaggcatcgccaaggccggaacggaggcgatggcccgattgcgccagcggttcgaggatggtcagcggctctgccccgagccggaggccagctggcccggccatggacgggagtatccggtcatcaagaatatcaatgaagatgccggcaaaggcgtttccggcgaggtgaacggacatgcggtgcgcgttggccggctgtctttcgcggctgctggggaggatggattcctggcggtcggcgaggctgcccccctcagcccgcgaagcggccagctccccctaagagggggagctcagcaaaaagatgacctgcgcactcgctttggcctgctgcagccggatgagatggcgtcctacgtgtccgttgacggccggctgatcgcgcgcatcgtgctgcgcgatgtgccgcgtgccaacgccaaggcagtgctcgccaaactgcatgagttgggcgtcaccgagctcgccatgcttaccggtgacaagcgggcttccgccaatatcattgccagcgaagtcggcattgacgaggttcacgccgaactgttcccggaggataaggtagccgcagtcagggccgctacaggagccggcaaaaccgtcacgatgatggttggtgacggtgtgaatgatgccccggtgctcgctgttgccgatatcggcgtggccatgaccgatggcacgtccaccgccgcttccgaaagcgctcaggtggtcattatgaatgacaatatcgccgccgtgccgcgcgccatcgccattgcacgccgcaccaagcgcgtgatgcttcaagccgtaatcgcgggccttgtgcttgccaccatcggcatgattgccgccgcgttcaaccttatcccggtcgtcgtcggtgccttcctccaggaggccatcgacgtggtgagcatcctctgggccctcactgccctaattgatcgggattgattaagataaaccggaattgattggagccgcatccggattatgtgcaatataacaagttgatatcaatattttgtgtgtgcttaccggatgcgggcgccgtaggtggcagtctattagactaaaggctgtttgcagcatcatttaggggcattgaggcccttgccagaggagtcgatatgtcagagggtgaggaagagctcaatgtgggcgcagtccgtttggaggaagtggcatcggcggctaatgtatcgctgtccactgcgtccaaggccttgcgtggaaagcctcacgtcagcgagaaaacccgtattcgagtgattgatgctgcgcagaggttgggctatagcgctgcagaagctatggcatcgatggcaaggttaagcgtcagggattctcacggcgtgcaggattttcgcgttggcatcattggcgttgatatgaaaggcgtcttttccccgaccattcttattggagcggagaatgcgtttcaagcgcgctcagccgcagcgctgctgttcaatgcgtcaggcaatgaggcattgttccacagtggtattgaacgaatgttggtgcaaggagtgtcgggactgttgattatcagcaggcgtacggatccggtgccatactacgtggattctccggtacctgtggtctacgcctatggcccgtcccgtgatcccgatgattgttccgtggcacaagacaatgtggaatcagggtgtttggccgttcgccaccttctttcctgcgggcgcactcgtattgcgattattgctggcgactccgagtgctcggttgcacatgaacggatgcggggtgcgctcaaggccttgcatgatgctggattacagttggttggcgaagcgcggttcggttcatgggaagcggaatgggggcgcgccgctgcccgtctgctgctcaatgacggtgctgcattcgacgcagtgatatgccaaaacgatgtgttggctcgtggctgcatcgaggaattggaacgtagcggatgtcgcgtgccgcaagacgtagcggttatcgggcacgacaacagtccggattatgtgtcgtacgcgcatccgttgcttacttctattgatgacaacaacgaaatgctggggcgtcaagctgccctatgtctactggatgcgattgcggggcatcctcaccatggtgtggagcgtgtgccggtgaagctaatccaacgcgagtcaacgttgccgttggattgataacgtcaccggataggcggcagcagccggtttacatcttgcgtggcatcatccagacctttgcgaatatcattgatgccggaatcctgtacaaggccgtgaacgtcgatgttgctttgttcgctcaacgcttggccgcgtacgcgcatgctatggataaatcgtccgaccttgcgtgcgtagtcgggcagcttgtcggggcctaccagcactaaagcgatgacaagaatcaccatgagttccgtgcccgaaatgccgaacaacatattattctccttctgcagttattgttgcaggggcttcctgtttgccggtgcgcttggctttgcgcgccgcgcgaaatggtaacgcggcgcgcattttatgtaaaagtttgagaagtttgggttcttcgcccgccgcgcgcatgactttccatagctggatgtgctcgtatactgcgcatacggctatggctgcgaaatagattgcgatgatgggcaaagcgagtgcgcataatgttcctgggtcgccggttggcgtggccacggccgcgaagataaacgctatgaccgttgcgagacgccactgcttcaaccatgttcgtgtttcgaccgcattcatcatcgtcaatgccgccataactacgggtagcaggaatgagaggccgaaagcgactgtcatgcgcagaatgaaatcaaaatagacgtcggcgctgagcaatgtggcggtgtttgcgggggcaaagccggtaaggatcgccaccgcttggggcagcagataccatgccagtccggctccggtgaggaacagcggcactgaggctccgatgaatgtaaccgcggtccagcgctctttgcgcttcaaccctggattaatgaatgcccacacttggtatgaccaccacgggcaggaggccgtcagaccaaggaagaacgcaatctccagctttacgttgaatgcggagaccacgccattgaatgtgatgctcatcagtccctgttgctgcccggccgccgtcaggaacggttgttgcaggatacgaaacacctgatcgctgaacatccatcccactatcgacatgatgatgatgccggcaatggcccgaacaaagcgtttgcgaaattcgacaagatgatcggccagaggcatcaccgcatcggggttgcggggcttgcgcgttttggacttgcgccctacaccccgcttccaccggcgtgtagggtgttgcgcacccgcgctggcctgctgcgtggcctcgtgtgagtgatcgatgagatcgtcgaggtcaagatgtgtatcccgatcgccgggatgcatcgccggtgcaaggggtgccggaagcgcggggtttccgggaaccgtgctcatcgctgttcggctccggttgctgtagtcggggcggcggtggcgttcatcgtgacggcttggggtacggcgggagcgggagccggtgctgccgccggagctggggcaggggcgtcgctgactgtattgacggtttgttgtgttgccgggtcatcggtcttggtctcggcacggaaaatcttcatcgattggccaatgcttttggctagctcagggagcttcttcgcgccaaacagcagcacgatgataagtagaatgataatgagctcggtggggcgaagattaggcatgatagtatgtccttccaatttctgtgttgtgacaggggaagggtatacctcattaacgcaccaatttatcagtatagcgaggaatggtgtgttgttcaagttgaagtgcggtgttgcgtttgagctgcttgtgagagttgctcgggaacatgttaatttgaatgcatttactgtgttattggtgagcatatgtgtttgggttcgttggttttcgcaagaggaaaacaaaaggaaaattacgaaaatagcatggctggaaatgctgataaagactgattttcattggtattgtgcgctacgaaaaccagagaaaaaatgagtgagtcgctttctttgacgcatggtgagaatcgtctgtttgagttattgtgaacgtgcacaacgaagacaagcggcatggagggcgcgcaaaaactcgaataatcgcatatggtaactgtttgctttaccgtcatctctcccatacatacatgacgacggggacgcaccacaatgatgtgatggtaaaacgggcagtaccagacgattccgagtatgtgtgtgccatccactgacgcatcttacctgcgtcgtcgggccattgaatggattaagtgcattgaatggttgcgaatgcggcagagtgtcttcgtccgtcatgcctcgcaatgaacgcgcggcagtccaacgaaggagcaagatgagttcaacggaagcaacaaacggcatctctcgccgtgctgtgctcgcaggcgcggccgccatcggcggcaccatcgccgtggcgagtgcattgggtacaggagtgacaacggtgcaggcagcgccatccgtcgctggcacggcaggtgcaacgggcgcgaacggcgcgggcggcgtggccgttcccgcagcgcagcgcaccacgaaaagcgcgaagaccattaccgacgcgcccgctctgccgggctggaaggtagctccgttccctctgcggaacgtcgccatcacctcgaacagcgtgttcgatcgtgccaaggaagggatgctcgactatgcacgcaactatccggtagaccgctggctggtttgcttccgtgcgcaggcgaacctgctgcctaaggacaacacgacgcagccttccggtggctgggagaacttccccagcggctcgctagacaaggctgttgaacagcaatggggcgatgccgaatacacgcgtggccagaacaagaacggtgctgatggtctgttgcgcggccactttgccggacatgcattgcacatgctctcccaagcgtatgccgaaacgggggaggaagcgattctcaacaagatcaacgagttcgtctccggcctgaaggaatgccgagattccctgcgcgagatgaagtataacggcaaagcccgctacagccaccccggcttccttgccgcctacggcgagtggcagttcaaggcattggaggaatatgctccctatggcgagatttgggcaccgtggtacacggagcacaagattcttgccggtctgattgccgcttacgagtttgccggtaatgccgacgcgctcgacctggctgaaggcatcggacattggacctatgcgcgtctgagcaaatgcaccaaaacccagctgcagaagatgtgggacatctacatcggtggtgaatacggcggcatgaatgattcgctggtggatttgtacaacgtctccaaggacaaggaccgtagcgaatttcttaaggcctccgcatttttcgacactgacaagctcattgacaactgtggtgctggtgtcgatatcctcaacaacttgcacgccaaccagcacattccacagttcgtcggttacgccaaagacgcggccatgggcgacgcggatatcgatgctgatgctcgtgcgcgttatctcaaggccgttgaggggtactggggcatgattgtgcccggccgtatgtatgctcacggtggtactggcgaaggcgagatgtgggggccggcacatactgtggccggcgatatcggcaagcgcaacgcggaatcctgcgcggcatacaacatgctcaaggtggctcgctatctgttctttatcgaacaaaaacctgcctacatggactattatgagcgcacgattctcaaccatattctcggaggtaagtcccgtgacctcgattccggcacggccctcacgccgggcaactgctacatgtacccagtgaatccggctacgcagaaggaatatggtgatggcaacatcggcacttgctgtggcggcaccgctctggaaagccactcgaagtaccaggattccatctacttccactcgacggacaacaaggaactgtacgtcaatctgttcacagcttccacactcgactggaccgacaccggcctgaagctcgcacaggaaaccaactatccggaggaggagacctcgacgatttccattacggccgcgccgaagagcgccgtcaccttccgcatccgcatccccgcgtggagcaaaggtgcgaagatcgaggtgaacggcaaggctatagatggcgtcaccgctggcgaatacgccaccgtggccggcagctggaaggtcggggacaagatcgtcgtcaccatcccgctgcagctgcgcaccgagtcgactgatgaccgcaaggacatccagacgctgttctacggtcccacggtgctcaacgcgctcaacccatccaccaagttcatccaacgcggcttctacgagcgcaacggcttggatggcaccatcaaactgggcgtacagaagaaggaaggcacgaagaactacttcatcattgacggcgacgagttcgagcccgcctacaacggcgacaacaccccgtaccacatgtacttccagcgcaaggacgagtatgtgggcttcgcaggcaagctcaccgatgtgctgaacccgaagcgcccggctgcacaggaccgtagcgagagcacgctgatggatgacatctgggcgggcgcgccgttcaaggaccgtgccgccttcatcaagaaggtgcaggaggtcacgaagacctatcaagacgaggggctgctttccagtcgtgatcgtcaggtggttctgcttgcctccgctcgcgccaagatgagctgacgttttcctgcgaccaaaccgtctcccgtagtgcacgacacggcgggagatgagtgatacaaaccataacgcctaacagaaagaatattatgaccatcgaaagcactacttcggccgtgaagggcggtgtggcgaaacgattcgccgcactgttcgtagctgcggccacgctgctggctggcggtgtcttctccgtatcggccgcgccgagtgcactggcggacgacgctgaaacgaatgttgcgctcaatgcagaaaaaggcaacgacaatgcaccagacgttcaggtcagctatgtcactggctggaacagcactgctgccatcaatgacgatagcttggacggcaacgccagctatggcggttggggcacttggggcaacaccagtgccagcgaaactgccacttacacatggaatcgcgccgtgaccacgtccaagtctgtgggctactactggacgaacgtcaagaccggtgatggtggcgtgccgctgcccaaggatgtctcgattgagtatctcaatgctgattccggccagtacgagaccgtgccgaacctgaaggtggacaagacattccccgccgacgacgagctcgacgccaccaacccggtgtatggtccgtatacctacaccttcgaccaggtcaccaccaagtccatgaagcttgtggtgaacaagaaggccaatgacaacaagggtattaccgtcactgagtggcaggtgtttggtaccagcgctgcactaccagtggatccgggcgacccaggtgctttcttagacgtgcagcaagttgccgtgcgcaccacgccgggcgtggacccgacctcgaagttgcctgcagaagtgtgggcgacacctcaagatggtcccagcattaaggttccagtgacttgggaaaccgttccggccgacgcttatgctacagctggtactaccgccgaagtcaagggcactactgctgccggtacctatgacaacatcaaagttgcggccggtcaggcgacggccactattggtgtctacgaccagctcaacaccgaggtgaccgacgcggagtacgtctccaccatcaccgctcccggtgtcaagccggtattgcaggataccgtggcgctgacctacgctgacggctcggtcgagtcgggtcacaaagtgacttgggacagtatcccggccgccgagtatgctgaagtcgaacaggtcggcttcgtggaaggctctatcgagggtgtcggcaatatcaaggcggaaggcacgttcttcgtcgtcgcgccttccgacccgaaagcccagccgattgttgctatcgatttcgactccgcggcccccggctccggctggtacaccactgccccgaagttcaccatcaccgcgcagcgcggcgtctccaccgtgccgataaagacgatcgagtacaagatcggcaagggcgagtggaccagtggcaagggcccgatcagcgtgaccgcgcagggttccgtgaccatttccgcccgtgccaccgatgaaaacgacaacagccgcgaggtctcccagaccatcaaggtcgacaccaacgtgccggtggtcaccgctaagcaggagagcaagaacggcaacgatgtggtcgtctctctcaccgctgatgacggtgccgcaggctccggcgtgacccgtgtgctgtactccaccggcccgtccagcaacccgaagtccaacgagaacacgatgtggggcacctacaccgacgaggacaaggtgaaggtgcagctctccgctgaccacgacacttacgtgcacttctatgcgcaggatgccgccggaaatgagtccgactacgccaacatcaatctcggcaagggcgaagccgtgaccccgaccccgactccgtctgtggattccgttgccgtctccggtgatggtgtcaaggatggcaagctggcgctggtcgctggtgatactgcccagttgtcggccgaggtgaaggtgaccggtgatgcggccaagaccgtggcctggaagtcctccgacgcgaaggtcgctactgtggacaaggatggcaaggtgaccgccgttgccgaaggtacggcgaccatcaccgccacctccacggttgacgagaacaagtccgcgtccgtcgaagtcacggtaactaagcccgaggctccggttccgcctgccaccgatgaggagcgcaagcctcttaccgacaagatcgccgctgttgagagtgagaagctcaaccagaacgactacacggctgattcgtggaaggcatatgcggatgcacttgctgccgcaaagcaggtagtcaaggatccggccgcaaccgcaccgcaggtgaccgctgcgctcaacaaactcactgccgcacacgatggtctcgccaagaaggatagcggcgaaaagcctgaaccgcagaagcccggtcagcagaagcctgggcaaaaccagaagcctgaccagcagcagaagaacgctactaccactgcccccacgggtagtgcggtggctgccgttgctgcggccgtagttgtgctcggcgcggctggcgccggtctggttatctggcgcaagcgccgtgcctgacgtgaggctattgcccctaggctaataacaacccaataattgaatacaggtcttatacctgaagttgatctgcgtcgcactggcttgaacccgaatcgatgttcgggctaagcctgtgcggcgcatttcgttgcggctgtgttgctcataatccggtatcggagttattcattaggtcggtttgacgtttattaggtcggtccttggtcggagcggcccttgaaaccccgccgttccaagggatggcttcagcaccctccgacctaatgaacgaagaaatgacctaatgaatgcaatcgaggtcgtaaagagccgttggaggtgacgtcttcagtgtcatcaagggattcgccggttgtgcagtattgttattgttctgcggcggctctttaccgtcggccttctagccaatcgagggcggaagtgacgcggattccttgtgagacataactatgttcaacccgactggttacgtactgttgctcacacggtataccgagaacattgccaattaaagtgaggtgccgagcgaatcggtcatgataggtttgtccggatttgatttctatgagcatacggttgttaggatcggtgaaatccaacaaatccacctcgaccttgctggcatcgcggtagaagaataattgtggctcctgattggcgttcaaatgctgtttcatggtttccgcaatgatgaggttttcaaatatatcgccgaacttggggtgcgcaaccagtgcttcgaccgtccgaatgcccaagagatggcacagcaagccagtgtcataaaaatagagtttcggcgttttgaccacctgtttgcgtgcgttcgtgtagaacggtatgagatggaatgcgatgtaacttgattccagaatcgacatccatgcctttacggttcgcggacttacaccaagttcattggcgatgttggtgtagtttatgagtgctccggaactgagtgcgcaaagagtcaagaatcggcggaagtcagccaaattgcgtacatcaagatattcggaaacatcacgttcgatataagtgtcgatgtagttcgagaagaacagattgagcggcattctcgtgtcgtaaatgcgtggataaccgccttgcagcataaacgtatccggagtaagggcctgatccgccttgcatgcttcttggaatgagaacggcaataacttgaccaaaccgactcggcctgccagtgattgttgaatacgcttgagtagtaggaaattttgagaaccagagagaacatattgtccttgttcgctacgttcgtcggaagccacttgaatcatggagaacaaatcaggagcatattgagcttcatccactatgagcttggaaggacgctgccgaatgaatcccaccgggtcgtcaatggcggctttgcgtgtctcaggattttccagattcacgtagtcataatcagggaacatggcttttgccagcgtggatttgccgctttgccgaggcccggtaatagagaccacgggaaaccattgcgcaagttgtttggcctgtttcccgagcgcgcgtggaatcatcgatgcctctttcccataatccgacattactgattatcataatcttacattagagaaacccataatcctacattagggaaacccataatctgacattagcagtgctcgtaggtttcccaaacgcacaaactatggcctaatacacagaattcccaccaccctccctctgtcgcaacggaaggctttgcgttaggctagagcgcgtgactgaatccgtgaatactgaactccgcattgctgttatcggcgctggcccggccggcgtctactcatccgatatcttcctgcgccagctcaagaagctgggcgaagaacttggcctcggcaccgaagcgcgcatcgacctgttcgagaagctgccggtgccgttcggcctggtgcgttacggtgtggccccggaccacccgtccatcaagttcatcgcctccgcgcttgagaagacgctcgacaacccgaacatccacctctactgcgacgtggaattcggcaaggacgtgactcttgacgacctgttggcccgttacgacgccgtgctgttcgccaccggcgcggtcaaggacaagccgctgaacctgcccggtgccgaccttgaaggcgtgtacggcgccgccaagttcgtcgaatggtatgacggctaccccaccggtgcccgcgaatggccgcttacggccgagaacgtcgccgtaatcggcggcggcaacgtggccatggacgtggcccgcgaactcatgcgcaacgccgacgacctcaaggtcaagaccgacattccggacaacgtgtacgagggcatcggccagaacaaggccaaggtgctccacctgttcatccgccgtggcgtggcccaggccaagttcagcgtgcaggaactgcgcgagatggagaagctgcccggcgtgcagctcatcatcaacgaggacgacttcgatctggacgacgagaccatcgaggtggccggcaaggacaagctcacccgccagatggtcgaggagctgttcgccgtccgcgagatggccgaagacatggaagatgacggcgacgtcgacttcgaaggcaacccggccgaccgcaagtactacgtgcacttcaactccgcccccaccgagatcctcggcgaggacggcaaggtcaaggccatccgcgtggagcgcaccgaaaccggtgccgacggcaagatgcaccgcaccggcgagttcaccgactacccggtcgaggccgtctaccacgccatcggctacaagcccgccgaagctcccggtatcacctacgacgagcacggcgcccacctggccaacgccaacggcgacggccgcatcaccaccgaggccgacggcggcaaagtgcgcgaccgcctgtacgccaccggttgggccaagcgcggcccggtgggcctgatcggctccaccaagtccgatgcgctcgccatcgtgaccaacatgctcgaggatctggccaaggccgctgaaggtggccgtgtggcagccgaccgcgaccccgaatccatcgaccgactgctggccgagcgcggcattcgcccgatcgacttcgccggctggaagaaggtcgacgctttcgagcgcgccgagggtgccaaggaaggccgcgagcacaagaaggtcatcgagcccgaccagatgcgcgagctcgcccacgcctgacggcccgcccacgcccgtctggcattcgtccacccagccgcgccccgtgcggacgcggccgggctcggggccggacgggccgggcgaatatgggacattgcgcgtggcgcatatccagcaatcattcagcctgcgattttagtgtgtgcattatggatgccaaagtacgggtgcacggccatttcaacggcctgaaaacaacgctgctgtttgccctgatgtgggccatcatcatgctgatttggtgggccacgggcggcagtcggcaaaccctgagcatctatatcgtcatcggcctgattaccacgttcggcacctactggttctccgacaaactcgccatcgcctccatgggcgcgcgggaagtcagcgagcaggaagccccggagatctaccagattgtgcgtgaactgagcgccaaggccggcaagccgatgcctcgcatctacatcgcccccaccatgagcccgaacgccttcgccaccgggcgcaacgaacggcacgcggccgtctgctgtacccaaggcatcctgcagattctcaacgcccgtgaactgcgtggtgtgctgggccacgaacttatgcacgtgtacaaccacgacatcctgacttccgccatcgcctctgccatggccactgtcatctcctaccttggctattcgctgatgtatttcggtggcggctcgcgagacgaccgcgatagttccggtggcctcggcctgatcggcgcattgctgagcgtgattctcgcgccgattgccgcgtctttgatccagatggccatctcccgcacccgcgaatacgacgccgatgaagacggcagcttgctcaccggcgatcccgaggccctggcttccgcgctgaacaagatttcctacggcgcacagaccgcgccgatgcgcaaaaccgccggcacccagtccgtctccgcaatgatgatcgccaacccgttctccgcggtcggtttctcgcgcttgttctccacgcacccgccgaccgatgagcgcatagcgcgtctcatgcagatggccaacgaaatgaacggcacgccgatcgctccgcccacctactccacgcgcgtcggcaggtgacgtgctaggataactattcgtgcctcgtttggctgagcatgctcgtcacgtgaggtgcagcagccgtaaggcatgcggacatagttcatcggtagaatgaaagcttcccaagctttagaggcgggttcgactcccgttgtccgctccattgattttcaatgattttcattatttccgggaaagtgtcgcgcacgatcgcaaaactacgcgctatttgagcgctttgcccgcggaacccagctgccggcaagcctcgaccacgcgggcggacatggaatcctcagccttacggccccaagaacgcggatcgtagaacttcttctcgcccacttcgccgtcgatcttcagcaccttgtcgtagttctcgaacacgtggtcggcgattggacgggtgaaggcgtactgggtatcggtgtcgatgttcatcttgatcacgccgtagcttacagcttcggcgatttcttccgggcgtgaaccggagccgccgtggaacaccagctcaaacggcttgccgttggggaaatcgactatgccggccgcgctaggcaactcgccttcggccaccgcgcgcgccacacgcgcctgaatgtcgccgagtagcgacggacgcagcttgaccacgccgggcttgtaggcaccatgcacattgccgaatgtgaaagcggccatgtaccggccacgttcgcccaaacccagtcggcgggcgacttcgaggccatcttccggagtggaatacagcttttcattgatttcggcggagtgaccgtcttcctcaccgccgaccgcgccgatttcgatttcgagcacggtgtgcgccttctgcgacttgtcgagcagttcctcggcgatgtccagattttccttgagcggcacggtggagccatcccacatatgcgactggaatgtaggctcctggcctcgtgccacctgatcggcctcatgcgcgagcagaggacgcacccactcatccagatactgcttggcgcagtgatcggtgtgcagagcgatggtgatgttcgggtatttcgcagccacttcatgtgcgaaagccgccagcgccagcgagccggtaacgcgatcattgacccccctgccggagacgtaggccgcgcctcccacggaaatctggatgatgccgtcggactcggcgtctgcgaagcccttcaacgcagcattcagtgtctgtgagctggttacgttgatggctggataggcgtaaccgcctcggcgggcggcctcgagcatttcggtatagcgttccggtgttgcgatcgtcatggcttcattatcgcgcgaggcatgccctctaggctccgttcttcaacctgtgcgctgtgcgattggtcacagcatcgcctcgtacgagtagaaattcgtcacccattccgggttgtcgcacctccagcctcgccctgcgtgagacgaaacttcgcagggtagagggtgtacggtagtctgtttccggcggaatcgtgcgaatgcggaggtgcatcatgcctggaattgttcttattggtgctcagtggggcgacgagggtaaaggcaaggctaccgatttgatcggcaccaaggtcgattacgtcgcgcgcttcaacggcggcaacaacgcgggccatagcgtggtggtcggcgatgagtcgtacgccctgcacctgctgccttccggtattatcaacccgaacctgaccccggtgatcggcaacggcgtggtcgtggacccggaagtgctcttcgaggagattgacggcctggaatcccgcggcatcgattgctcccacctcaaggtgagcgaggccgcacacatcatcgcgccctaccaccgcacactcgacaaggtgaccgaacgcttccttggcaagcacaagatcggcaccaccggccgtggcatcggcccggcctacgcggacaagatcaaccgtgtcggcatccgcgtgcatgacctgttcaacgccgaccatctgcacgacaaggtggaggccagcctacaccagaagaaccagatgctggtcaagctctacaaccgtcgtccgattgacgtggaccagaccaccgaggagctgctgaagctcggcgaacgcctcaagccgtacgtggccaacaccggcctgattctcaacaaggcgcttgacgaaggcaagaccgtactgttcgaaggcgctcaggccaccatgcttgacgtggaccacggcacctacccgttcgtcacctcttccaacccgaccgccggcggcgcctgcaccggtaccggcgtgggccccaccaagatcacccgcgtagtcggcgtctccaaggcctacgtcactcgcgtgggcgaaggcccattccccaccgaactgctggacgagtccggcgaatggctgcgtcagcagggccacgaattcggcgtgaccaccggccgcccgcgtcgctgtggctggttcgatgcagtcgtcaaccggtacgcctcccaggtcaacggcctgaccgacatcgtgctcaccaagctcgacgtgctcgccggcctgaaggagattccgatctgcgtggcttacgacgtggacggcgaacgtcacgacgatatgccgactgatcaggccgctttcgccgcagccaagccgatttacgagaccatgcccggctgggatgaagacatctccaactgccactccttcgacgagctgcctgccacctgccaggcctacgtcaagcgtttggaagagctgagcggctgccgtatctccgcgatcggcaccggtccgcagcgcgatcatgtcatccagatcaattcgctggtcgactgaccgtctgcaacgaatttcccggcttgactggtaacgacgcggcacatgatatccgccggctgattccgcgattcgaccacttgaagtggaagatggcggcggccggcatagtcattggtctggtttcaggattgctggttgtcgtataccgtctcggcatcgaatacggcacggatgcgtcccgttggatatatgcgcggattcgcgagaccccgtggctgattgcgccgtgggcggttgccgcggtggcggccgcgctggcgatcgcgtggatggtcggcaaggagccgatggctggtggcagcggcatcccgcagaccaacggcgtggtgatatgcggcttgaagatgcgttggcagacgattctgccagtccgtttcgtcggtggactgttgggcgcgttgtttggtctgtcgctcggccgtgaggggccgtccattcagattggtgcgtcgggcgcgcagtgtgtgtcccaccgtttgcgcggccgccgccgtgaggacatgcaggagcattatctggtcaccgccggtgccgcggccggcttgtccgccgcgttcagcgcgccgctgtccggcatgatgttcgctttggaaggggtgcatcggagtttttcccctgcgattctgatgggcgccaccgccgcatcgctgaccgccgatttcgtctcaaaatactgtttcggtctgcgtccggttttggatttcggtgatatcggtcagctgtcgttggaagagtatgtgtggctgattccgttgggattggtggccggtttggttggttcgctgatgaaccgctcgttgcttggcttccagacgctgtacggcaaactgccggcatggagccgcccgatgattgcgattgcgatcgcgttgcctgtcggcatctggttgcccgatgtgctcggcggcggctcgaatctgattgataccgccgaacatgcgcgcgtcggcttgggaatgctgtgtctgctgttcgtggcgaagatgctgttcacatccacgagtttcggctcaggcgcgcctggcggtattttcatgccgattcttgcggtcggttcgttggccggcggcatctgcggtgaagtgttgcatcgattcggtgatctgccatccgacgcagtggcggtgtttgcggtgtgcgtgatgacgggcacgctcgccgcgtccgtgaaaacgccgatcacgtcgattctgttggctgtggagatgtctggaacgttgacgcacatgctgccggtcgcggccgtcgctttcgtcgcgctgttggtgtccgatttgctgcgcaccaaaccgatttatggggagttgctggagcggtacgtgcgcgcgcaaggcatgcagatggcgatcgcaagccatgtgggcagcggcattatggaactgccattggaaatgggagcgattgcggacggcaagcgggtgtgtgacgtgcgttggccgtctgggtgcctgatcatcggcctgcgtcgcggcgaaagcgagatcgtgccgcgcggcgatacacggctgcgtgccggcgactatctggtggtgctgttcagtggcgaggaggagcgcgaggtgcgacctgcgatgcggcggctgtgtgatgcccggcttgactgagcctggctgaattcggctggactctggatgtacgaatctgcggaatcggacatccagggtgcatacgttggcgctccgtgtaaactcatatgcgttaggaaggcggcaaccgcggcccagctcgttgttgcacggcctatgggcggaacaacgctgtccgcggaaggccagtacagggggagcgcaatggaatcgcaagaacaatcgccgggagacgtggtgactgcgggtgaggactcacatcccatcacgcaggcaatcgacactgttgaggtgatgcatgctggtgcaaccgcgcccgccgctaacaccatggatccgcctacgattcccctggcgccgatgaaacgtatgcaggcgcggttcaatccgctcgccgacggactgatgtatgttgtggtgttcgtcggtggatttgttggagtcggctgtcggcatgcgttggatatgctcctgccgtcggtcagcgggacgccattcgttgtgggcacgtttgtgtcgaatatggtcgcctgcttcctgttcgcgatgctgaccgaattcatggcgaccgcttcgtggctgcgtcgccgggtgcggcaggttgtcagccgtggcgttgggctcggcttgctcggcgggctttcgacgatgtccggcgtgatgctggaaacgatggaaggtctgcacgagcggcatatcgccagtgcgcttggctatcttgcgggaaattttgcaggcggtttgctcactgccgccgccggcgtggttctgatgcaggcactgctgtcacggagtactcgaaagcgggttcggggtgcgttttcagctgtttccgtgtccgattctgccgaatcggacacgcagggcgtacgccatgtgaaagtggccgacgtggcgcgttctgccgcgcaggccgcaatggaagccgcgcagacggcccagcagattgcacagacgggacaggttccgcgagtcgaaacaccaaccgtgccgccgaccgccagccagcctatgcagacaggccgcgttccgcagattcctccgctggccgttcctcagctgacgcagccggcgcatccgttgctgcgcgagccggatactccagacttggggcagctgcccgagattcagcagtcgcagccgatccagcagccccagcagcagtcgcagccgatccagcagccggccaacccgcttccacccagcttcgagcccaaaccgatcactgcggagatttcgcttgtcgccgacccgactaccggggaggtgcgctgatgatgtggatgatctgtctgttcggcggtctgggagccatggcccgttacgtgctcgacgtgtcaattcaacaaggctggaaccgcgagaatcgaagaacgaaccgcaacttcccgctatccacgctcgtcatcaacggcgtcgcctcgctatgcgcgggcatcgccatgatgtcctactattcgcaatcggtggatatggacacggtcatgatgttcgttgtcggatttctcggtggtttctcaacattctccacggcgctcaacgaagtggtttcattgattcgccagcgtcgttttacgctggctctgggctatggaatagcaaccgtcgcggtgcctctcatttgtgtggccgccggtttcggcattgcgctgcttgccaatccggcgtaattttcacgttacacggacggtcgctgagtaacgtgaaagaaatctgagcgcaactgccatcaaggccgccagtccggatgcaacgctggtgattgcattcgaccagaccaagccgctgctgaaggccttcgcctccgcgggagtcgacactaagaagctgtatttcgttgccggactgtcgaacaggttcgagagaatgtaaatgaatgtaatatttcgtggtaagcacgtgagcatacaacgatagaacagtgataacggggaaggtgcgatcatggtcggcatgcgcgatgtggcgaagaaggccggggtgtctctgagcaccgtctcgctggtggtgaacggcaacgggtacgtgtctgatgacatgcgcgaacgtgtgtgcaaagccatgcaagccctcaattatgtgccgaacgagcttgcccgcaatctgtatcatgatcgtacgaatctggtcggcgtcatcgtgcccaccatccgccacccgttctttgcaacgtttaccgcacatctgcagcatgcgctcgccgcgcaaggattacgcactatgctgtgctctaccgcagatgaggcggacggcgaaatccagtatgtcgacatgttgcgtcggcacatgatggacggcatcgtcatgtgtgcgcacacttcgcatcccggcgattattggacgtcgattcatcgcccgatcgtcgcgttcgaccgtgtgcttggagacggtatttcgtcgattggatccgaccacgagcagggtgggcgattgattgcgcagatgctgatccgcaatggtaccaaacatgtggtgatgattggcggtccgcgagatcaattcttcgatttggctgcgcgcggagaagtcgaggaaggaccgttcgatttgggaaagaccacgttcccgacggtgcgctactacctcacgttggaacaggaattgacctccgcaggcgtgaaatacgagtatgttgaagctggcgaagtgatggattttgccggctatcatcgtgcggtcagcaatgcgctcgacaaggtgacgaccgacggcgtcgatgccgtggtcagttccgatattggtgcatcgttctgcgtgcgcgaagcgttgggccgtggaatttccattcctgacgagctgcagatcgttgcctacgatggtacgtatttgactgatttggccggcatgaagctgaccgcggtcgcgcaggatttctcggcgatcgcacagtcggcggccgaccatatcgtgcaggcgattgccaatgaggaagtggccgcggctaacgcttcacgcaagaacatccccaagccgttcgagccgaacgtgcttattcccatgacactggtgccaggcgataccacgcgttgatactgtgcgtcttcatgcgtgtgcccggtgtggatcgcatcgatttcagcggcgtccacaaccggcgaacgcccgtcgatagtcgtgctcatcattcgacttgtgcacatgtgtccgattctgccgaatcggacgtctgagttccgaaaaatgtgttctgtgtgtccgattctggagaatcggtcatgtgtgatgtgaattgggatgtttggatgtccgtttctgcagaatcatctttgctctgtactcgttgattcgcaaatacggcgcatggctcgtcataccggccatgctcggcggcgcggccttcctggcggactcggtgctgacgccggccgtgtcgatctcgtccgccgtcgaaggcctgaagacgctgccggcgttggagcatctgttcaccgagaacaaggatctgacgatgatgatcaccgcggtgatcatcgtgatcctgttcgccgtgcagtcgcgcggcaccgaatcgatcggcaaggtcttcggctcggtggtgatggtctggttcgcgttcctggcgatcgtcggcgtggtagccatcagcaacgactggtccgtgctcgccgcactcaacccgtactacggcatcaagttcctgttcagtccgaataacgccaccggtctggcgctgatgggcaccgtgttcctttcgaccaccggcgccgaggcgctgtactcggatatgggccacgtgggccgcggcaacatctacttcacctggccgttcatcaaggtggcgctggtgctcaactacttcggccagggcgcgtggatgctgcgcaaccagaacaaccccgaactggccgacgccgaggggatcaacccgttcttccagatgatggatccgaacgtgcgctatgtggccgtcgtgctgtcggtcaccgccggcatcatcgcctcccaggcgctgattacgggcgcgttcaccatggtctccgaggccaccggcctcaactggatgccgcatctgcaggtccgttaccctgcccgtacccgcggccagctgtacattccggtcgtcaacgtggtgctgtgcgtggccacgctggccgtgccgctgctgttccgcgattcggaacatatctcggcggcctacggcttggcactgaccatcacgatgatcaccaccacgatcctgctgggcatctacctgtggcaccgcagcaacaagttcggcaccgttgtgttcaccatcgtgttcctggcgatccaggtcctgttcttcgccgcctcgatggccaagttcctgcacggcggctggttcacgctgctgctcacgctggcgatcctcatgatcatgtacacgtggaacgagggcaccaagctggagcgctcgcagcgtcggcacatgatgccgaaggacttcctccccgcgctggacaagctgcacggcgatagccgcatccaccggttcgcggacaacatcgtctacctgaccagcgatccggacctgaagcgtctcgatacggacatcttcttctcgatcttcgccgaccaccccaagcgcgcccgcgcatggtgggcggtggccgtcgagaccaccgacgagccgttcacccgtgagtattcggtcgagagcttcggtaccgactacctgttccgtgtgcgcatccgcctcggcttcaaggtctcgcagtccatcccggcctacctgcatcagatcatgcacgatctggagaagaccggcgagctgccgaaccagcagtcgatctacccgaagcttgacgccgatcccggcatcggcaccatccgctacgtggtgatccacaaggcgctgatgcccgagtcgaaggtctccggccgtggctccctctcgctgcagatcaagtacgcgatccgccgcgtggccggttccccggtcaagtggttcggcctggcgccgtacaacccgctggtcgaggtgcagccgctgttcgtgtccacgcgccgcccgccgcgcctgacccgcgtggccagccaggcgcccaagcgcgagggctgagccggcaggccgaacagccggtgcgagccgggtggcctaatggcatgtcagggggccgcgaaccgtcatcgtacggttcgcggcctttgcatatgcgaatgatgcagagtgggcggtactgcttgtgaatgtagcgggtggacgggtgacgtggttgatgccttttgccgtatgttcacggtggctatgcgtcggatgggactgtaattcgacttcttgggatcttttttgctgcagtggtgcgccaaaaggtctcagccgtctctgcgccacgccttccggcagtcagtacaaggttgtactacactggtggctgtcacacggatgtccccggtcgcccgcgcctccgcggtacatcgttgtatggatacgtgtcacgtatgcagagtgcatgcagatatgtagaaaggaatcccatgccccagcaggaccatctgaccgcacgtctcgtcgtcgatgacgattttgaggtcgctccggtcaacaatcgtctgttcggttcgttcgtcgagcaccttggccgttgcgtgtacaccggcatctacgagcccgaccacccgaccgccgacgagcacggcttccgcaaggacgtcatcgacctggtcaaggaactcggcgccaccaccatccgctacccgggcggcaacttcgtgtccggctaccgctgggaggacggcatcggccccaagcaggaacgtccccgtcgactcgatctggcctggcattccaccgaaaccaacgaattcggcctgcacgagatggccgaatggcttgaggccaccggcggcaacgagctgatggaggccgtcaacctgggcacgcgcggcctgcaggaggccctggacctgctggagtacgcgaacgtgcccggcggcaccgagctgtcggaacgtcgccgcgccaacggcgccgacaagccgttcgatatccgcatgtggtgcctgggcaacgagatggacggcccgtggcagctcggccacaagtccgccgaggactacggcatgctcgccgcctccgtggccgccggcatgcgccagatcgatccggacgtggaactggtggtgtgcggctcctccgcccatggcatgccgaccttcggcaagtgggagcagaccgttcttgagaagacctacgagaacgtgaacttcgtctcctgccacgcctactaccagccgttcttcaaggaggacggcacgcgcgacatggccagcttcctggcctccggcgtggatatggacggcttcatcaaggacgtggccgccaccatcgacgccaccaaggctcatctgaagagcgcgcacgacgtgtacatctcgttcgatgaatggaatgtctggtaccagggtgaggagccgagcaagacccccgagggcatcggcaactggccggtggccccgcgtctgctggaggacatctacaccgccgccgacgccgtggtgttcggcgatctgatgatcacgctgctcaagaacgccgaccgcgtgcgcgccgccagcctggcgcagctggtcaatgtcatcgccccgatcatgacggagccgggcggcccggcctggcgccagaccacgttccacccgttctccgtgaccgcgcgcctggccaagggcggcaccgtgctggagccgaagctgtccgccggcaccgtggatacgccgcgctatggcgaggtcgacggcgtgaacgccgtggccgtgcgctgcgccgacggctcgctcgccgtgtttgcggtgaaccgttcgctcgaggcgaccgccgagttcgagatcaggctgcaggacggcgcgcagccggcatccgtcgaggcgcagacgctgcacgacgacgatctgttcgccgcgaatacgctctacgaccagaaccgtgtgaccccgcacgccaacgggtcggccatgtacgatgccgagtccggcgtggtccgcgtctccctgccgccggtgagttggaccgccctgcacatcaagtgacgcgatgggccgcgcggtccgttccggagaaggacggatcgcacggcccttgcttcccgggccgggcggaagggaccggaccggccggggaaaacgcgttatgctggaatcagacgggcgttccgcctgaaccgtgcggaacatgcccgatggtgcgacgagaggggtgctgtggcgaaacgggtgaccatcaccgacgtggcgcgcgagacgggcgtctccatcaaaacggtgtcgaatgtgctgaacaacaccggcagtatgcgcccggagacgcgccagcgtgtccaggatgccatcgaacgcctcggataccgcgttaacgtgtccgcccgcgccatgaaaaccggcggcacgaagctcatcggactggccatcaccgatttctgccagccgttcatgccctatctcgccgacagcatcgtggcggcggcacgttcccgcgggtacgcggtgatcaccgatacctacaacagcgccggcggcttggcgcaggcgatcccggagacgaagaagctggccgcggacggctggattttcttcatgggcttgccgatcacggatcgcacgatactgcaccagccgtatccgttggtgattgtgggcgattacgatacgcagggactggccgattgggtcacgatgccgaacgtggaggccgtacgcaccgcggtgggggcgctgctggattcgggatgccgtaggatcgcgttgatcggcggcaccgcggagaacgcatgcccggatgccgaccgcgagtcgcggcccgaaaccaccagcacgatgcgtacccgcggctatgtgttggcccatgaggagcgtggcctgcaggtcgattggcggctggtccgtaacgcggattgggtgcagtccggcggccgcgatgcggtggcggggctgttggacgatccggatgcgccgcgtccggatgcggtcatgtgcctgaacgacgcgctcgccatcggggtgattcatgagctgcagcggcgcggcgtgcgcgtgccgcaggatatgcaggtcattgggttcgacaacgtgccggatgccgagtactgcatgcccggattgacgacgatcgacccgcatgtggatgattacgcgcgacatgccgtggatatgctgatcgcgcgcatcgaggggtcggcggatccgttccgcacgtatgtgacctcctacgatctggtgcgtcgtgcctcgacgtgttgacggcccggcgttcgcctggacatgggtctgtgacgggctgctgtcgcctctcccgtggcgtattccgggagaggcgacatgcgggctaggatcggagcagcacctccgtcagcgcttgacggacggcgctcggcatatgcgaatcggagcaatcttccatgtccggcccgctgacgtgctcgagtgaatccatcgtggccaatgcgtcgatgccgttctccgctatggcggcataagcctgttccttggtcagatatcgcatttcggcatgccgaaggatgtcgaagacgtcttccatgcggggatcggcggccatcgtcgtgtcgccgatggtgacacgtatctcgctgcgggtggatacgtcggcgaccgttacctgcaatgtgagggtttcggcatcataccggcgatccgaatcgacggatgcgccgtcggcctgtacggatatgtcgctgtcggtaatgcctcggaacaggaaatcccatgttctccgggccggcagagcgtgaacgtctccctgggctggcgataccgtgagtgcggatgtggcgccgtccttgcgccatcgataggtgatcgcggtggtcgccggggtgatctgccgagagtaatgtcccgaatcctccatcagcgtgaagtcgccgtccgctccggggaagacgatgatctccagatgctgcgggttgtcgacggagttgatggaatccccctcggacaggggctgcatcggcacgatgccgccggccttcgcgaacacgggaattccgtcgagcggacgccagacggtcatgcgccgtccgttgggcgaagacgcgctataccggcgcccggtgaagaagtcgaaccagtcgccctgcggcagccatacgtcggccttgccccgtcgggaggatttatccatcggttccgtgatgggcgcggccagcagttcggtgccgaacatgtattcgttgggaacgtggtatgcggcgtcgatgtcgggcgatccccaatacatgggctccaccaggggaaggcctgtccgggatgcgcgccagttcatggtgtggaggtacggaatcatgcgatggcgcaggcggagcgcatcgtccatgatcgcacggagggggtgcggatgtttttttggacggtcaggcggccagtccaagacttctgcggtattgcacggggctcatccagtccagtgacttcttgatcctggtttcattgtagtgggtcaggtaggcggccaggcgttcgcggaactcctcgtagcccacgcccctccagtcccgcccgtagaataactcgttcttgagcctgccgaagaacccctcggcggccgcgttgtccgggctgcatcccttggcgctcatcgaccggatcagcccgtgctcctcgcagatgcggatccattcgtcccaccggtagtggcagccgcggtcggagttaaaccgacatcggtttaacagtgattaagccgggtttgttgttaagccggggaacggttcggggtcttggtggctggccgtgtcccatgtggtttcccggcttaacgttccgggttatgttcgtcttgtcccatttgattcgaacgaaggagtttgccatgggtgagacgacggttggccatgtcgcgggcgaggtggtccgcgcgctttacggggccggttatatggaatccaccataggccagtaccgcaagtccatcagggcgttggaacggtacgccggaggcccggatgcggtgtacacgcgtgggttgggcgcggggttcgccgcgtcgaccttcagtgagcggacgggcggtttcagcaggcagcggtggttcgattacggcaggctggcgcgtttgtgcgactcgtatctgcggtccggttcggtggacctgggcaagtggcgcaggagcaggcttgcggagccggtggttccgggtttggccgtggtcatggagcgttgggaggcgtatctcgccggttcgggactggcttcggcgacggtggggcattaccgtcggatggcgggcttgttcctcacgtggctggaatctcatggggtcgtgtcgttggatggttcggatggctcgcatgtgctggggttcctggccgggctgcgttcacgctggtcggagtcgtcgatgcggcacgccgcgtcggacctgcgcccgttgttcagatggctcgggcgggatgacctggcggacgcgatcggcctggccggcatacgcaggacccacgcgatcgcgggaacgttgcccgacgacgagcaccgccgcttgctggaggcgtgcgcctcgcggtcggtgccgtcgagggacgcggcgatcaccctgctgtcgctgacgtgcgggctgagggcatgcgatgtgatcggtctgaggatcgccgacgtggattgggattccatgagcataggtctggtgcagcgaaagacgggcaatccgttgaccgtgccgatgacgggaccgctggccgcgaggctggcgtcctggctgttggacgaaaggcccgccaccgacgacgaccgtgtgttcgtgcggtacaaggcgccccatgtcgcgcttcggggtcattcatcggtgtacgaggcgatcagccgtgtcatgcggcacgccgggctcggacgccggggcggttccaggctgttgcggcgcaacgcggcgacgaggatgctggaggcggccacgccgttgccgacgatcagcgcggtgcttggccacgccgaccccgattccacacgcgtctacatggccacgcaccgcgggggaatgctcgcgtgcgtgctgcccgtgccggaaggcggatcgtcatgagacccacggaacacggattcgtcggcccgctcgccggcgaattggaggagtgcatccgcttcaaggcgtccatgggcaggcatggcgccacccgcgtccgggtcctgcgctcgttcgaccggcattgcctcgaacacggggccgtgcgtctggagcggggcgtcgtggagcgatggatcgcccataggatcgacgcgaatcccgggggttgccgctcgtggttctcgtacatcagggacttcggcaggtggatgcgactggcccacgatcccgacgcgtacgtgctctccgaccagtggaaggccggatccccgcgtccgacgccgtacctgctgacggaccgcgaggccgccctgttcctgcgggccgcgggaacgttggagtctccgtcgccgtgggcgtggcagtctcgcgcgttcttcatgctcatggcctgctgcgggctgcgcacccgagaggtcaggagactcgccgtcgggcacgtcgaccacaaggcccgttccatcgacgtggtcgattccaaggccggtcgcagccgcaggctgcccgtgggcgacgaggtcgccgccgaactgctggaatgcgaccaacggtcccgcgaacgcttcggagacgaccgtcccgcgttcttcgtcacctccaccggcaatccggtctccccgggcatgcccggcgtggtgttccgccgcgtctggacgcgggccgggctcgagtggccacaagccggcaaacggcccaggccctatgatttccggcaccggttcgcgttcgcgaacatcgagcggtggactcgcgacggcgtggacgtgatggcgatgctgccctatctggcggcctacatgggacacgccggcatcgacagcaccctctactacgtgcacgccagccccgatttcatggacggatacgcggacctcgtcgccgacgccgaacgcgtggtcccggaaacggaggaaccatgagcaaggcaaggaaaacggccgccagctccggtgaaccggacttctggcgagtcgcgcgcgactggctgcaccactggctgcccaaggtgcggggcagctcgccgaagaccgtcgaggcgtaccgcatcggcctggaatcctacgtccgatggctcgaaaccacggaaggcacgcagcgcagccacatcggtttcgggcatttcgaccgggcgcgcctgggccggtgggtcgaatggatgcggaccgagcgcgggtactcggaccgcaccatcatgctgaggatgacgacgatgcgcgtgttcctcgaccacgcgggcctcgaacacccggcattgaccgcgctgggcaacgacgcggccggcatacgtgtcaaaccacctgcgcgcaaacccgtcgaccacctcggggaggagcacaccaaagcgttgctgaccgcatggggcaccggcgacgccaaatcgcgcaggaaccgcatgctcctgatcctcatgtacgacaccgccgccaggatcggcgaactcgccgcactgaccatcgcggacgtgggtatggataagccggccagggtcacgctcaccggcaaacgcggcaagagccgggtcgtgcccctgggagaaaggacacgaacccacctggccgcctacctcgaggaattccatcccggaccgtccatgcgcgacggcgacaggccgttgttccactcgacgaggaacggcgccatccagccgctctccgtggaccggatcgacgagatcctcaaaaccgcggcggccagagcacgccgcgggacgtgcccgtccatgcccgaacgcgtccactgccacctgatccgccggacccgcgccatggacctctaccaacagggcgtgccgctaccgctcatcatgcaactgctcggccacgaaagcatgagcacaaccagcgcgttctacgcgttcgcgaccctcgacatgatgcgcaaagccgtcgatgcggccaaccccggccccgacccctccaaggagacatggctcagcgagcaacgactccgacaactacacaccctcaaataacccggaacgttaagccgggaaaccacatgggacacggccagccaccaagaccccgaaccgttccccggcttaacaacaaacccggcttaatcggaatggatgattggatgttccccgtccctgagcgtggcgaccgcgtcaaggagcatccggttcgccatgtcggcgttcggggagcgcgacaaggtccaggagaccaccatcccgtcgaagcagtcgaccaccggggaaagccagcacttgtacccgtccatggtgaactgggtgacgtccgtgacccacagcatgttcggcgcgtcggcgtggaagtcccgctccacgaggttcgccggggcctcgccgatctcgccggcgtaggagctccaccgcttcggccgcttcaggtacacgggccgcatggccccctcgcgcatgatccgcctgacgaccttctccgagacgacgatcgggtcggactcgtcaaggcgcagcatgcggtggatggtccggtatccccatgcgcgcccaccctgctcgaacaggccggcgacgcgggcccgcagcacggcgtacctgtcgcccgcggcgatcgcgccgcgctcgtaatagtaggtgctgcgtttcagccccacggccttcagacaggccgccaggccgaattcacccctgatcgcgtcgacgacccgcgtcctctccctgttcgtcagcatggacgggtcgaggcgcgggtcgtcggcttttaaaacatcgatcgtctcccgcatcaccgcgttctccagccgcaggacctccacctgccggcgcagctcctccacgtcatcgccggccgcgggcatcggttcggccggcatcggcgcgtttctcctgtccatcagtcccagtatcccctcgctccggtagcggcgcatccactggtacacgctcgtcggcgtgcaacccgcgtcgcgcgccacgcgggcgaggggctcgccctcgagcgcgcgtctggccgcattcgtcttgcattccagcgtatacgaacgcctgcacgcgcccgtgatctcgtcggcctccgcgtccagcatcgcgttcaacagctgttcgaccttctccgacaccaaccggtccagcttcgtctcgagcatgttctcgtcgacctgtagaatctgattcggcatggttccgtcgccttcctaaataggttgatttggtttggcgactgaaatcgtacccggacgacggaccatgtctctcaactcaagcctcaaccaaaatgcgcaacaaaccgggcgttatcaatcggacacattggggtcggacaggctaagctgcatagaacaccgcatctaatcggttcgacacgcgcatttcactgcgcgactggacattgacgtccctttcgaggtaatatcgaaccggttcgatacatacgtgagtatgcaaatacgtaaacaacaaacaggcagatgcgcacgcaaattgcacccgcgcccatgagccaagggaggtcccatgaaaaacaaagtgcaactcatcacatacgccgatcgtctcggcgatggcactcttagctcgatgaccgacatcctgcgcacccgcttcgacggcgtgtatgacggcgtgcatatcctgccgttcttcactccgttcgatggtgcggatgcaggcttcgacccgatcgaccataccaaagtcgacgaacgtctcggcagctgggacgacgtcgccgaactctccaagacccacaacatcatggtcgacgccatcgtcaaccacatgagttgggaatccaagcagttccaagatgtgcttgaaaaaggtgaggaatccgagtattacccgatgtttctgaccatgagctccgtgttcccgaacggcgccaccgaagaggacctggccggcatctaccgcccgcgcccgggcctgccgttcacccactacaagttcgccggcaagacgcgcttggtctgggtgagcttcaccccgcagcaggttgatattgacaccgattccgacgagggctgggaatacctcatgtcgattttcgaccagatggccgcctctcacgtcagctacatccgcctcgacgccgtcggctatggcgccaaggaagccagcaccagctgcttcatgactccgaagacgttcaagctcatctcccgcctacgcgaggaaggcgtcaagcgaggcctcgaaattctcattgaggtgcatagctactacaagaagcaggttgaaatcgcctccaaggtggaccgcgtctacgatttcgccctgccgccgctgcttctgcactcgctgttcaccggtcacgtcgaacccgtggcccactggaccgagatccgcccgaacaacgccgtcaccgtgctcgatacgcacgatggcatcggcgtgatcgacatcggctccgaccagctcgaccgctccctcaagggcctcgtgcccgacgaggacgtcgacaacctggtcaacaccatccatgccaacacccacggcgaatcccaggccgccaccggtgccgccgcgtccaacctcgacctctaccaggtcaactccacgtactactcggccctcggctgcaacgaccagcactacttggccgcccgcgccgtgcagttcttcctgccgggcgtgccgcaggtctactacgtgggcgcgctcgccggccgcaacgacatggaactgctgcgccgcaccaacaacggccgcgacatcaaccgccactactactccaccgccgaaatcgatgaaaacctcgaacgcccggtggtcaaggccctgaacgccctggccaagttccgcaacgaactgcctgcattcgatggcgagttcagctacgaggtcgatggcgacacgtccatcaccttccgctggaccgccgccgacggcacgtccacggccgccctcaccttcgagcccggacgcggcctcggcacagacaacgccaccccggttgccagccttgcctggagcgatgccgccggcgaccacgaaacccgcgatctgctcgccaacccgccgattgccgatatcgactaaccgttggcccataaacgccactccgctgtgcgcgctccaagtagtgcgcccggcgtaagctgggtccatggaaaacaaaccgcccgcagtgcactgaagccagtgcgcccgggcggttttgcgtatgcggggttgaaggtcatgctcctgcgggcgcggcccaagcatcccgccggaatcgacgagacgagcagcagaacagagaaagagcagcatcatgttggaaccgtatgtgcgtccgggtattgatgatcgcccggatttggacaaggtcctaagtcccgaagacaaagccgccgtggccagactgaccatcaagaatcgccgccgcccgcccgaagcctctgcggaccagcctgaggcccaggctgtgcgattggcttccgccggttcttcggcagccgctgctgcagccgccagtgtggacactcccgcgccggatatgtcgtccgcctacctcgacatgcgcgatcccatggtcgccgtcaatggccaacgccctaccgcaggtcaggtctcccgactcaactggggtttcttcgctgcttcaattctggtcggcgcaccttgggtggcgttgaacaccattgccatgcccaacgcgattgcgcgtacgttcggctatgacactgctgttgccggtcatatcgccatcaatccggccactggccgcccgttgcccgtcgccaccgaattggcgatgcccctggccgtgttggtgattgtcggcgtagtggcctccatgtttgcgatgccgctgatttcagtgttgtccgaccgcacacgcacgccattgggccgtcgtaccccgtggatggttggcggaggtctgctgtgcgcgctgatcacgctgattctggggcagaatatcggcatcattgtgctttgtattttctgggtgttcctacagttcgcctatgcgatgctttccgtgccgttgaccagcgccatcagcgaacgggtgcccgacaagttccgccctcgcatcgaacgctggcatggcatcggtgtgatgctcggccaagcgcttggcgtgtgcatgggtgcgcttggtgtgatgttcaattcgtttgcgccgtttagttacaccgccgtgctatttgcagtgtccggtattgccaccgtattgattctgcccaaggagccttctagcgctgagcagccgaaccagctttttgaccgcagtcaggtacttgaccaattgcgcccgccggcccacgctcccgagttctcccgggtgttcgccgcccgtacgtgcatgatggccggtgttgggctgaccggtgtgtttctgtggtatctcgtacgtttctgggtttatggcaaggccgtggtacttacgtccgcgccgctgaccattccggccggattcctcattgccggtatggctgtggccacattgatcggtgccgcgctcgcctcctgggccgccgggccgatttccgagcgaatcgaggaaaagaacattcccgtggcccgtgtggtggccggtgcctgcctgctgtatgcgattggtctggggctcgcatggggccttggcgtctggtccaccggcactgcccgtgaaaacggcatgctgctgtttgcgttgatctccggattcgccttcggcatttacgattcgctcggacttgaactggtgatggactctttgcccgacccgcgccgagccggccacgacctcggcatttatgcgctcgccaactcggccggtctggcgctcgccgccatcatcggcgcgctactggtgaacgccttcgagcatagcttcggctattacctgctcttcccgtccgccatcgtcatggtgctgctggccggaatcgtcaccctcaccaccaaatctgccgaataataaaccggttcgagtacactggtcagcagtgatccagtccagtactcgcaggggagcaaaaccatggtcggcatgcgcgacgtagccaaagcggcaggggtgtccttaagcaccgtttcgttggtggtcaacaacaccggctacgtctcggccgatatgcgtgccaaagtcgagtccgcgatgcgccagctcaactacattcccaacgagctggcccgcaacctctaccgaaaccgcaccaacaccatcggcgtgatcatgccgaccatcgcccacccgttcttctccacactcaccgcgcatctgcagcgcgagttcgccgcgcgcgacctcaaaaccctattgtgttccaccgccgatgcggacaaaggcgagggcgaatacgtcgatatgctccagcggcacatgatggacggcatcatcatggcggcccacaccgagcatccggccgactactggacctccatccatcggccaattgtcgctttcgaccgcacgctcggtgagggtgtgccggtcgtccggtctgatcatgaacagggaggccgtctgattgctcgccagctcatcgattccggagcgcgccacgtggtgctcgtcggcggcccgcgctcccagttcgctgcggccaccacgttccccacgattcgctaccatctcaccgtcgagcgtctgctggccgatgccggcattgcctgcgattacgtggaagccggcgccgtggccgacatcgccgcccacgaagccaccgcatgcgccattttcgaacagtatcctgatgtcgacgccatcgtcggctccgatgtggtggcatccgtggcattgcaggaagcctcacgacggggtatcgaggtgcctgctgatctgcaagtcatcgcctatgacggcactctcatggccgaaaccgccggcaaacgcctgaccgcgattcgacaggacttcccggccatcgccgccgcgctcgccgtccgcatggactcacagatcgccgccgacggtggccccgcctctccgtccaagaacgatagcgcttcggacgttgacacccaacccactcccgaagaagtcatccccgtagccctcatccccggcgaaaccacccggtgactcctatcttggctcccctctctgaggctgagctgtgaagcaaacagtccggtggactgtttgtaggcgaaggcgagccgggaggcgagcaggcagactgcgggcggtagcccgtctgtaattgcggccgagctggcggcgtaggcgactgaggggagccgagtcacggccgcccacagtcacccatctcacatgactcctacgtcacaatgtccacaatgtgaacccttgctggattggcaagacatacaaacctatgtttacattccagttcaggtcgaacggcctgaggaaataccgaaaggaggccacgcgatgactggattcaatgcttctgcgtttgtatccgcacgaattattagcccgtcttcgctggcggactaattcggcactgatgcttgaagccccgtcaacgaaggcagggccaatcaagctgacacaatcggcacggccctgcatgatgcggggctttttttgttgcgctcacaaggcttacggcagaatcccgcagacggaaacggtagcggacagtacacggcaacaacacagcgacagaacaacaacctccctgtggggcgaaataatcgcccgccgatgagagtgaacgagagcaaaacaggagtaacaatgactgcagcagtcgaagagactggcttagggcaggcggcaggtaaagccgctaccttggtacgcgattcggtcaagaccgtgatcgccgcgtcgatggtcggtaccgccatcgaattctatgacttctacgcctacggcaccgccgcggcaaactacttcccgcacatcttcttctccgcgaaggacaaccccaccgtcgcactgctgatgagcttgctgaccttcgccgtcgccttcatcgcccgcccgctgggctcgctgatcttcggccacttcggcgatcgcatgggccgcaagaccacgctggtcgtcagcctgatgaccatgggtgtcggcaccttcctgattggctgcctgcccacctacgatcaggtcggcgttggtgcagtcgccatcctctgcctgctgcgtttcatccagggcgtcggcctgggcggcgaatggtccggcgcggcactggtcgccaccgagaacgcgcctgaagacaagcgcgcactgtacggctccttcccggagctcggcgccccgatcggcttcttcctgtccaacggcacctacttcgtgctcgaatccttcaacaatcaggacgcgatgctggcttggggctggcgtgtgccgttcctgctgtccgccatcctggtgatcgtcggtctcgtggtccgcgttcacatggaggagaccccgatcttccgtatggctcaggagcagaagaaggttgtcaagtccccgctgaccgaggtcttccgcaagtcttggcgtcaggtgctgcaggccaccttccttgtggctgtgacctacacgctgttctacacgctcgccacctggtccctcgcttggggcaccaaggagcagggcgaaggcggcggcaaccttggcttcaccaaccaggaatacctgctcatgctcatgatctccatctgcttgttcgccctgttcatcgtgctgtcctgcctgtacgcggacaagatcggccgccgtcgcgtgctgaccttctcctcctgcgcacttgtggtgttcgccgtactcttcccgttcctgctggacggtggtctggtcggccagaagaacttcttcgccaacatggtgttcctgtgcgtcggctttgccctgatgggcatcgccttcggcccgatcggcgccttcctgcctgagctgttcgacgccaacgtgcgttactccggctccggcatcggctacaacctggccgccatcgtcggcgcggctttcgtgccgaccatcgccacttggctgagctcccactggggcgtccactccgtgggcctctaccttgccgtgatggccgtgtgctgcctcgtctccgtgctcacctgcaaggagactaaggacgttgactttaccaagtgacgatgttcacaacgtgaaaacccctaattccactaagtgaacccctacagggcttttccgatgcgacgggactaaacctgcatatcggaaaagcccacaaggaaagccacaacagaatatcgctcagcgaaaccccgcagaacgcaagaaaaattcaaccccataaataaacaaataaataaaaggagcgccaaaaatggcagcaactatctggtacgagaaggacgccgatctgtccgtgttcgatggcaagaaggtggctatcctgggctacggttctcagggtcacgcccacgcgctgaacctgcgtgactccggtgtcgacgtggtcgtcggcctgcgtcctacctccaagtccgtggagttcgccaaggagcagggccttgaggtcaagccggttggcgaggccgttgccgaggctgacgttgtgatgattcttctgcctgaccagtaccaggcagccgtctacaagaaggacgttgagccgaacctgaagccgggcgctgccctggccttcgcccacggcttcaacatccactacggctacatcaagccgtctgaggatcacccggtgttcatggttgccccgaagggcccgggccacatcgttcgtcgtgagtacgccgctggccgtggtgtcccggtcgtcgttgctgttgagcaggacccggacggcaagacctggccgctgtgcctggcttacgccaaggctctgggcgctctgcgtgcaggcgccatcaagaccaccttcaccgaggagaccgagaccgatctgttcggtgagcaggacgtcctcatgggcggcatcaaccacctgtgcgacctcggcttcgacgtgctgaccgaggctggctaccagccggaaatcgcctacttcgaggtgttccacgagctgaagatgctggtcgacctcgctaacgagggtggtctgaacaaggctcgttggtcctgctctgacaccgctcagtacggcgactacacctccaccgtcatcaccgaggagaccaagaagcgcatgcagtatcagctcaagcgcattcaggatggctccttcgccaaggagttcatggatgaccaggctgctggcgccccgaagttcaagaagctgcaggaagagtactctcacccgcacctcgagaccgttggcccgaagctgcgcgccatgttctcctggaacaacgccgaggccaaggacaaggacgaggctgagtccttcaacggcaagatcgctcgtacccaggttcagtgattgccgcccctgaaggggatttaagctagcaaaccgccgttcccgcccatacgggagcggcggttttgtgttgttgcgcgcagcgaatcattctcaataacaactatgcgctgatttcttgcaggcaaacgaacaccgaatatgcaagatcgttgatatctcagcctttccccatatgtgggattgtgcgattctgttcaaaagggtgcagagttgttatcgagaatcgttctctgcacacggctgtccatactccaatagtgacctagctcacgttgtggactccagcggggctgcgacggcgttctcggtaggattgaactcggtttgaaggacacaatcctcgcaaaacaggacttatctgcacaccgtagatacccccggcgcccagcggcgccacaacccactactgaaaaggagtgccaataatggcagcacaaatctggtatgagaacgacggcgatctttccgtcctcgaaggcaagaaggtcgcaatcatcggctacggttcccagggccacgcccacgcgctgaaccttcgcgattctggtgtcgacgtggtcgtcggcctgcgtccgacctccaagtcggtcgacttcgccaaggagcagggcctcgaggtcaagtccgtggccgaggcttccgccgaggccgacgtgatcatgattctggcccccgaccagtaccagcgcaccatctgggccaacgacatcgagcccaacatcaagccgggtgccgctgttgcgttcgctcatggcttcaacattcactacggctacatcaagccgtctgaggatcacccggtgttcatggttgccccgaagggcccgggccacatcgttcgtcgtgagtacgccgctggccgtggcgtgccggtcgtcgtggccgtcgagcaggatccgcgtggcgacggctgggctctgaccctggcctacgccaaggccctcggtgccctgcgcgccggtgccatcaagaccaccttcaaggaagagaccgagaccgatctcttcggcgagcagaacgtgctcatgggtggcgtgaacaagctcgtcgagatgggcttcgaagtcctgaccgacgccggctaccagccggaaatcgcctacttcgaggtctgccacgagctcaagatgctcgtcgacctgatgaacgagggcggtctgaacaaggctcgttggtcctgctctgacaccgctcagtacggcgactacgtcaacaccgtcatcaacgaggactgccgcaagcgcatggaataccacctgcagcgcatccaggacggctccttcgccaaggagttcattgacgaccaggatgccggcgccccgcacttcaaggaactgcaggagaagtactccaacgagcgcatcgagaccgtcggcccgaagctgcgcgccatgttctcctggaacaaggatggcgtcaaggatgccgacgaggccaactccttcaccggcaagatcgcccgcgcccaggttcagtgattcttccttggctcccctcgggtgaggtgcgcacgaacagcgagccggcaatcgcagccttcaggctgtccgtgttgcagtacgctggcgcgtaagcgcctgagggtggtccccagtgcataccaaaaggccgccgctccgattcattcggaacggcggcctttcgcttattccaagggatctacttgataacccacgcagaagtgtcggtggggagctggccttcgggggtcagcgggccggacgccagcaccacggagccatcgggcagcgcgaccggggcattgccgaagttggtgattgaggtgaacacccgcccgccaaccgccgcgcgggtgtacgccaccacatcgtcgcccatgtccacctgctcggccgtggtgtcgcgcgtggcggtcagcgactcctggcgaatcgccagtgcggcgcgatacagcgcgagcatcgagtccgggtcggcttgctccacgtccaccgcgtaatccttgaaccacagcggttgcggcaggtgcgggtcggcggccggcgtcacgccctcagcgcgcgtagccggcgagaagccgaaggaagcgcccgtgccgaactggccggctgcgcacagcggcacatggttttcgccggtaccgtcatcggccggagccggacggctgaaatcggccaaggccggctcatcggcggcggtccacggcagcggcacgcggcagccgtcgcggcccttgtccatcgtgttgcgggtggtgtggaaggcggtcggatcctccaagtgatcccacggaatatcggccacctcaaacaggcccagttcctcgccctgatagatgtatgcggcaccgggcaggccgagctccatcagcgcggcggcacgggcacggcgggtgccgagctcgcggtcttcgggatatgtggtgccgttgcgcagcagccagtcgtgcggcagctggtggtagggcgcgcccttgacctgcggcagaccgtagcgggaggggctgcgcggcacgtcgtgattgttcatgacccacgtggtggtggagccgccggtttcggccgccgccttaagacccgcggcgatggccttgcggaactcgtcggcataccagttggcctgcgcgaagtcgaagttgaaggactggcccagctcgtccatcgaagcgtacaggtgctggtgctcaggcaccacccacgcctcggccacggcaaagcgcggcgggttgtattcgttgaacaccttgcgccactcgcggtagatgtcgtgcacctcacgacggtcgaacagcgggtggctgaagtcatgattcagcacgccgaccacgctgtattcgcggccgagctcttccaacggcttggattcgagatccttggccaggccgtgcgccacgtcgatgcggaagccgtcggtgccgtggtcggaccagaaacgtagggtcttcttgaactcctcgtggatgtccggattcttccagttgacgtccggctgcgccttatcgaacaggtgcagataccactggccgtcggccacgcgcgcccaggccgggccgccgaagaaggattgccagtcgttgggcggcagttcgccgtgctcgccgcggccgtcgcggaagatgtagcggtcgcgcgccggggagccgggctcggcggcgagggcctcttggaagaacacgtgcttgtcggcggtgtggttgggcacgatgtccacgatcactttgatgccggcctcgtgcgcggcctcggccatcgcgtcgaagtcgtccatggtgcctaggcgcgggtcgacgttgcggtagtcgatcacgtcgtagccgccgtccgccagatccgaggggtagaacggggagatccagatcgcgtcgacgccgaggttcttcaggtaatccatcttctcggtgacgccggcgatgtcgccgagtccgtcgccgttgacgtccttgaagctgcgcgggtagatctggtagacgacggcctgcttccaccagtcgtcattgaggttgttggcggtcatgccgattccttcctgttccgggtgcgttgtggttgggttgttccggttgtgctcgaactgctgtgtgaaggcccaaccgttgtattgatgatgacaacgatatcatgtgaattacgcatgcaaaagtcgatttatcggcgttttgcggtggtaacgtagtcacgcctgcgcggacgctgctgttgcggcaggcggcgcggtggtttcgcgcagtattagcggagtgtccggccgtacgaatgccggttcgattgacttgcccgcaatggcatccaataccatgtgcccggcggccacgcccattgcgaacgggtcctgatgcagtgtggtcagtcccacggcggcggacagggtggaatcgtcgaagccgatgatggagatgtcctgaggtacccgccgcccgtattgacgcaggcgatacagcacgggtgcggccatttcatcatcctcaaaacagaaggcggtgatgctgggggaggcgttcagtacggcgttcaatgccgcgttgctttcgccaagaccgcgttgaatgctcaggggcgttagctcgatccccggatgggcggcagcggcatcaatgacgccctgcaaacgagcctcggcactgtagcgcatgttggtttcggtcggggcgctgccgacgaacgcgatatgccggtggccgagtgcaatcaggtgctcgatggccgaacgtgtggcggcgtaatcgtcaatgctcacgcctgcgtcgaacccatcggtggagggaatgttgatgccgacaatcggcacgtgcatatgcttcagtcgctccacttcagccggctcaatgtcgaaggagctgacaatcaccgcatccgcattgcgtcgcacgggcaaatccgcaaagaagtcatggcgctcggcggcgttgcgcatggggtagggcacagtgtcgtagccggaggggcgcagcgccgagtcaaggccggcgaagatgtttgcattgaaccaggtggtgatggtctcgctggccagcagcgcaatgcggaacgactggccggacttcagtgcggcggccgagcgagagacggagtagtcgagcttttcggccgcggtcatcactcggtctcgagtctctggaagcactagatccggcttggcgaaggttcgggacaccgtggatacggaaacgccggcctcgcgggccactgcctgaatgcttgccttggtcatatgccgtcgctcctttaccgtcgcgaacaatcattgtcatgacaacgataacatgcccataacaagtcgccgtcttcggctatctcgattacgaggggctgatttagggtgtcccggacatctacttccgtttcaaggggctccttgccggtgaaaccacaagtgcaaacgactttgtgccaacgtcattccgccgttctcgcgctgggtctacttgggcaccagccccttgaagcggaagtggatgtccgggaaaggccaaatcagcccctcgaagccgatttagaccaatttcccattgcggaatcgatcaccgcttctctcggcgcatcacggcggctagggactgcacgcgtggcaggtcgaagacctcgtcggtatgtaccacgtggcctgagctgtccgccagcggcacgcgccagttcgaatactctctggaagtgcccggctgattctgggagcggcattcgcccacgccgtccaccagcgctgcctgcagcagcagcgacggcgtatcggtgagcatggcgtgcatcgcttccacgatttcctgcacatggccttccacatcatccgccacggtctgcgagatatagccgttctccaccagacggttcatcatggccgtgcgctcggccatcgccgaggcggcgaatgcctccaccggctcgctcaggagatgcagctcctcgcgcagcttgacgtgtgcgaagttcaggtagccggcggtgggtggcagatcgtgcgtggtcaccgaggccaatgcctgtttgcgatagtccttgggtgcgcggtacgggtcgccggcgttcggcgaatcgtccacgcggttgaaccattccacgtcagtgccgagcacgccgtgatcggccagaatgcggcgcacgtaatccggtacggtgcccagatcctcgccaaccaccatgcctccggcgcgcgtggcctcgatggccagtactcccaacatcgcctcgtggttgtacgtcacgtatgcgccgttgcgggcaccgagcccctgcggaatccaccacaggcggaacaagcccagcacatggtcgatgcgcaccgcgcccgcgtgctcgtacatcgaatgcaccatctcgcggtacacctggtagccggtggcctccaggtagcgcgggttgaacggtggctggccccaatcctggccctgctggttatagaagtccggcgggcagccgaccgtgacgccacctgaggcgaagcgttccggattggcccaggcatccgcgccgagcccgtgcacgcccacggccatgtcctgcatcagccccagcgtcatgccgtggtccagcgcctcctgctgcgcggcgttcacctgctcggcagcgatccactgcagccagcggttgaactcgaacaggtcgtggtgctcctcgacgagctggcgcacggccgggtcgtcgatggtcttctcgaagaaccaacggttctcgccccacggcgcgccccatacctcgaagcacaggcaccatgtggcgaaggaatcgaggtccgggccggcggtggtcttgaaatgctcgaattcgagctcgcgcttgttgttgcggcccgcttcgaagatcaggcgcagcgccgggcgcttggcctcccacgccgcgttgatgtccatcggggtcgattcgtcgttgcgcgcggccaccgaatcatgcagcgcatccacctgcgcgcgcacgtcggccggcagtgtggcatattcggggatatcctgcggccggatgtacgtcacgttgaggaatcggcgcgattccggtagatacggcgatggctcaagcggcggaatcggcgcgccggcgtgaatcggattgatgagcatgaagtcggccttggacttctcggcggcatctgccaaaagacgcttcagatcgccgtaatcgccgatgccccacgattcgcgggaccgcacggaatacatctgcgtcatccagccccaccgctggtgctcggcgaccgcctccggcacgggaatgcgcgcgggggcggcgatgatggccgccttgccctcgcgcccgtcaaccgtgacggtcagcgtgtggtaacccatcggcaggtcgggtgcgatggtcaagtccggcttgccggaattgaggttcggcagcagggcaaagtggccaaacgcggtgccgtcctccagttcgatggaggcggtgatgtccgcgtccgacgagcagttcagggtgatgccggtcggtttgccggtggtggcgacgatggtggaggggagcaaacgtttgctgttttccacctcaagttgggtcatggagcgtacgatggcctcgtcgctggatgcgtccacgtcgagggccttgagtacggcgaccaaggccgcgtcgctgatttcggtgtaggtgccgagctggtcgatgaatgaggtggcaagtccgcaggctttggcgagcttgatgagcgggcgggcgagtcgttccgtgctttccgcgcgctgcggggcaccggaagcggcgttgttggtggtgtctgcgatggtgccggtgctggttgctgcgtcgttgccgtatgcgtcggtcatgatgactccttgcttgcaaatcgggtactgctagtcgtttgcattgctgttcgagggccgctctgcgttgaggttccggcaacctgacagaccaatgttcgagctgttctgcctctaccgtaactcatattgacaacgattgcaatacattcggtgagttggacgaggctagaggtgttggtgtttgtcgtgatggcccgttgactatccccagtcgactttgccgacagcctcgccggcggaggtgaggtcgaacgggtttaaccaaacacgacgaacgattgcggggagagcgtcagctgcccgccgctcacggccggttcaccaagactgagcagcacgtcggcgtcggaagagagctcgtccggcaggtattccgtgaggaatgaggcgattgaggcacctgaatcggcgttgaaataactggaatcgccttcgtgctccataggcgtgtcggtattgcgcagcaacaggttgtagccgttcgggtggccgtcccggcgccagtcgaggtagaggtccatgtcgaagccggcctgcatcgattcgttcggatggcctggacgccatcggcggaccgacctgggtggattccgataaggcggccgtatgggtgaccaactgggacaccgagcgcaacggctcctcgctcaccacccgtgacggcaccagctacctgctcgccaacgccttcatgctcgcctacgattacggccagccgcacatcttctccggctactactacgccggcgtcgacgacggcgctcccggcgccacccgcacctccgtgccggacatgacctgtccgaccgacggcatcgaaaccgccggcacctggcactgcgcgcaacgctggaccgccatccgcggcatgatcggcttccgcaacgccgtggccggcaccttcaccgccaccgtggccaagggctcggccgtcgccctatacgccggcgcgacgcccgcaaactgggccggcacccggaaatacgatccgtccgatcccgcctggttcaccggcgaaacaccgcataagggcgatgacaccgccgccaagtccgccgattccgcagcgtccgccaagtcaggcgacgccaagtccggaaaggcaacgtccgatgccatccgccgcgccgcaacgctcgccgccatcctcctgcccgtcatcgtcggcgtcacgttcatggcgatagctcgcaggaacggcaaagcccagtccgacaacagcggcccgaataacgactgattcggccccgctcagccgcgcacccgcggcgcggcggtggagtcgcgtaccagcagttgcacggggaagatctcgtgcggctggtccagggtgcgcccctcgataaggtccagggccttgcgcgcggcggcgacggccatgtcgtacggcttctggcgcacggtggtcagccccacctcgcccgagaacgtgctgttgtcgaatccggtgacggacaggtcggtcggaatcgccatgccgcattggcgcaggcggaagaacagcggaatcgccagcgaatcctgatggaagcacagggcagtcggggcgtcgtcgcgcgcgagcagcgcggtgagggcggcgtcgaccggatcgtcgccggcctgcatgtccatcgtctggccggtcacgccgtccagttcgctgcacgcctccaggaatccggtgacgcggttgtgcgagctgaagcccatcgtggcatcgaacgtctcgtacaaatacaacaggttgcggtggccgagcgtggtcagatggcgcacgatcagccggatgccggccttgtcgtcgatgcccacggaggcggtgaacccctgcgaggccgtgttgatgccgatgagcgggatccgcgtggtgttgagtcgcctgatttcggccggggtgatggcgaacgacgagacgatgaccgcgtccgcgttgccacgcaccggcagttcgtcgaagaactcctcgcgcgcgcccgcgtcgccgatcggttggatgaccagatcgtagccggccgatcgcagcacttcgttgaggccttcgatgatgcgcgaggtgaaccagtcgagcttgctgctgcccaccagcagcgccacgcggtgggagcggcccgatttgaggatgccggccatgcgggataccgagaagtcgagttgttgggcggcctccatcaccttggcgcgcgttttggcggagaccatgtcagggcgggagaacgcgcgggagaccgtggcggtggagacgcctgcttgcctggcgacgtcctcgatgctggctttcatggcccctcccggtttttcaaagttgacggtgtgacaaacttctcttcattgtaaatcattgcagtacgttttacgacagtcatagtgcaatgggttgcgatattgcgacacgccgaaaatatagaccaatatggtctcaatagctttggaatgtaacaggttgcaaatgtaacggtttgcatggctgagaaagccgggttgccgaactagttcgacacccgtatactgaaccgtgttcacttagagcttgcgcggaagtaagggagataatgaagatcaagaaatctctcgccgcgctgactgcaaccgtgagcattatggcacttgcaaccggttgcagttcgagcggttcgtcaggcgtcgtcgacacccaggccgacaagggcctggccgtcatgggcgacaccatcacctacgaccccaaccacttggtcaacgacggccagcccatcgaactgggctactggtcctggggcgacgaaagcactgacccggtgatctccatgctccacgagtacgagaagatccacccgaacgtcaccttcaagatctcgcaggtggcttggagcgactactgggtcaagaccccgctctcgctcaagggcaacaagaacgcccccgtgctgttcaacgtccacaactccgaggatgccctgctccgcccgcacgccgtccgcctcgacggcgccagcgactggcgcatcttccaccaggtggtgctgccgatgagccgcaattccatcgccgcgctcgccatcttcaccttcctgtggaactgggaggactacctctggccgttcctcatgatcaccgatgacgacaagcagctgttgtcggtgggcctcaagatgttctccggccagtacggcaccgattacggcggactgttcgccgccacctccgtgaccatcatcccggtggtcatcgtctacctggtgttccagaagcagttcatcgccggcatcgccaccggctctggcaagtaaacccggccggtttcggccgaatccgaaccgcgccgcagtctcccaccagtcccggggagccgcggccgcatcactcgtatcatcgtgaataaccgtacagaaggggtaaccatggcacagtcaccacaactcaagcagtcgtctccgacctcgcccgatccgcaggacttccgcctcgacgccacgccggccatgcgcgccgacaatgtggtgtccggcgagcactggcgcatcggactcatcaccgattcgctcgtgcgattcgaatggtccgattccggcgtattcgagaaccgcccgacccagaccgtcctgaaccgcgatttcggtagcccagtcgaacgccgcgtcaccgagcgtgacggccgcgtcatcatcgacaccgcggccctgaccatcgtctacgaccagcagccgttcagcaaggaaggcctgagcgtggtcgtcaaaggcgtggccgacacccagttcaacacctggcattacggcgacgcccagcgcggcaacctcaaaggcaccgcccgcacgctggacgaggcggacggcgccatcgagcttgacaacggcgtgatctcgcgcgatggctgggccgtcatcgacgactccgccgccaacatcatcatcgaaaccgacacggtgaacggcaaggcgaacccgttcggcacctgggtatccccgcgcgccaccgccgaaacggacttgtacttcttcggctatggccaccgctacatcgaggccgtacgcgacttctatcgcctgaccggccccacgccgctcctgccgcgcttcgccatgggcaactggtggagccgctactaccggtacacgcagggcggctatctggccctgatggaccgcttcaagcgcgagggcatcccgttcaccacctccgtgatcgacatggactggcatcgcgtggacgacgtggacccgaagtacggttccggctggaccggctactcgtggaatcgcgaactgttccccgacccgccggccttcctcgccgacctgcaccggcgcggcctgcgcaccacactgaacgtccacccgcgcgacggcgtgcgcgcgttcgaggacgcctaccccgaagtcgccaagcgcgtcggcatcgacccggccaccgaggagaacgtggaattcgacctcaccaacccggacttcgtggacgcctatttcgacatgcaccaccgcatggaggccgaaggtgtcgacttctggtggctggactggcagcagggcggcgtgacccgccagaagggtctcgacccgctgtggatgctcaaccacatgcactacctcgactcagggcgcggtggcaactggccgctcaccttctcccggtacgccggccccggctcccaccgctacccggtcggcttctccggagacacgatcgtgacctgggaatcgctcgccttccagccgcagttcaccgccaccgcttccaacatcgggtatggctggtggagccacgacatcggcggccacatgttcggctaccgcaacgaagagctggaggcccgctggtaccagctcggcgcgttcagcccgatcaaccgactgcattcgtccaactcgccgttctccggcaaggagccgtggaacttcaaccgtgacgtgagcgccgcgatggtggacgcgctgcgtctgcgccacgcgatgatgccgtacttgtacaccatgaactaccgtgccgccgaagccggccgtccgctggtcgagccgatgtactggcagaacccggatacgccggacgcctacgaggtgccggatgagttccgcttcggcaccgagctcgtggtcgcgccgatcgtctccccggacgatgccgccgcctgccgcggccgcgccgacgcctggctgccgcagggggagtggttcgacttcttcgacggccgccgatacgtctcatccgacgccgctggccgccgactggaggtctggcgctcgctcgaccgcacgccggtgttcgccaaggccggcgcgatcgtgccgttgcaggacgtcgcggaatccggcgaagcgatcaactctatcgccaacccgcaggccctgcgcgtgctggtgttccctggtgccgacggctcgttcgtcatgcgcgaggatcgcggcacgtggggcgcccccagcgccgacaccgcgatagcgttcacgtggggcggggccgatgcgtcgcccagcgccttcaccgtcgcgccggttaccggcgatacgtccgccgtacccgagttgcgcgactggacggtcgtgttccgcggcgtcgcgccggttgacgcggccagcggcgtgcgtgcatggtccggcgaggctccggtcgaggcgacggtggcgtacgacgaggcgaccatgagcctgaccgtgtccgtcaccggcatcagctcggctgccagtctgcgcatcgagattcccggcggtctgcgcatcgccgacaatccggtcgaatcggacgcgatggacctactgctgcacgcccagatgctctaccgcaccaaggagctcgcgctgcaggcggtccacaagctcggcatcggcgcgatcggcgccctgcgcaccatgaaccgtggtccgcgctacgccaacgatttctggatcaccgacatgcccgatgcggtggccggcgcgctcgaagaaattttgctgcgcagctgagcccggttgcagttttctgcaacatccgggtgcgccccggtatgcggcgataagttcggcatggttgccgaagagcgtggcataccgggtgcagtgcgtgggatggccttcgcgattgcactcatcgtgcggtcagtggaaaggaacttttcatgcacaaggtgaaacagcacaagggcgtcgcggtggccgccgcggtctgcgcggtcgcgatggcggcctcgctcgcgacccacgccggcgcggccggggaccggcgttattgactggctggcgttatcgagtgattggcggtatcaattagccggcgttgttgatgagccggtgttgtcgattagccagcgttatcgaccggcactgaagcatgcagtacccactgcccgcgtttctcccgcacatcccaatccccgtgcgcatgcagcacacgctcccgatagtacgcaagcccggaatgccgccccctcaaacgtcgcgtcaccttgacgcggacggtccgtcacatcaatggtgacgcggtcctgagcggcggaaaccagcaccacgtaacgctgcgtcgaatcggcatacctggcgatattgccaaacaattcccgcagaaaatcggcgacaaacactgtgtctgagttattcagcgcatcgatgcccccagcgacaataacgtcgccgacacaccccatgcgccgcaatcgcgcgccgccgctggcaagtctgatggcaaggctgatggcgcgccccagtcaccccttgcagttttctgtataagtggattttggctccaaacgcaccactccgtcatcgccgtcagtcactcccacaaaaaacttgagccaaacatactcaactttttgtgttgaaattgggaatagaacttgccaaatggaagttgagtgatgtaggctcaagtttggaaggtccaagagacgaccaatcggaacttgggcaaagaacgtaagaacaaacgagtaattaaggagcacacattatggcacgtgcagttggtatcgatctgggaaccacgaattcctgcatcgcaactcttgaaggtggcgagcccaccgttatcgtcaacgctgaaggcgcgcgcaccacgccgtctgtggtggccttctccaagtccggcgagatcctcgtcggcgaagtggccaagcgtcaggccgtgaccaacgttgaccgcactatttcttccgtcaagcgccacatgggctccgactggaccgtcgacatcgacggcaagaagtggaccccgcaggagatttccgcgcagatcctgatgaagctgaagagggatgctgaggcctacctcggcgagcccgtcaccgacgccgtcatcacctgcccggcatacttcaacgatgcccagcgtcaggccaccaaggacgccggcaagatcgccggcctgaacgtcctgcgtatcatcaacgagccgaccgcagccgctctggcctacggccttgagaagggcaaggaagacgagcgcatcctggtcttcgacctcggcggcggcaccttcgatgtctccctgctggagattggcaaggatgacgacggcttctccaccattcaggttcaggccaccaacggcgacaaccaccttggtggtgacgactgggatcagaagatcatcgattggctggtttccgaagtcaagaacaagtacggcgtcgacctgtccaaggacaagatcgcgctgcagcgtctgaaggaagccgctgagcaggcgaagaaggagctctcctcctccacctccaccagcatctccatgcagtacctggccatgacccctgacggcaccccggtgcacctggatgagactctgacccgtgcgcacttcgaggaaatgacctccgacctgctgggtcgctgccgtacgccgttcaacaacgtgctgcacgacgccggcatctccgtgagcgacatcgaccacgtggtgctcgtcggtggttccactcgtatgcccgccgtcaaggaactcgtcaaggagctcaccggtggtaaggaagcgaaccagtccgtgaacccggatgaggttgtggctgtcggtgccgccgtgcagtccggcgtcatcaagggcgaccgtaaggacgtcctgcttatcgacgtgaccccgctgtccctcggtatcgagaccaagggtggcatcatgaccaagctcatcgatcgcaacaccgccatcccgaccaagcgctccgaggtcttctccaccgctgaagacaaccagccgtccgtgctgattcaggtctaccagggtgagcgtgagttcgctcgcgacaacaagccgctgggcaccttcgagctgaccggcatcgctccggctccgcgtggcgtcccgcagatcgaggtcaccttcgacatcgacgccaacggcatcgtgcacgtgtccgctaaggacaagggcaccggcaaggagcagtccatgaccatcaccggtggttccggcctgccgaaggacgagatcgaccgcatggtcaaggaagccgaagctcatgaggctgaggacaagaagcgcaaggaagacgccgagacccgcaaccaggccgaggccttcgcctactccaccgagaagctcgtcaacgacaacaaggacaagctctccgacgacatcgtcaaggaagtcaccgacaaggtcaacgctctgaaggaagccctgaagggtgacgacaccgagaaggtcaagaccgctcagaccgagctgatgaccgccgcccagaagatcggccaggtcctctacgcccagcagggtgccgagggtgctgccgctggtgctgacggtgccggcgcttccgctggctccgcctccggttccgacgacgacaccgtcgaggccgaggtcgtggacgacgatgacgacaaggacaacaagtgatgtccgagttcaacaaggacgactacctgaacgacctgccggatccctcagatgctgaggctgccgctcaggcctcttcaggggctgacgcctccgtcgagtccggctctgcgcaggattcggctgcccaggctccttccaatgaaggagccgacgcggctcctgccgcagctgagggagagaagactggcgaaggccagtccgattccgcagacaccctcaccccgctcggcaaggccaagaaggaagccgcagactacctcgaagccctgcaacgcgaacgtgcggagttcatcaactaccgcaatcgcacgcagaaggagcaggagcgcttccgccagcacggcatcatcgacgtgctgaccgcgctgctgcccgccctcgacgatatcgaccgcattcgcgaacacagcgagatggacgactcgttcaaggccgtcgccaccaagattgacaaggccttcgagaagttcggtgtcgagaagttcggcgaaaagggcgaggacttcgaccccaccaagcatgacgcgatcctgcacaagccggacgcggatgccgaaaaggaaacggttgacaccgtggtcgaggccggctaccgcatcggcgatcgcgtaatccgcgccgcccgagtagtagtagcctccccgcaaaactgacggtcagctcgctgcaatgagttgatatttaccttggctcccctctctgaggggagccaatcataaagacttttctagaaaggagacatgaatggctgaaaacgaatggctcagcaaagacttctacaaagtccttggtgtctccaaggacgcttcggacgacgacatcaagaaggcgtaccgcaagctcgcccgcaaataccatcctgacgtcaacaagaccaaggaagccgaggagaagttcaaggacatctccgaagcctatgacgtgctgagcaagaaggaagatcgccagaagtacgacgcgattcgtcagttcggcatgggcggtgcccgcttcgccggcggttccggcggcttcgatgcttccggtttctccgacatctttggttccatgttcggccagggtgccggcggcaatggctcgcgcatccgcttctccacttcgggcggcggccccaacaacatcaacgacatcttctcgatgttcggcggtgctgcaggtcagggcggccagccgtatggcggctacggccaatcgccgtacggcaatgccggcggctatggctatgaggaggccccgcgccccgaaaacggcgaggaccgcaactccaagatcagcctgaccctgcgtcaggcggtcaagggcgctaccgtgtccctgtccgtggacggcaagaagttcaaggcccacgtgcctgcgggcgtcaaggacggacagaaaatcaagctggccggcaagggcaagctaggcatcaacggcggcaaggccggtgacctgtacctgcacgtcaccgtcaagcccgatgccacattctcgatgcgcggccatgatatcgtcatggacctgcccgtcaccgtgggccaggccgtggccggtggcaaggtcgaggccaaggatatcgacggcaatcccgttaccttcaaggtgccggcaggctccagctccggcgcggaagtcaagctcacgggacttggcgtccagcgcagcaaccagccgggcgatctgatcggccgtgtgcagatcatggtccccgccaagccgggtctggccgtcaagcacgccgccaaagaattcgacgaaaaagccggcgactatctcagcctgtaatcaggaggtgaacaatggcgcggttagccaaccagatgaagcagttatacgcgatgtgcgcaaccgcgctcgtgatgggcagggccgatctcgacggagccgatgacgtcggcttcgacatcgaactgcccatcttcaccgtcggccagaccgccgagttggccaacattcacccccagactctccgtcagtacgaccgcctcggtttggttcgtccgcagcgcaccgatggcggcgcacgccgctactgcctgcgcgacattgcccgcctgacccgagctcagcgcctgagccaggatgagggcatcaacctttccggtatcgcgcgcattttggtcctcgaagaagagaatcgccaactgcgccgcgaagtcaaacgcatgcaaaccggcgaccaggagagcgttttcgccgcaggccgtgacggcaatatcgtggagatacaacgctccaaccgcgcccgcctctggcgcaacgccatccgccgcgaaacccgcgaactgcccggccgcgatactgccgccgatatcgctgccggcgccaccggcgactccaactacactcccgccgactccaagtccatggtcctgtggggttggtgagtctggccgcattgcttcgattccttctccattcgtaaaactgtttgttatctcacatcgggcagctgccgaaaagcacgaatcttcttgacggagatgtcaaggtttgttacggtgacgtgcgaaaaccgattcgtaaggggtgctttaggctgagacggtatgtgccgaacccttcgaacctgtgagctaacactcgcgtagggaatgcgacggttgaactcctctgttcggctcggcatcccatatgcgcgttgagagagaggaagcgtatgtcaatacgcaaggagctgaccgcccagaacgtactgctgggtttccagcatgtgcttgtttccaacgtctggcttgatccggtgtttgtggccggagcaatcggcttacctattgccctgtcgtcgaacatgattaacgccatcttcatcgtctctggtctggttactttggttcaggccactcggctggttcgcctgccggtggtgcaggggccgtcagccgcgtttgacgcgttgatgatcgcggcaggtacggccggcatgctgggggcggcgagttcgtccattctcatcgcttcgcttgtgttcctgttgctgtgcctgaccggtgtgatagagcggatgcggttcctgttctctccgatgatttcgggcgtggtcatctttatggtcggtgtctcgctgtctggattcacgctgagcgagtttctaggcggggctcccggcgacaagacgttcgccgatccgcacatcctgaccgtgtcgattctgaccacggcgattgtgcttgtcctgtcgttgctcggcaagggcctgctcaagtcgttctcattcctcatcgcgctcgtcgtcggcaccgtggtcgccgcagcgtttggcatggtggacttctctcctgtggcatccaagggatggttgggcctgccgaccttcctgccctacggtccgttcacatttgactggaagatcttcatcccgttcttcattgcctacatggttgccgtcatggaagctctcggcgtctatcaggcggcttctgagattcagggcacgtccctcgaacgcaagcaggtgcgctacggtcttgccggcgaggcggccggttcagccatttcctcgctgattggtggattcaccaccaccgcctacccgcaaaatgtcggcctgctcaacctgaccggcgaaggcaagttgcgcacgcgcacgcctgtgatcatcgccgctgtgctgttgctgattctgggcttcgtgccaaaggcgggcgcgttgctgtccgtcattccctcggcagtcgtcggaggcattttcctgccggctgcggccagcctaatcgtgaccggcctgcgcgccctgcgcaaggtcgctgatgacgagcgccgtcaaacggtcatcggcatgtctctgttgctcggcatcgccctgcccaaggcgctctccggcctgaccggcggcgcaagcgtgttctttggcaacaacatcatggtcggtgtattcagcgccatcattctcaatgcgcttttcgtcgctcttccggatttggtggcgaagcatcgtgcgccggcgtccgtggatgttccagcagccgatccggcggatgggactggcgctgcggcgtacgatgaacgataatgctggttgatattggatattgacaggagcgatgcaatgactgatgtgatggatgacgcgcgtcgtatcaagcgcgggattctggattttatccatacctatggctgtgagcaggccccggaagaggcgtttggtgcgttggcgcgcgacgtgttcatctatcagtacacgtatgatctgccgtaccgtcgttactgcgcggctaaacgcgtcacccccgcaacgctcaaggattggcgggagattccgccgatgccggtggacgggttcaagcaccttgacctttcgaccataccgaccgagcagtgcgaagccgtattcatgacgagcggaaccacgcatggcggcaagatgcgtgggcgcaacttccatcccgatcttgaggtgtgggatgaatcaatgattgtgccgttccgtcatttcatcatgccggatcgagagcgtatccgcatcgccgtgatttcgccggcatgggacatgaaccagaactcctccctgtcgcgctaccttaccaaggccgtggagtgctgcggcagcgaaggcagcggtgtgttcttcgacgagcatggactcaagttcgatgaaatcatcgccttccttaaccgtgcggtgtctgacggtgaaccggtgatgctgatgggtgtctcgtcgtcctatctgtatctgttcgattacctgcatgagcatgatctgacgttcgcgctggcccccgatagccggttgttcgacactggcggcttcaagagcactaagcgcgacatcaccgaagaccagatgcttgatgagctggaacagacactgggggtgccgcgccaccactgcgtcaacatgtatggcatgaccgagttgagctcgcagatctatgaccaaaatattctgtcgtggtatacggatggcaccagcaactatctcaaggcgaaccccgcctgggtgcgcacggtcttcctcgatccggaaacgctgactcccgtcaaggatggtgagaccggtgtgatagcccattacgaccttgccaattggaattcatgcatcggtattctgaccgaggacctcggccatcggaccccggacggattcctgctgcagggcagggcgaagggagccgaggctcgtgggtgctcaatcgcggtagacgaggtcatcagtgccaaccgttgatgaatccgtgagtcaggccattgatgtcttccacctgccctcgggagtggatgtttcggattacgaaatctatgaggtcgccacatcggatggggtgaagcgtttgcgctatccgcgactggatggctcaaaggtgacttcccttgccaagcagcttgtcgatgttcgcaaccgcacgcttgccgcgatgagtgtcaacgatattctcgacatcgtggccgacgcggcccaactatgggccgatccggattttgagctgcggcgtcaggctgaactgctgattcccgcaatcaccggatatgagcctgacatggtgcggattgagctcaaacggtatatgcgccagttcaggcgtcgtgaactgctccggttccttgactccgaaatcggtcagccgtctatgctcgacgaattccggccgaacaaggcggggggatactctaaatatgtgggcccagcgctcacctatcaggtgttctccagcaatgtgccggggattcccgtgtggagcatggcgatgaccctgctggtcaaaggcgcgattcttggcaaatcttcattttccgagccggtgatgcctgcgttctttgctcgcagcattgcgatggtcaattccgacctcgctgatgccattgcggtggttccatggaagggcggctcgcagcagctcgaggattcagccatcgatgcggccgatgccgtgattgtttacggttcttcgcagactaccaaattgattgcgggcaaagtcgccgggtccaagccctgtctaggttacggagcaaaagtcgggttggcgttcattggccgagaggctttgcgtcctgatacctatgccgataccgtgcatcgtgtggctgttgacatcgccacatatgaccagcaaagctgcctggctccgcagaccgtgttcgtggagactgatggagccctcacccctcgtgaagtggctcagctgctcggtggcgagcttgagaatcagcagcgcaaatatccgcgctccgtattgagtgacgccgagaacgtggccattcagcgggcgcgcaccgacgctgagatgagagccttgatgggcgggaaggccgcggtgttcgccagtggccatagcacggcatggtcggtgctgtatcgagaacttgacggtagcggtgccgacgaggatgttgcttcgctgatgtcgccgttgaaccgcaccgtcaacgtggtggcggtgccagatttgttggacgctgccagaagactgacttcctgccgtggctggctgcagagctgcggtgtcgctgtggattcaaccagactgtttggtcttgcagatacattggccgaggtcggtgtgaatcgcatctgtccgctcggtgagatggatcgggcgaaatccggctggcatcatgatgggggcttcaacctcatcgatctgttgcgcgtggtggatgtcgaacgcggcagcgacgcgtacagcgattcgttcgatatggatatggaataggcctgtgctgttgcgggcagcagaggctggtagcagggcgaaaggcaagggtaatgacagagcaaagcgatatggcacggcgtccaatggtgaatctggatggcagaacagcgatcatcaccggttccggcaagggcataggagcggctgtggcgaaatgcctggcatcgcacggagccgctgtcgtcatcaattacgtacatgacgccgccagcgcgcagcgcaccgttgaagacatccactcgctgggaggcttggctatagctgtacaggcggatgtttgcgatgaatcgcaatcttccaagctagtgggtaccgctgtcgactcattcggcggcgtggacatcttagtgaataatgctttcggacgcttctcctttgacccgcgtcgccgttccacttttgctggaggcgattgggatgagtttagcgcacagatcgagggatgcctgcatggtgcatatctgatgtgctcacatgtggtgccgctgatgcgagcccagacctccgggcgtatcatcaacatctccagcaatctggtcgattcgcccatcgtgccctaccattcgtatatcactgccaaaggcggcttggtcggcatgacccgctctctggcccaggagctgggcggcttcggcattaccgttaatgccattgccgcaggtttgacggccggaaccgcatccagcgcagccaccaccgaggatgttcgtgaacgaatcattgccatgacgcctcttggccgccttgcccgtcccgatgacatcgccggaggggtcgcgttgttggcgtccgacatggccggcttcattaccggacaatgtctgcacgtcgatggtgggctgaccatgcgctgaggcgcaggggcggtgtgctgacgcgctatggttgtcgcatccgattggtgcaatggaatgcagcaagagtaaaggcgccaattggcgtgcgggcatgtggacggaggtaactatgctgctcaaagccgtgttctgggatttggacggtactctcatcgattctgagccgctctggcatgacggtgagattgagatcgcgcacaacaatggcggcgagtggaacgaggacctcggttgggagtgctccggcactccggtaccacacgtggcagaggtcatgattgcgcatggctgcacattgagcgttcccgaaatcgacaagcagctcaaggattatgtgttcaaggcggaggtcgaacgtctgccgtggattcctggtgtgcaagacgtgctgcattcgctcaaggaagccgacatcccatccatgctggtcactacttcgcctcgccgcatggccgagaacatcatgaagcaggctgatggattgcttgccggctacgtctgcggcgatgatccgtacgagcacaagccgagccctgccccatatctggccgcggctgagagactcggcatcgcgcctgaagacatggtcaagtgcgtggtaatggaagattcctcatccggtctgcgctccggcgccgcctcgggggccacactgattgcgcagactggctggattcgcaccgacacttccggccttggccagtttgcctccatcgactcgtatgagggcatcgatgcggccgcgctggacgcctttgtgcggcagcgtttgggggagtagaaatttcgtttgtattgcggagtttgtgtgggaaaccccagtcgacctgatgttataggccggctggtagggtatttgacggtttgcatataactgtctggttcattgggctggcagctcaatacaagatttaggactcataggaaacacatgggcttcgttaatttcatcatcgaactgctgaaggatccgcgtgccgcgattgccggttggattgccatgggcgtggcgccgaccctcggattcatcttcctcatcgtattcatcgaaacgggcgtggtgttcttcccgttcctgcccggtgattcgctgttgttcgcggccggcgtgttcgcagccccggatgctgcgaccggcaaggccgcgctgccgctgttctggttgctgccggtggtttggtgcgcgccgattatcggcgaccagtgcaactacttcatcggtcatttctttggccgccgtattatccaatccggcaaggtgaaggcgctgactcctgagcgactggccaaaaccgagggcatgattgaaaagtggggcccgctggctgtgttcctgggccgcttcttcccgttcattcgtacgttcatgccgttcatttccggtatttccggtatgcgttggagccgtttcacgccgttctcagtgctcggcggcctgtgctggtccacgttgttcacgctgctgggctacttcttcggcaacattccggccgtgcaggatcacttcgaactggtgatcgtgctgattctgctggtttcgctcgccccgaccatcatcggtctgctcaaggccaagttcggcaagaagaagccggccaaggtgaccgatgctcagttggacgtcatggaagacggcatcaagaacctcgataagtaagcaaggaatgtagattaccgcataaggaatcgtcgtgaaaatgaaggccctgactgtgcatatgaggtcagggccttttctgcatgagatgggcgtgaaacaacagcgtggttatccacatttgtcgtggacgacatgccggggtgtggataactcagcaagctagaaccacaatggtcgattcgtgttgagcattgaactcggacacgtttcaatcggcttatgaatagcaacaccacaccccgcgtggcgcgtaggatcacctcgccagcggtagcacctccgggcattccgctgcccacggacgatgcgccgattccagcgcatcgctactacactccgccgcccaggccgttggcctcatgcgaacggcagagatcgggcgaggctccggcactcgccctaactacagacaccagcttccataacattgtgacgatgacgtcaggtcatggaggcgtggggttgagtgtcatggcttccatgcttgcatggacattggcgagacgtgaacacagctgcgctctcatagacgctgatttcgtggccggatgccttgacctgctgctgggtgtagaacgagagccgggtttacgattcagccaagtcgacgcacccctcggccgcatcgagggcgatgcgatgaaccatgagctgatgatgtgggagggtgtgcgagtacttccctatgacccttggagcgcgcgccagcctgactggtgggaagttcaagcggccattcgagccttggcggaaacgaacgacgttgtcatcgtagatgccggtcagggtggactcattgagaccgtacccgatctgcgcagtggcatgcaggtgattgccgcggaattgtcggtgatggggctggccagagccaagtcgcaccggtccagactggattcatggggctgtgaagcgccacatatcgtcggcgtggaaccacgtggcgctccacgtgggagaggccacgtgggtattggtgaggcgcaggactatttgactgccacggtattggggcctgtcaaaccaagtgtcaatctgtgtggagacgtactggaaggcctcggcatcagatcggtgaccaaaggcagccgcaaagccgtgagcttgcttgccgatcttgtcgagcaggccattcgcccggtttcgggagcttcttgcaaggaccggtgatgcggtatggctgccgtaatcactcgggctgatgagcccggcgcagtgcccagaactgtgttcttcggtctattgaatgatgtggcatccgacccgcaggttaccgatctggcggtgacctgtgatggccgcgtttgggcggaccgcggcaacggcatgcgagaaacagtattgcgtgtgccgtttcgctcgccgcaagtagttcgagaatacgccgtccaactgtgcgcgcagcttgggcgcagactggatgatgcctgcccgatagcggacgccgccagtccagacggcatccgcgtgcatgcggtgattgccccattggtgccacaaggtgccgcaatctccatacggttccctgacaggaccatggcatcgttgcgacatctgagccaattaggtgtattcccggctgcttggctgccgatgttcgtgggactggtgcgcagacatgccacagtgctgattaccggcggaacaggcgtgggcaagaccaccttgctcaaggcgctgctggcgcaatgcgatgtgaacgagcgcatcgtcaccgtagaggaagttcgtgaactgggagaactggggcgtggcgatcatgtgtcgttggtaacgcgcgaggcgaatgtggagggcgtcggagccataagtctgacggacttggtcaaagcgacgttgcgaatgcgccccgaccgcgtggtgctgggcgaatgccgtggcgcggaaatcgtcgacctattgcgcgcgttcaattctggtcatcacggtggcatgaccactgtgcatgcggacggcgtgaaccgagtaccgtccaggctgatttcgcttggattactcgccggagtcagtccacaggcgttggccatgctggcggcaggcgctttcgacgcggtggtgcatttggagcgagtgaacggacagcggcgtatcacgcagatcggcgaactgcgtgtagcacatggtgaactggcaggaacaccgctggcggtatggaatggctgccatcctcctcggtatgccgccgaatgggggcacttcattgaacgatggggcatcgttcccgggccgagtggtggtgggtgatgatgtggtgtgctgttctggtggcgctcgccgtgctgatatggccggggaacaagtccgggaggctgtatcggctggcttaccgcgggcgtgcggtcgattccgcagccataaacgaacctcgatatgccggctcacctcgcgtgggcgttgcgcaggtgattacgtccgccatcgcgcgattgcgaggtggcggcacattggttgaagcattcgaggaacaatccagcagacgcttcgccactcagcgcattactgtggaacggctcataacggtgttcgaacagcggcgtctgcccgacgaatcaccagcgcaggtacttgaagctgcacgcggggtcaccgccgcagcggttttgagcgatgagctcggttgccaagcagtgccatgtctggaagcggtattgactgcttaccggcagatgaggctgatgcagaacctgcgatcgcaagcatgtgccgttcctaaagccactgtggggctgctgagcgcgcttccggccgtcactgtggcattgggcgagcttctgggagctagaccattggcgttcttgcttggatcgccacgcggtgtggtctgcttggtattagggggatgttgttatgctgccggcttggcatggatgcgggcattgttgaaaggcagcggattatgagtacggtgtgggtacacgccgcggcaggctgtgcggcgatcgctagttggctgtataaggctccgtcttgtcatgacagccgcttgccgggcgaggaaccggccgtagcgcatgattgcgggtcgtcatggaccatactcatattgcgtatgtcgcaggtgtccttgcgtcagggctcctcgattccccgggcgcttgacatggtgggcaaagccgtcggcggcgactgcggcgctcgcatgagcgaggtcgggagctccctggccagaggggttccctgggctgatgcgtggcatgccgctatggctgttcagcatgagggtgcgccagctgatagttcatccggaaaacgtaccagcagaacgcaacgagatcttggcctgctgcaatcggctttggaatcgtcatggacgcatggcgatatgcctggcgtgcgcctcgaatccgccattgaacagctggaccgtgacgagcgtgccgccatcgaacggaatgccgcgaagctgtcggtaaagctactgatgcctacagggctatgttttctgccggcattcgtgctggtaggagtcattccggcgattgcgtccttcatgatgtgaatataggcgtgaactgagtgcgcttagggtgaatcttgttgtattgctcggtattgcacttggctgcgtttggttatccacattggtggtggacgacacgtcggggtgtggataactcggcaagctagaaccacataccccgttttccctggtgcatgaagcgttgatagtccacagtggtatgcaccccgcgtcaacccggcgcgggggccaaccactcacacacgcatggggaaggtgcgaagccactgcgcagcttcccctccttaccgaaaggaacgccaatgaatacccctatccccgtcatcgtcgacgggcaggccggcatctttgcgcacagcaaggctcgtgtggccacgctgaacgccaaggcgaaagaacggctatgcctcatggacgcacgcatccgcaccctcatggctgagcccgaagaaggcgcggccactgcggaatacgcagtcgtactcgttgcggctacaggctttgcggcggtgctggtcgccatcctgaagtcggatgccatcaagacgttgctgaccaacatcatcaaacaggctctgaaagtcgggtgacagccatgaagaccatgacatgccggtggcggctcgccagactgccgccagacctatgcacggggtcggccaccgccgaattcgcaatcgtattgcccagcattatcgccatcgccgggctgatattggcaataggacgtgtggtcatcgtttccatggactgtcaaagtgccgcggcagcggctgcacgcgagtttgtggttaccggtgacgaatcatccgcgcgcagcatagctgcggacgttgccgggggaaagccccacgtcagcattgcccacgacggccaatcgacgagtgtgacggtcgaatgttcggtattgcccggtccgctggatgtaactccaacgcgggttaccggcaacgctacggcgataagccaataacggtcggctggctgggcggccgcaacagaaaggaactgcggtgcagggaatgcgttatgaggagggatcgggcacgatggccggagccatgctggttatggtggtgggcattgcgctcgcggtggcggcaagtgtgggcaacctcatgatctgccagaaccgagcgcgttccctcgccgaccttatcgcctttgacgccgcgtatgcgctgtggcatgcggatatcggtgatccatgtgcgctcgccgccaacatggctgaagcgaatggtgtagttttgggctcctgctccgtgcgggatgaagacgtgttggtaaccatcaaggtggaaaccatggtcctggtggcatcatccgtggagcggatggctcgggccggaccggtgagttgtacggaaggagacaattatcacaataatggaccgtaaagcaccgatactctggcgggcttctgggcctttggctaaggtgagagcatgagcgagagtgaacgcaacgagcgccgtcgcgtggtggccatggtgggcaaccccacttccgataaaggccgtggcgctaaggtggacgcgcaggtattgggtctgctggaggaagccggccgtgcccataacttcgacgtcatcgacatcaccggcacgagtttcgacgattccctgaaccaggcgcgtgaacgcgagcacgagtacgactatctcgtagtggtcggtggcgacggcatgatcgcacttggagcgaacgccgtgggctgcagtggcaagccgttgggcatcgtggccacggggtcgggcaacgatttcgcacgaggactgaagctgccggtcaaccgtatcgaaaccgcagtggaaggtatcgtcggtgctatcgtgcgcggatcacacatcgatgtggacatgggacgcgtgacctctttggacggcggctatgccgtggatccctccactggcgaggagtacgagtaccaggagagcaagtccgccgagcatccgattgaccggtactatgcgggcatgctgtcctgtggtcttgacgcgagcatcaacgaccgtgcgaatcattcgcatctgccgaccggcaccatgcgctactttgcggcggtgctggtggagctgacgcatatgaagcgttatggttaccacatcaaagccacattggcggacggtaccacggatgaacgagacatcatcacaccattgctgacgattgcgaattcgaggcatatcggtggcggcattgaggtctcgccgtactcctgcttctccgatggattgttggacctggtgtggatggaccacgtgccgaacttcggcgaatgcgcggtggccatttcgaatgcctataacggcaagctacttgcttcaaaggtgttcggctggaaacgtatccgtgaaatcgaagtcacgcgggcagcggaaggcgacgagccgccggtgctgatggcggacggcgaatatatcgggcatttgccatttagggtagtggccgaggactgcgcgttgcgcgtgctagtgccgccggccgtagccgcccgtgaggtggattcccgacaggaagtgctcgacgtcattgcccgagatggtcgcgatcccgtgaccggccagttcgcgtgacccgattatattggctcccctcattaggctgagccgtaaagcaaacagcccagtgggctgtttgtaggcgagggttcgacgatagtcgaaccagaagaaagtcagccgtaggctgtccgcaattgcggacgagctggccgcgaagcggactgaggggagtgcgggagagcggtaccagagccaatgcccgtcagacctcagacgacatagctttcgatatgcagcgtctgcgccatgacctctttgatggttcggtcgctgatgttcggatgcgagcgaatcagtgagataagccccacaatcagtgtgaagaacgtctcatggacgttggtgattggcaggccatgcatctgctcgaaatcacgtacggtggtctgggcaatgtagtcggcaatacggtccgccgcgcggtcaatgaacttgatatacagttcggcgttgccgtcttggatcatacggtttgagaaggggctctcgtcggcgatcagggagcggagtacatgcacgatgtcgtctaatgccttgttcacgttgcctgtttcgcgcgcttggttccactgcttcaacgtggtgaggatttcgtcgatgacgttatcgagtactgcgtcagctacggcttccttgtcttcgaagtagtggtagaacagcgaacgcgtcataccgacttcgcttgcgatgtcggaaacggtgattttggagaagcctttttccagacacaccttgcgcgcggcttgcacgatggcgtcgcgccgggcatcgccgcgggtgggacgtttctcgtcgagggtatcgctcatgggtgcctcctgaccacaaccgttattgacactatgttaatacaaagaaagcggttaataacaataaaaatgcggtaaccgttgtcaggtgaatgtcgttggaatataaagagttttcccgattcggcaactatgagcccggtttatcttgactttttatcggttaattctgagggcaaaggtaggttagtagctatggcacttgcactgtatcgtcgctatcgtccggacaccttcgaaggggtcatcggccaggaccaagtcacggtcccgctgatgcgcgccttggacgagggcaagctcacacatgcctatctgttctcagggccgcgaggctgcggcaaaaccagctccgcgcgtatcctggcccgttgcgtcaactgtgccaaagggccgacttcccacccctgcggcgaatgcgaaagctgcaaggacctggccaccggcggtccgggttccatcgacgtggtcgaaatcgatgcggcctcgcacaacggtgtggatgatgctcgagaattgcgagaacgcgctgggttcgcccctgcgcgcgaccgctataagattttcattctcgatgaggcccacatggtcacgcagcagggcttcaatgcgctgcttaaaatcgttgaagagccgcctgaacatgtgatgttcatcttcgccaccaccgaaccagacaaggtgatcggcaccatccgttcgcgcacccaccactatccgttccgtctggtgccgcaggaagtcatgggtccctacctggagacgatctgcgacaaggaaggcatcaagcccgagcccggtgtgctgaaactggcgatgcgcgccggtggcggctccatgcgagataccctgtccgtgcttgaccagctgatggttggttcggtcgaaggcgttatcacccatgatgccgctgtagccctgctcggcttcacgccggaggcactgatcggcgaggccgtggatgcggtaatcgatcacaacggcgaagccctgtacggcgttatccagaaagtcgtggtcggcggattcgatccgagacgattcgtcgaagacctactggctcgtgtgcgtgatctgctggtgcttacgttggccggggaccgtgcggaatccgtgctgtccgacacggctgaggccgaggatatggacgatctgcaccgccaagccaaggcgctgggactgggcgcactgaccgcaatggcagacatcatcaacactacgttgggtgccatgaccggagccatttctccgcgtatgcgcttggaactgctggccgcgcgattgttggccggcagtgaatcaggctttgcaacagccgctcccgcgccagcttcttctggtatgccgcctgcggctgcttcttcgacttcgactacgtcagccgcttccggtacgggtgccagtggttttgccggcgcatcgcggggcgggtttgccggagcctcacatggcggattctccggtgctgcacgcaaccagcaagcagccgcgcctcagagcaccgcttcccatgaatctgttggaggcaacggccctgtcaacggcccggtcagcgaccgacccgcgggctctctgtctgtgcaacctgctgtagcaactgctgctgccggtgccgctcctgccgccaatgccgggtggggcgcgcccgccgcgtcgccggccgtcccggctcaaccggtgacctcgcctgcggcatcggataatcggtccatcgacgagaagtgggatgcagccgtcgccgctttgccggaaaccattcgtgaatatgtgtcacgagacaaggtgccgaccgtaaaattcggccccaaccgtaagggtctgccttgcttgtcgatgacgttcgacaagtcgctgagccagcacgctttcgccttggccgtggataacagcggtaagaaggcggcggccgtggtgatggatgccgtgcgcaacgagttcggcgccaatgcggttattgcaccttctgcggtcgcggcgaatggcgagcgagtcgaatccgtcaaacgtatgagcccggagcaattggccaaggtcaagcagcagattgccatggccaaggctggattggccgcgtcgagtttgggcgcgagcctgggcattcatatggggagcgagacgaaagctccgaagccgactgcaacaggccaagccgaggacgcagacgacagccatcgagccggacaatccagtgcatccacggcagcgaagaactggagtgacgatgacccttgggccaagccggccgtaagcaacgcttcgccgcaatctgcagacgggttcgcacctaacgagcccgctgctacgcctgcgcccgaagagcatcacaagaagcatgttgcggttccggacatcagtgacggtgttgatccgtgggccgctccggctgctcctgttgcacccactgcgtccgttgcgtccgctggacccactggacagtccactgggcagccagccaccgcatcttccgttacggcagttgccggcgcgagcgacgatccatggaatcagacgcagtctcaggccgcggtctcaccggcgtcgcaaccggccgaagccgacccgtggaaccagccatatcagcagtctcctcacgatgatccgtggaatcaaccgcaggggaaccatgctcaggcggctccgcagccaggagacgacccgtggaatcagcctcagtcccagactccggcttcttcggttcctcagacagtgtcgggcaatatgtcgggcgatgacccgtggaaccagccccaatcggttccgcagccggctgccggcgatgacccgtggaatcaaccgcaggcagttccacaatcggctccgcaggccaccccgcacggtgacccgtggaatcaaccgcaacccgcacagccgaccccgaatgccgacccgtggaatagccagccccagccccagccgaaaccacaaccgcaagtcgcggccgaggatgacgaatactcgatgagcgaccagtcgctcggcgaggcgacggccatgaatctcgacgatctgaaaaagctattcgaggtcaaaaaagtcgagcaattcgcggcagatgatccgaagaaccccaagaacatccagcctgccaagaagcactcggatgaataatgaggacgaataacgaggaatacccatggcacttgcttatgacggcgcaatacaacgactgatcgacgctttcgggcggctgcccggcatcgggccgaagggcgcgcagcgtatcgccttctacatgctgtccgcgcccgaagatgaagcgcgcgatttggccgaggccatcgaagaggtcaaggccaagatccgcttctgtgatatttgcggcaacgtgtgcgaatccagcccctgcccggtatgcgccgacccgagacgcgaccgttcggtgatctgcgtggtcgaagagcccaaggatgtgatgagcatcgagcgcacgcgcgaataccacggcctataccatgtgctcggcggcgcaatcaacccaatggccaacgttggccctgccgacctgcgtattcccggtctgctcaaacgcttagaaggcgatgaggtcaaggaagtgattatggcgctcgacccgaatattgaaggcgaggccaccaccagctacttgacccagctattgcgacccgtaggtgtcaaggtcacccgacttgccagcggcctgccggtgggctccgacttggagtatgccgacgaaatcacgctgggcagggcactggccggtcggcgcgaggcctaagccagcgtatcattggcgctttcgcccttgcggcgcatccacggccagaatgcgccgtggcggatgatgcgcgcggccttgtggcgtcgtgccaaccagataatgaacagtcctgccgccagtatgcctagaccaacaccaagggcgatattgcgcgcgtcaagcacgtcattcggctcgggggccggcatcggaatcgccacgcggtgcccggagataagcagtcggtgcgtgttcacgccgtatggcgtacaggtcatcaaagtgacgcgatcctcacccggcacgatcttgagcttcgacgtgtcatccggcaaaatcaccgaaatgcggtccactttgtagcccaaagtttcgcccatgacttcgatgtagaagaagtcgccctctttcacctcgtccaaacgggtgaacatcagcgcttcaaccaacccgcggtgcccggtaatgaccgaatgggtggatttacctcccaccggcagcgacgtgccgtacaagtggccggcaccagaagccagtgcttcctcggaagtgccgtgataaaacggcagattgatggactgcttgggcaccttgattgtgcccatcacgccgttgccggtattaagcagtgactggtattccttgtctttctttgaggcggaatcctcgccgctggcttgggatcctccttgagcggcggcgaacggatcgacggcttcacccaagataggctggccggattcagcgagcttcttgttgtatgcgcgggccgccgtgagcttgtcttccgcctgcgggtaaggccagccagctacttctttggccgtggtggctgtggtggcggccaagttgcggtcggactcgaattgcaacgctagcgggaagcaggccacggcgattgcggcgatcagcagcacaatggtgatgatgcgcatcgcccacaggttgcgttgcaggcgtcggcgctcggccacgagatcgctgatatcgatgacttcgtcaaatggtgttggaacgaatgctgcgggctcgggccgcgctgaggaaacgttgtcatttgcagatgcgtcatccggcatggccgcgttgttttcccacattttctgtgaggcacgcttactcgtcgaacgtcgatgcagcaatgccatagtcgcctgttccttcgcttgatctgctcatgatttgcttatacaagacggccgggtccgtcttagtcgtgcatggcataggtgctgtcgcaaatggcaacaccgcacgcgccacactgcgaaacgttactccgcaccaagcctttcatgcaacatgccgacggggccatataggggcaatgtagggggcataagaagtctgaaaatgcgatacgaacaacgttgctacggctgtcagtgatgcggcttacttcggacaagccgttgagatgcaaggggatgcaaaggattgcaaagtatggcaacatgataagtcgcggcgtcggcaatatttggcagagctttcaaatagggggggtatgaatgcataaagagggaatatgttacctcgataaaagaggcgctattgctgttttcgtggatgtcggttcgtcgtcgagccgttggtttcgtaggcgtgaggggcgttcccgcgtattctgttttccgaccaaagaaatgaatcacgaagaacgcctgagcaaaagctcattcgccggattgccgaacgtcaaaggcgcggttgcagaggatgcgcggatcacggattcgccgctgcgttccgaattggctagtgtgatcagagaaaagatggcactgtctgggcatctctctttttaggtcaaggaaaagggtctggcgataggcggtgatgacgcccatcgtgttggtggcactgttgctgcaaaaaggaaaagtctagttcgtaatctagtgtccaacttccctaataggaatggtccaacttccacaacgaaaatagtccaacttccacaattagaatggtccaacttccgcaatagagtgatttataggttgatgtttcgacggtttgcgggagggcacatatggcagtggagagctcggagattcaacgtggcgagtaccttcctcgagtggctgatgggttgctgactcaggcattgcagtcttctggtgccgttcagattaaaggtccaaaatggtgtggcaagactgcaacggcagaaaggcagtcggcgagtcaggtcttcatgcaggacccggatcgcagtgctacgctgttggccttggctgatacaaagccttctctcatcctgcgaggtgaggagccgagactcattgatgaatggcagatggccccgcaattgtgggacgcggtgcgtttcgccatcgatcgagggcgcggtcgtggccgattcatcctaactggatcggcgactcctcaacaggaaccagctcattccggagtgggaagaattgcccgattaaccatgcgtaccatgtccttatttgaatcgcaggaatcgacgggcgttgtttcgttgggagagttgttcgatggcaaccatgatgtttcgggtttctccgatttcgatattgaaaacaccgcgtttgcgctatgccgcggtggctggcctgaagcagtagtcgaatctcgagtaaatgttgccttgcgcatggccgcggattatgtcgaagaactacttgattctgacatcaatcgtatggatggtataaagcgcaataaaacttggatgcgtctgattatgcgctcgtatgcgcgcaatatttcttctcaggcgtcgcaatccactatcgcggcggatatgcagggtgaaccgccttcggaaggtacactctccgattatttagatgcattgtcgcgagcttgcgtaactgaagatcttccagcttggaaccctcgtttacgttctaagactgcagtgagaacgagcccaaccagacacttcagcgacccgtcgatagcttgtgcggtactgcacgcgaccccggagaaactccttaatgatttcgagacctttggcttgctgtttgagtccatgtgtattcgcgatctgcgtgtgtatgctgatgcgcttggcggagatgtgttccattatcgggataagacgggattggaatctgatgcggtcattggcctgcatgatggacgatgggctctcattgaggtcaagctcggagaaaagcaggttgatattgcggcggcccatttgaaaaagttggctgacagaattgatcaagatcacgaaggccgtccgtcattcttgatggtgctgaccgctacggctgccgcttatcgccgggatgatggggtattggtagtgccgttggccacgcttgctccgtgagctcgtatcgtgcgtttgacccatcgttcccaacacaaaaggaaaaggcccgggctgcgggaccgggccttgaaaaggagagaggaagaagaaggtattcagttatggggtctgcggaaacctcgccggtttgctttcgtttgccggtaattgatagttaaccgctcgaatctcaaaggatggatgcggctgcctcaaagaaccaccggtgaaaacttgaatatttgctgaacaacgtaggccatgcccgtgtccacatgtcggcgcggggtcgcggggtgaacgcggcaacctttataatcgttgcgtttgcgtagaatattgagcaaactccccctaagagaagaacaaaggacagcagtggctctcatcgtgcagaagtacggcggttcgtcggtcgccgataccgaatcgatcaaacgtgtggccaagcgcgttgttgagacggaaaagaagggcaacaaggtggccgtggtggtctccgccatgggcgacaccaccgatgaccttatcgatcaggcgctgagcatcgactccaacccgcccgagcgcgagatggacatgctgatgaccgcaggcgagcgaatttccatgagcctgctggccatggccattcacgccgaaggcagccgtgcccactccttcaccggtcagcaggccggcttcttcaccgacgcccgttacggcgcggcccacatcaaggccgtgagaccggaccgcgtgaagaacgcgctctcattgggagacatcgccatcgttgccggcttccagggcatcaacgccaagggtgacgccaccacgctcggccgcggtggttcggatacctccgcagtggcgcttgccgtggcgctcggtgccgatatctgcgagatctacactgacgtggacggtatcttcaccgccgacccgcgtatcgtgccttccgcccgccgcattccgtccatcgattacgagtccattctggagatggcgtcctgcggctccaaggtgctggcactgcgctgtgtggaatacgctcagcgtttcaacatgccgctgcacgtgcgttcctcgttctcccgtcgccccggcacattggtggtgcccgacggcattgacccgcgtacgctgccgaacctcgactgagcgcggctacagcgaacgataatcgtaagtaatttcaagcaagacaaggcaagacatgactgaagaagaagcgaaatccatgggcgacctgttccctgacctgggccccgaggcaccggtgatttccggcattgcccacgatcgttccgaggcgctggccaccgtgcgtggcgtgccgaacgagccgggtatggccgccaaggtgttcaccgagctggccaccgccggcgtgaacgtggacatgatcgtgcaggccggcgcatccgtcggcactgcggacatctccttcaccgtgcccgaatcggccgtcaagcaggttcagaacacactgctcgacaagcaggaagtgctgggctaccactccttcgatgtggacaccaacgtaggcaaggtggccgtggtgggcgttggcatgaagacccatgccggtctggccgccaagttcttccaggccctgagcgatgagggcatcaacgtgctgatgatttctacctccgagattcgtatcgccgcgctcgtgccgctcgatcagctcaacgacgccgtcaaggcgctgcacaccgcatacggtctcgatgccgatcaaatcgaagccgtggtgtacggcggtactggccgctgagccactgagccgcgtttttgcggtatatacgacgaaagccctccttgcggagggctttctcagtttcggactcagtttcaactacttcttggtgatgtagccgagagccttgagcatttcggcgcattcaagggcaccgccggctgcaccacgcagggtgttgtgggccagacccacgaacttccaatcgaagatggaatcctcacgcagacggccgatggaaacgcccatgccaccctcgtagtccacgtcgagcttgacctgcgggcggtcatcctcggtgaggtactggatgaagtgcttcggtgcgtgcggcagctccagctcggaagccttggacgtgtagttcaccagacggtcgatgagctcttccttggtggccttcttgccgaagttcaggaacacggtggcggtgtggccgttgagcacgggcacgcggatgcactgggaagtgatcttgaggtcgccgtcgaacggcacgatctcgcccttggcggcgtccacatggccgaacaccttgagcggttccttctcagactttgcttcctcaccggagatgaacgggatgatgttgcccaccatctcgggccagtccttgaaggtcttgcccgcgccggaaatcgcctggtaggtgctcacaaccacctcgcgcggctcgaattccttccacgcggccagcgccggcgtgtaggcctgaatcgagcagttcggcttgacggcgataaaaccacgagtggtgcccaggcgcttgcgctggtgctcgatcacctcgaagtgctccgggttgatctccggcaccaccatcggcacgtccggggtccaacggtgggcgctgttgttggagaccaccggggtctcggtcttggcataacgctcttcaatggcgcgaatctggtccttcggcatgtttaccgcagagaacatgaaatcaacgccagaggccacggactcggcatcgtcgccatcgacgaccaccatgttcttgacatattcgggcatcggggtttccatcttccaacggtcgccgacagcctcggcatacgtcttgccggcgctgtgcgcggaagcggcaagcgtgaccacctcgaaccacgggtgattctcaagcagcgtgataaaacgctgaccgaccataccggtggcaccaaggatgccgaccttcaatttttcggacatgatgacctctatgacctctgggtttcgatggattacttacgtcggacggccgtcatgcgggtggccgtaaaacaatgcaattgtacgaaacacgcggaacaacggcagtggtcttcccagatggtggctgcccaatgaagcgaaggcgatgttctacactggtagccatgtctatcgcatcagtagaggcccaaaaacagctcgaccgtatcgtggctctcggctacccggatgtggcggatatttccgccgccgcattccgctcgctggcccgacctctgatcggggcgctcgagcattccgatttgggatcgaacatcctgctggtgcccacgcgtgaactggtttcgcctgagtcgctgattgcacgaacctccatcaatcgcatggcaggcttcaccaccatgccgccgcgtgacatcgccagcttcctgcttcaagacggcttcatgccgccggaaggcccgttctatctggtcgtcaatccgcacaccggcacgtgctatgtcaatcgcgagccggatgtggcccgcaaacttattgactccgatgagcgcctgccgctcaccctcgaggaaggcttggccatcgccacccagcacccggagtggctgctggaaaagaacggcttcaatctgctcggctcacgctccgcagacggacgcgtgccgagcatctggatgagccagaacgcaccgcgactgggagccgtctggcccaattcccgccatacttggctgggcaacgcgtattgcacggcccgtcgcggggtgagcctgtttaagtaggtttagcgcgcggccttgatcagcgaacggatgatggctataaagccaaggctcatcgcgccggccaccacggcgaacacctgcgggcggcgcagctcgttgcgtgcgctgaccgctccggtaacgcaatgatcctcgaaccagacgcgcagctcgttgctggagtagcggccgaccagattaccccatgtgagcatgcgggtcacatagcccgccggattgctctcatggaattcaaacaggcgaatgccgcggtaccgcgacttgggaccatagcattcgaacccgcacgtgggtgcatagcccagatcgatatcatgcacatgaccaacgaaagagttcttatggtcatgcccgcagaacagcgcgaaatagccgccagcctcgcgcaaggcatccacctcgcccacattctcgtccgcgcagccgatcgcctcgccgagccgcgagccggggcggcagacctcatggttgagcacatagcaacgcccggcgtgcgtgcgcgcgccttccacggcgttcggcgtccatgcgggcacttccttcagacaatcgtagaattcctgcggcggaatgtgctggaaggcgatggccggcacgggcttgccgtcgccattgcgctcgcccaactcggtttggacggaccccagccattcgatggccttgggggtgggggtgccgtacccgtcggcgtcggccaggtcgagtcctcgcggattgaccacatacgccgggtattgggcgtcgttttcttcgggtttgccggcataatcgcctgaattgaccatcataacggacatggccacgcggccggaaccatcggaggactcgacgggcagcgcgaacgtgccgggctcgagactgtcgtcggggttcaggcagccggggtattcgcggtagatgtcatcctgttcgtcggccagaatgccgcattggaagtcgtggttgccgtaggtggcggcaaagggcacgccggcctcgacgaccggaccaaggaaaccggagaacgtgcggcggaccttttcgcgggtctcaatcatgagttcgtcgagggtcgccggcgtctcgtgtgcggggctggccttgccggattgcgttgaatatacgagggtggaaaccgtctcgggcgtggggctggtctcaacggaatcgcctacttcggaagtcgtgatcacgtcggtcgaatcggcgccggcagcggcgacggcgttcgtcacggtatcggggtcaagcagcgcggctggtacaggcttgccggcttcggtgagacgatcggccacgcgatcggatgttttgcgaattacggggtgacgcttgatcccgcggattttggcctcgatctcggtgaccgcgcgcacgcgagcgcccggctcttcgccgcggcggcgcaggaacgtgtcgatgtaggcgggatcatagccgcggatctggtcgccggtgaacaccacaagatccggatcggcttcgcggatggcctcgcggatgaggcggatggtgtcgggcaacacatcggggccgtcctgtacgtcggccatttgcagcacgcggaagctgccgtcttcgcggaatcgcaagctcgtcatagctcttcagtctatgttgccgggcggcggatcgcccgcgcgttcacaggactggcacagcaagggacggggcagggcggggtgccgcagccgtgttgttgcttgatggtgccgcgattttgtcatgcagcgtcggtggagatccagacagcgtccctatgctgacgttctgagaccattggcgtcgttactgattcatagaatggcccggcgccgacgctcaaagaggctagcgtcggcggtgggccaatatttgtcgcgttgccgatggttgtgggcctcgtagcgtcggtagtgtgccatagcctggcaatttgccgacgataagctttcccagagtcggtatttcgccataagttggtccgctgacgacgctgagccgtttggctgtcggtgcagtaccaatatttggcccgccgccgacgtatggagggccatctggtggggtatcgcaggcggggtgttgtgccggagtcaaagcgtggcccggcgccgacgctgagtgccctcatgtcagccaggtgcataagcaaatgccacgatacggcatttcccgcgggtttgcccgaaccggcctgtaggatgttacgtgcgtattgacaaatccgcgtggcccggcgccgccctggcacaacgccgcagtcgcgtccgcaagagggcccgcgcaataaccagtaaaggaggaacaatgggtcagggtcaatcatccgtttttgatctcgcggcagtggctgcggcgtccaatggggggaacaacgacccgctgctgcctccggcgcgattcatcggcgatccgcagaagccgagtcgtatgccgtacaacaagtacaccgcctacgacaagcagatcccgtttgattacccggagcgtacgtggccgggcaagcgactgcagcgcgcgccgcgctggtgctccgtcgatcttcgcgacggcaatcaggccctcgtcaacccgatggattccgagcgcaagctgcgtttctggaacctgctcgtctccatgggattcaaggagatcgaggtgggcttcccgtccgcttccgagaccgatttcgacttcatccgtatgctcatcgagcgtgagctgattccggacgacgtgaccatcgtggtactcacccagtgccgcgagcacctcatccgccgcacttacgaggcgctcaagggtgccaagcgcgccatcgtgcacttctacaactccgtgtctgtgttgcagcgcgaggtcgtgttccgcaagaacaaggaggagatcaagaagctcgccaccgacgccgccgaactgtgcaaggacctcgagaacgaggccaagggcatcgacctgtactacgagtactcgccggaatccttcaccggcaccgagccggagtacgccgtcgaggtgtgcaacgccgtgatcggtgttatcaagccgactcccgagcacccgatgatcatcaacctgcccgccaccgtggaaatgaccacgccgaacgtgttcgccgacgaagtggagtacgtctccacccacctcgacgaccgtgactccgtggtgctctccctccacccgcacaacgacgaaggcatgggcgtggccgccaccgagctggccgtgctggccggcgccgaccgcgtggaaggctgcctgctgggcaacggcgagcgtaccggcaacgtcgacttggtcacgctgggcctcaactggctcacccaaggcatcgacccgcagcttgacctgtccaacgtgcccgagattcgcaagacggttgagtactgcaaccagatcaagatttccgagcgtcacccgtacgccggcaacttcgtgttcactgcgttctccggctcgcatcaggacgccatcaagaagggtctcgaggctcgtcaggtggccgccgagcgtgctggcgccgatctcgacagcttcgtgtggcttgtgccgtacctgccgatcgacccgaaggacatcggccgtacgtacgaagccatcattcgcgtcaactcgcagtccggcaagggcggcatggcctacctgctcaagaccaaccacaatcttgacctgcccaagcgtctgcagatcgaattcgacaagatcgtgcagaactacgctgacacgaccaagaaggaagtcaaggacgaggatatctggcgtctgttcaaggacgagtacctgccggtcgaacagtccggcatgaccgccgccggtgtggttgtgggcgatactcatgacgcctcgctcgtgccgtggggccgcttgaagctgctcaaggtggccgtcagctccggtgaggatggctccgacaccgtgctcaaggctcgtctgctcgaccgcggcgtgaacgtcggggtcgatgcgcccgtggagcgcgaggtctccggcatcggcaacggtccgatcgccgctttcctcaacgccatttccaactttggcgttgacgcctcgattatggattacgcggagcacaccatgtccgtcggcaccgacgccatggccgcctcgtacgtggaatgccaggtcggcgaggccgatgacgcgcagatcgtgtggggcgtcggcatcgattcgtcgattaccactagcgccctgaagtcgattatctccgccatcaaccgttcccagcgcaagcgctgagcgctaacagaacaaaaacaaggctccctctgattgcatcagagggagccttgttgtctgtgttttacttactactgagtgacgccgttggtgctggtgttcccgccggtgcctccggaattaccattatcgttgccggtattgttcccgttgtcaccgccggtattgttgccggcgttgccatctccgccggtagtggtgccgggataattcgggcactcggtggaatagctcggattggcgaggcactgctgggcgaactcctgagcctgctgttgcttcttggcttcctcttcggccgccttctgctgtgcgtcctgctcagcctgcttctgcgcgtcttcggtggactgcttgttggtgttgttggacaggccgctgctctgtcccttgcccaagccccaagtgccgtcggagccgccgatcttgccgttgtctttagcggtcgggaactgctccgcctcggtgccttgcaaggcctgagccatgaactcctggaacaggtgggcggggtatccagtggaagagacgccgtatccggagaaggctggcaccacttgcggattgcccttatcgtccggattccagatagcccacacattcatcatgctgggggtgtaccccacgaacgacgaagccatttcgtcgttggcggtaccggacttgccggcgacgggccggcccaacatgctggatgtgccggccgccgtaccgtacgtggtggtgccctgcatggccttctgtaccaaagcgcagtcgttggcatcgaacaccttggtgccgttgctgggcgcgttgtacatgtccttattgttggaatcaagcactttggacaccatgtgcaaggtgttcttcacgccattgttggcgatggtcgaatggccttgcgccaaatcccacacggtcagggcgttgatgcccagcacgttgtacatggagttttcatcgatatcgccctgaatgcccgcttcatgggcgattgcggccgtgcgcttcggcgtcagatgctcattgacgttcatgaacaccgtgttcaccgagttggcggtggcctgatacagattgatgttgccccagttgttctccagagcgttgttcacctcttgatccaagccggtgaagtgctggtgggaattgccgttgaacaacgtatcgaagctgacgccggattgcgcggcccccagcaaagcgaacggcttcatagtcgaacccggttcgaatacggcctgatcggcattgttgagctgcttggacagataatctgaaccggcgtatacggacaatacttcaccggtcttcgggtccagcgctatgccgccgatttgcagggattcaggcatgtcgtccagacgggtgtcgccgatggactgcataagatcctgcttgctcttgtcgatggtggtgatgatcttgtatccgccagtatccaaatcctctttggtaaaggccttggactgcaccagctcgcggcgcaccatatccagcagataaccgttcggccccgcgtattcgttctgctgcgccaccgcggcggtctgcgggaacttggcatcagtgtgctgcttggcagtgatgtaaccatcctcctgcatgatgttcagcacacgcttgaagcgcgatttggccatatcggcgttatcggccggatcccacgtggacggtgacggaataatgccggcgatcatcgccgcctcagacagcgtcagatccttggcgtccttattgaagtatgccttggccgctgcctggataccgtaggagttgcggcccagatagatggtgttcatgtaattgcacagcacctcgtccttggattcggtctgcgcgattttgatggccatgatggcctcgcgcgccttgcccacataggatgtggtttcgcccatgtaataccgctcggcatactgctgagtgatggtggaaccaccttggcgcgtgcccttggtcacattattaatgaatgcgcgggcgatgcccttcagatcaaggcctttatccgtgtagaacgtacggttttcggacgccacaatcgcgttgccgatgtagtccggcagcccctcgcaagagatgatttcacgattctgttccgcgtaggagccgatcgcggtggtgccgtccgcgtaatacacggtggttttctcggccaacgcgaacttttcgggttgcgggacctcggtggtggtgtacaggtatgcgaatactgcgataccggccagcaagcccagtccaatcagggagaagaagatgcccagcacccatttcagtacacggtgcttgccttttcctgtgttctttttcttcctgttcggggctcgatggctattggaagccttgtggcttgcgtggcgggaacggctctcctggggcgtataggggccctcctgtgcggagtggccggctctgctttgcgcggtgcgcggttgcctcagagcggggccattgcctcccgaatgtgcacgacgagtataagaagccatggtgtccaccgtaactgttggccttgaacaatcgtttgacgtgagcgtaaccacacgcatttatgccggtattttttccggaattcttacaattgggcacgcttcttgatgttgcatgaatattgcctgaatgcgctggttggtctgccgtgcgacccggcgcgcacgtttcgtgtcgctgcgctggtccatacgtctccatagacttatccccagcctccacgcggcgctatgtcacccaactcccccagggcaggaatgcagcaagggtaagtggcctctgacgggtgtgtggaggttttctttatgtgcggatttggctgtgagctggcactagcgtggtcccctgtccggggcgcggccgtacagtcgaacgtatgaatgacgcacagacccctagaattcgcgacccgcatgcggcggtcaatctggtcggctcaggcgcagcgcagcctgactcgtcgtcgaacgttgttgacccattggctgcgctcggcccggtctccggttcagatgcatcggcatccacatcaggctccttacgggatttcaggccgctggacatggacgatgcggatggggcatctgatatcgaccgtggcttggcccggcttgacccgcttaccgtgcgcccgcgaatctccagccgcgtactgtgcgtggtattcggtctgctcctgatcgctatcggcttcggcgtgtggtgggggtgcgtgtttaccgaaaacggacaatcgtacgacgaactggtctggaaaaacctgcacaacgatgtaccgtcctgggccaccggcgtgatgaacgccgtcgcacaatcctggctggttatcgctgtcagctgcacaattgccgcaatcggcattattacggcgctgattcgacgccgctggtggttggccgggcaaatcgccgtgttcgccgtggtctgcttggccgtcacccgtatcaagggtctgttgccgcgtccgttcatcatcaacactgaatctcctgccgctaattccgcgccttccggtcacacgatgctggccgcagcctgtgcggtgattctgctgcttaccgtgcctcgtgcggttcgagctttggcgggcgtcatcggcgtggtttgggcggtgaccgtcggtgtctccgtgatatacggacaatggcatcgcccttcggatgtggcgatgtccatcctgctggtggcgggattggccctgctcgctctggcagttacgcgcaagtccggcatggacgagccgggtcgccgcgtctcctcagtgagcgtgcaaatcgtcggcagcgtgctgattaccggggggctgctgttgctcgcctacagcggttatgtgatctggcaggtggtgccggggctcaatgtcagcgccagctgggcggttcagggggcgaatgtcagcgctgttgtgggcattgcgggtgtggccatgctcgcattcggactgttgctggccctgcgtcagattactgcagcgcccttaagccggctgggtctgatcggcgctccgccggcaccgcccaaacggtaaaacatggggtgcgaacggccgaatttgcccggcacaacggcggaatttggcagttggacatgattcatgagtattatgacgccagaaacgtcgtgtgtttcgcgcaatacataaggagtgggtatggctaccaaactggtgattgtggagtctccgaccaaggcccacaagatcggtgactacctgggcaaggggtacaccgtcatggcgtcggtcggccatatccgagacctcgcgcagcccagccaggtgcccgcggcagacaaggccaagttcggcaagttcggcgtggacgtcaacgacgggttcaagccgtattacattgtcgacggcgacaagaagcgtacggtcagcgaactcaaatcggccctgaagaacgccgatgaactctatctggcgactgatgaggatcgcgagggcgaggccatcgcgtggcacttggtgcagaccttgaaacccgaggtgccggtcaagcgcatggtgttccacgagatcaccaagaacgccatcaacgcctccctgaacaacacgcgcgatgtggatggcaatatggtcgacgcacaggagacccgccgcatcctcgaccgtctgtacggctatgagctgtcgccggtgctgtggcgcaaggtgggcccaggcctgtccgccggccgcgtgcagtccgtggccacccgcctgatcgtggaacgcgagcgcgaacgcatggcgttcaagcgcgcaccgtactgggatatcgtcgccacgctgtccgcgcctgacgcgctgggggagcgtgccgaattctccgcccgcatgatcgcgctcggcggcaagcgactcgccggctccaaggatttcggtgccgacggccagctgaccccggacgggttcgcggcgaacgttcgccagcttgatgaggctggtgccaccgccgtggcttcggcgctgaagaccgccgatttcactgtgatgtcgatggaaaccaagccgtaccgccgccgcccgcagccgccgttcaccacctcgaccctgcagcagaccgccggcaatcgcctcggcatgggtgctcgcgccgtgatgcgcgcggcccaaagcctgtacgagaacggctacatcacctatatgcgaaccgattcggtgacgctgtcgcaggagggcatcaccgccgcccgcaacgccgtctcctaccatttcggcgacaagttcctctccgccgagcccaagcagtacgccaccaaaaccgctggcgcgcaggaagcccacgagtgtattcgcccggcgggctcgcgcttccacgacccggacgagctggcttccaaacttcccggcgaccagctgcgcctatacacgctgatctggcagcgcacgcttgcctgccagatggctgacgccaccggttccaccgccaccgtgcgcctgtctgcgccggccggccccaccgagggcgaggccgtgttccaggcgtccggcaccgtcatcgaattccccggctttatgaaggccacgggggaggggcgcaagcccaaggccgccgctcccggcgctggggctggctcggaccaggctgctgccgccggcaagacggacgccaaggccgtcaggggtgacgcctccgaatccaacacctccctgccgccgatgagcgtcggccagcaggtcgaggcaagcgacatcgaaccggacggccatgaaacccagccgccggcccgctacaccgaggccacgctggtcaagacgctggaagccaaggagatcggtcgcccgtccacttacgcgagcattatctccacaatcatggatcgcggttacgtatacgagcgtggccgtgcgctgatccccagctggctcgccttctccgtgaccaagttgctcgagacgaacttccccaagctggtcgactaccagttcaccgccgagatggaaaacggccttgaccgcatcgcccacggcgaggaatccggccgcgactggctcacccacttctacttcggttccggcgagggcgctgcccgcaacgccgacgaggcgcacgaaggcctgcaacagcaggtcgcgcagctcggcgagatcgacgcgcgcgccatcaacaccatcgacatcggcgacggcctgcacgtgcgcgtcggccgttacggcccgtatctggaagacatggagcatctggacgccgaaggcaacccgaagcgtgcgtctctgccggacaccatcgcgccggatgagctgacggtggccgtggcccgcgatttgatcgacaaccactccggtggaccgcgcgagctgggcgttgatccggtatccggcggtaccgtcgaggtgcgcaatgggcgtttcggcccgtatgtggcgttggtgccgccggctgaggcttcggctggcgctgctggcgatactgctggtgcttctgcggccaagaagggttcgaagaaggccgcggccgccgccgcgtcgcgcccgaagatggcctcgttgttcaagacgatgagccctgaatcgctgtcgctggaagacgcgctaaagctgctgagcctgccgcgcgaagtgggcacatacgaggaaaccaacgccgaaaccggcgaggtatccgaatgcacggtggccgccaacaacggtcgctacggcccctacctgaccaagacgggtgccgacggcaagtcggagacccgctcgctggcctcggaagacgagatcttcacggtcgatatcgacaaggccaaagaactgttctcgcagcccaagtacggccgcgggcgtggccgtggtgccgccaagccgccgctgcgtgatttgggcaaggacccgaacaccggcaagaacgtgaccatcaaggacggccgtttcggcgcgtacatcaccgatggcgagaccaaccgtacggtgccgcgtcagtacacgcctgaatccatcacccctgatgacgccttccgactgctcgccgaaaagcgtgcggctggtccctccacccgtggccgtcgcggtgctgggcgtgctggtggcgccaaggccgttgccggcaagggcaagaagggcggtacctcggctgcggtttcggcgcaggaggccaagcgcgccgaacgccgtgccgaagtcaagaagttggcgaacaagggctggtccaaccagcgcatcgccgaaaaactcggttccacccccgccactgtgaaaaaggacgtcgactggctgaccgccaacgaggactacgagcgccccgccgtaattcccaagcgtggctgagcggaattattgctctacttgcgtttcaaggggctgatttctcgttttgagaatatctacttccgcttcaaggggctggtcatctgctgaaccacgagtatgaacggctccgcgccaacgtcattccgccgttttggaacgttgtctacttgggcaacagcccctcgaaacggaagtagaccttcagaaaagaccaaatcagccccttgaaacggaggtagagctggtttaactgcctgttgggcgcaactctgcgcctaacgctaaggtcaatagcatgaacggtctgtttgtttcgtttgaaggtgtcgatggcgtgggcaagaccacgcaagtcgagcggctgcgtgcgtatcttgaggctcaggggcgtaccgtggtcgttacccgtgagccgggaggcactgcgttaggcaaggccattcgccaactgctgttgcacggtgtggatgggggcgccgtcgacatcgcaccgcgcgccgaggcgctgctattcgctgcagaccgagcccagcacgttgccgaaaccatccgcccggcattggagcgcggtgaagtggtgatcaccgaccgctatttagactcttccttggcctatcaggccggtggccgcgaactcacgccagaagagattcgatccttaagcatgtgggccaccaacaacctgctgcccgaccgcacgtatttgctggatatggacccagccctgtcccaccatcgcctcgaacacgcggaagaccgtatggaatcggccggtgatgacttccagtcccgcacccgccaggccttcttggacttggccgccgccgagccgaatcgtttccgcgttatcgatgcgagccagagcattgaagcggtatgggctgccatcgaatccgacatcaaggagctcgcatgagcgtatgggattcactagtcggccaaaagccggtaatcgacatgctcagtcgtatcgcgcagggcgacccgagccagatcacccagtcgtggctgatctgtggacctcccggatcgggccgttccaacatggctcgtgcgtttgcggcggcgctggaaagcccggatcacggcatgagcgctgagcccacgcgcgtcacccagcaggtgcttgccggcacgcatccggatgtcacggtgctgaccacgaacaaggtgactattggtatcgatcaggtgcgtgagatcatcactacctccgagcagatgcccgccaccgcaccgtggcgcatcatcatcatcgaagacgtggatcgcatgcttgagcgcaccaccaacgtgctcttgaaagagattgaggagccggccgagcattgcatctggctactgtgcgcgcccagcgcccaggacgtgctgcccaccatccgctcgcgcacacgcatcgtgaacctcgccgtgccctccacccaggcggtggccggattcctgacctccaccaccaatgtcgagccaaaagtggcgcagcgtgcggcccgactcgccgaaggccatatcggcatcgccaagttgtacgccaccgacgaacgggttatgtccgaccgcgatgaacttgtggtcggtgtgctgaatctggcccgtgcctcggatgcagtgttgttggccggcaatcttatcgacaatgccaaggcccaggccgaggcggacgcgaaccgcatcaccgccggtcaggaagcggaattccgccgcatcaacggactggcaccgagcgaccgcatcccgccgaaactgcgtggcgcattcaaccagattgccaagaaagacgatgtgaagcgtttggtcacccgccgtacgcgcgacgtattggatcgtgcgctgaactccatcgcctccatctaccgagatgtggcggtgctgcagaacaatgcggaggattcggtgggcctcatcaacctggagaaccgctcgtcgatcaccgaattgtcggtgcggttgaaccgggccggtgccgtgacccgtctggacgaagtggcccacgcccgcaagcgcctagccggcaacggcaacccgctactggtattcgagtccctcttctgcgccctgatcccataacccgacgcaactagcccccctctgatgagtgggggctgtcgagcgtagcgagactgggggagagaccccgtaacgcacagcccccagtacgtcacacatatgagcgatactgggacgtatgaagatttccgccgatttcaccgtcatcccggacgatttcgccaaggccgcggcccctgaatatttcaatggtggcgtgccggtcgtctccttcccgttctacatcgatgatgtgaaccccgaggcccgctacctgcactgggagttcgtggacccggattcgattccggtctgcggcttcgagtggattcactggtccgtggccaatctgccgattgatgcgctgatgtacgacttcaatgattcgcatgcgttggccatcccgccggacttctcccgtcagctgccggccatgattcccgagaccgtgcaggggcgcaactcctcggcctccaagttcttgggccgcagcactgacccggcggtgatcatgcggtacaacggtccgcagccgccggacaaggatcatgagtactacctgcaggtgtgggccaccaagaagccgttgcccggcttgaatcagggcttctggctcaacgagctgttgcacgcgctgcgcaacagcggtgaagtgcccgacaccgacggcatcttcctgaccggcaaggcgtgagccacatgagcccccgcaggcgggggctgtcagcatcactgactgggggtgggtcagtacaaaaccaccttcagtccgacttcgtcgtccagctcccgccagtgggagcgtgactacaacaaagaaaggacaccatcacactatggcctgcaccacgattctggtaggcaaagacgcgagctatgacggctcgaccatcatcgcccgcaacgaggattccgcgaacggcgagttcaacccgaagcgcttcatcgtcgtgaagccggaggaacagccgcgcgaatacaagtcggtgatctcccacctgaccatcaccctgccggacgacccgctgcagtacaccgccgtgccgaacgcggacctcaaggaaggtatttggggcgaggccggcgtcaacgaggcgaacgtggcgatgagcgccaccgaaaccctgaccaccaacgagcgcgtgctcggcgccgacccgttcgtggaatacacgccggccaagggcgatgagcccgaggtgcccggcggcatcggcgaagaggacttcctgaccatcgtgctgccgtatgtcaagaccgcacgcgagggcgtccagcgcctcggcgcgctgcttgaggaattcggcacctacgagatgaacggcgtcgccttctccgactccaacgaaatctggtggctggaaactgtgggcggccatcactggattgccaagcgagtgccggacgaggcctacgtgaccatgccgaaccagctcggtatcgacgaattcgaccttgaggacgccctgggtgaccaggaagcacacatgtgttccgaagaccttgccgaattcatcgaaaccaaccatttggacctcgcggtggagaacactaccccgttcaacccgcgcgatgccttcggctcccactccgactccgaccacgtgtacaacaccccgcgcgcctggtacatgcagcgcttcctcaacccgtacgacgaggtgtgggacggcccggacgccgaccacaaacccacctccgacgacatcccgtgggcccgtcagcctgagcgcaaggtgaccatcgaggatatcaagtacgtgctgagctcccactaccagggcaccccgttcgatccgtacggccagctgggcgatgagcgcacccgccacatgtaccgcacgatcggcatcaaccgccagagccagctcgcggtgatgcagatccgcccgtaccgcccgcaggcctcccgcgccatccagtggatggcatacggctccaacccgttcaacacgctggtaccgttcttcccgaacgtggacaccacgcccgcctaccttgaggacaccaccacccgcgtgacgtccgagaacttctactgggccaaccgcatcatcgccgccctgtgcgatggcgccttccgctccacgtccaacgccgttgagcgctaccaggagaagaccggtgcgatgggccaccgcttggtcgccgccaccgacgagcagatcgcccgtctgggcttgacggccgccgaggaagccgcgcagtccgccgctgaagaggaatttgaggccgacaacgtggatggcgatgtgcagccgatgaccccggacgagaccatcgccgcgctgcgtaaccccgaggtgcgcgagattctcgccgccgccaaccagaccatggccgaccagctcaaggaggaaaccgaaaagctgcttgactccgtgctgtacactcgcagcatggaaatgaagaacggcttccacatgtccgacttttagtccgtattgagctcccctccctgaggggctgagccgtttagaaaacagcccagtgggctgtttttaggcgaagaggcggcgactgccgccccaccaccccgccccatcacacaaacacagaaaggctttatatgaccaccatcgaagacttcaccagccagtacggtctggtccagaagatcgacgcattcggctacatgaagtacctggccgagaaccctgacgccccgcgcaagcacggcaaggtggtgctcgtcaccgccgatacgccgctcaaggcatcgcgcggagaaggcaagaccaccacgaccatcgccctgatcgacgccctgaacaagcgcggcattgatgcgaccgccgtgctgcgtcagccgagcatgggcatcaccgcagccggttccaagggcggtgcctccggcggcggcaaggcttccctgacccaccccgagctcatcgactggggtctgtgcggcgaaatgggcgccatcgaggcggcccagaacctgctcgtctccttcgccgagaaggccatcgatgacggcaagctcgacacgattctcgtgccgcgtgtctccgaggtgccgagccgctccctgcgctccaccgccgtggactacggcaagggcaacgtgccggagaaggtcgtgctcacgccgacctgcgagctcatgcagattgtggtgctctcccgctcgatggacgagatttccgagcgcgtgtccaagatgatcgccggcaccaaggacggcaaggccgtgaccttcggcgaattcgtggacctgtggcgtatcactggcattctggccgacgcggtcaagccggccaagaccgagaccgtaaacggctccccggtctacgtgcacggtggcccgttcgccaacgtgtccatcggcattccgacgctggtctccgtggaaatggcctgcgccctgcatgacgtggtcatcgtcgaggccggttacggcaccgacgccggcgcccagaagtggctggacatcgcctgccgcgaatacggcgcgcagtggccgtccgccgccatcgtggtgacccgtgcctccacctggcgcgacgatcccgagctggcctggcgctacccgttccacgtgcagcgcctggagaacctggacattccgaccttcccgctcatcaacctgtgggaaggcgaggacgatcaggttccgtccctgaaggccaccgccgacgagctgggcttccgcacgccgatcatcggcaacctgttccgcgacggcggcgaggcgctggccccgcagcttgacggtttcgtcgacgcgttgcagaacggctccatgccggccgaaccgcactcgcacaagggcatggccctgaccgagaacgccaagtgggtggccgagaacgcctacggcgtaccggccgagcgcgtgatttacaagccgggcttcaccgagtccgtgtccgaggccatggaactgtgccagagcgcaggcatctcgctggacgatctggcgttcgtggcggtcaagtccccggcgaccatgaccgacaacgaccgtgcccccgaagaagagcgcaccgtgaccctgaagaaggttgaggtgcatgccggtgccggtctggtccacgtcaacctgaccaccagcctcaccacccccatgcccaagatcgtgtgatgacaggcatgaggtgaggtaactcgcttttgaggggcggattttcggttttccggaggtctatctgcgtttcgaggggctcttcgattgcgaaatccggagtatgaccattgaaattgcaatgtttatactccggttttcttgttttaaaagccccttgaaacgctagtagagcttctgaatgttggaaatcagccccttgaaacgtagaaagcccgccaccggcgggctttctacatctgagcttccctctttgaggggagctgtcagcgaagctgactgaggggagccagcatacgcaaactagaagttgctaccctgagccgttaaacggaaagcccaccgggctttccgtaggcgatgcgagcagctatgctgcgaggggaatggtggcaactagaagttgccaccattccagccccagtcggtggtggcggtgtaacggatgtaggtgcggtcctcgggaataccgagcgtggagttcagcgcggccataatgctctcggtcagcttttcccaagcagagcccggcacagagcggccgaacacgttgacttccacataggcggcgggctggtcatcgctaccaccgaagtaaatcggcatattgtcctcgaacgggcacattagccagccctcggacttgcccggcacggcggtaatcgccttgccataggcagccttcaacgcctcgcgctgctcaggggtggtgggcacggacacatgagtgtgaataacgggcataattcctccttgattcggttcgcttccagtctagcctcagcggttgctgttgaacatggcatgcggatgtaggaagctgcttgcagaacggaccggggcaaggccaatttggggagattattggcctttccagccaatatatgttccgcagtcagcccaatagtgttgaatacccttgtgagaaaactgattgaacaactgatgaagttcggcattgtgggcgtcatcgcctttgttatcgactggggtattctcaacctattggttggcatattccacatgcacaacgtgctggctgccaccgtctctttcatcatctcgctgattttcaactatctggcgagcatgaaattcgtattcaagcatcgtgatgacatggcgcgctggatggagattcttatcttcgtggcgggcgctgtagtcggtctgttcatgaatgacgcgattatctggatttccacttatggcatgaaccatgatgcctatgtatcgcagcatgccgaatatctgttgcgcaccaatatcggcaagttggtggccactgccgtggtaatgatctggaacttcttgattcgcaagtggctgctcgacgatacgcacaccaatgcgatgaaccgtctgaagtccgctgaaaatcgactgaatgccgaggagcttgaagccaagtggcagaacagcttctcccacaagctcggcatctggtccctggaacacacgcccaaaggctggccgaagtagcgttttgacgtataagccccctcgtcagagggggcttagcttttgtctcacacactcacttcagtcaaggtcggctgctcggtggagcccttgatctgcttgaagccaatcagcgcaatcaccagcgagaccagtgccaaagtggtcaccaccatgaagccgccatgcgagcccatgcggtcgatgaactggccggcaatcgccgaaccggcggaggagccgatagaattcatcgcacccatccacgccatgccttcggtcaggcgggaaggcggcaccaagtgcagcatgagctggttgccgttaatccacgtcggagcctggcacacgccgatgatcaggtagatgatcataatcacccacagatgcttggcgaacaggaacgtgctgatgccgatgttcaccacggccaggcagaagtagaagcgcttccacagggcaatcgaccagttcttcgcgccgtacaccaaggcgcccatcaacgagctgatggagaagcaggcgaatacaaagcccgtgtactgcttcatattcgactcggtggcgaatgcgatgatcgagatgcctgtagccgactggaacgcgcccaagccgaaccaggtgacgcataccgcaatcagacccggtccccagatggacgccttcttgccggaacgcgcatcggcgaccgcctgctcaatggcggcgttaatcgtggcctcatcggtcacgccttcgcgctcaagacggcggcgagtctcctcggctgcggtctccaccttcaacgcttcggctcgagccgcctcgcgctcacggtattccttgcgggaaatgccctcagcgcgggccagctgagtctgtgacggtggctcagtggtcagctcggtcaagaacatcagcgcgcccaccaccacgcacatgccggtgaacgagaatgccagcagaccggagatcacggccagtgtggaagccagtggattgccgattacccacatgcattcgtccagcacgccgcacagggagagcgcacggttggtacgctcctgatcgcccttcaggattttggtccagcgcgcgcggctcatcgcgccccacggcggaatagctgccaggaacggcgtcaaacagtacagcacccattccggcgcacgattggtgatggatgtggtcagcgcgacggcggcgacaatccacaccagaatcgttggaatcgaaacctgccgctggccgaacttgtcggtcagcttgccgagcagcggcgtggccacggccagtgcaatcgcctgaatggcggtgagcatacctgccagcgagtagttgccgtagtaatgctgcacggaaatggtgatggtcatgcccaccatcgggaacggcatgcaggcaatcaccgaaccgatggaataacgagcggtatgaggtatgcgcagcaactccgcatacccaccaaaaactttgtgacccacttccttgatgccagccataatggtgttcgagttggacaggttgttggacataacagcactacgctcctttccgctcccgattggatgttccccgctgacgtggcgttgccggcgaagccctcatcgaatgatgtgttgtccatggtcgcgcaaagtttgcgttggatttccctattcgcatatttgcgtcacggatactctaatcgttggttagggcgcgacacgcggtagattggagatattaagacaacgttctcatgttcttcggcgaacatcgcaagatgcccgtaggaataaaaagaaaggcggctcatgagcgcaaccaccatccacttcgttcgccacggcaaggtctacaaccctgaccatctgctctatgagcggctgcccgacttccatctctccgatcttggccggcgtatggcacaggccaccgccgcctatctggccaatagccctcagaccaatacgatttccgcggtgtattcgtctcccctggaccgcacgcgcgagaccgccgacgcgattcttgacgcgttgaatcccgtgcgcgaggcccgaggcgaagccccgctcatgctcaccgccgatgagcgagtgattgaggccggcaacgagttccgcggcaagcgtatcggccatggcgaaggcgcgctgtggaagaacggcaattggaaactggtcaccaacctgtacaagccgagttggggcgaatcctatcagcacattgcgcagcgcatggatgatttcgcacgcgagaaggtcgcccaacaccccggcgaacagattgtggtggtcagccacgaatcgccgattttcagttatcgccattatctggagaccggccaccccgagcactggatgttcctgcggcacacggcgctcgcctccgtgacctcggtgacgtacgacaacgaaaccggccgtgtgatgtcaatcacgtatgtcgacccagcagccaacgtcaagtaacggcacactggtgaatagctgagctacaatctgggctcccctcagagggagccaatgggacgcactacaatcaagtggtgaacgcagaggagcatgaatgaccattgaactcaatcgtgaggcaatcgcacggatcgcggcattgccgggggtagctgaggccgctgaagccggctcggcgctaattagcctgtggccgctgaccgaagccatgcagatggacaatgacgccaagtatgcggagaacctgcaggtgcgtgtcacgcacgcgttcgcacgcattctcaccggtcaggatgttacgatgcctgacgccgaattcgtctacgagggggccgatgagattcctggccgtccgcaaagcatcgtagacacgctgcttgctgccaatgacgcctacgatacgatggccggttactcggaatccggcgatgtgcagctgattttcgatgccgccgaagctttaggtgttgactgggattcgcatgtcgaggccgcagtccgtgagacggttgtctccgtggaggctcaggttgaggccgatgccgaggctggcggacgtttggcggcttccggcgagccggctgatgtggccgtccgtttcgccaccgcgctcgccgtatgcgatgcgctgctgaacgtggtgagcgggcatgccgagacggttggcttggttggtccggctgttgctgatgccgctgatgttgctgacgaggcccgggccaccgccatcgtaacgttgccgattctgctgtacgtcaacgaattacgtgagcagtgctcgattccgcgcatctgcctgaccgaccagcagattcttgatctgattgatacgcgtgccaatgccggtgacaccctgaccgccaccgccgaatacattgccccgctggccggtgccgaatggaccaagcaccgcgacgatgtgctctggaacccggacgaagccaagaagaaggccaaggaagaagacgaaaagcgcaacaaggaggccttggccgccaagtttgcgcacattaaagatgaccctggcaaagaaaccgtggagttgtgagaatcaaggcagcttagcccgcctgatcggttctcttacccctgctcgcgattcctccgtgccaaggaaatcgtctatgtggtgaagaacatcgcttacgcaacggaagaagaaacacttatgggcaatggcgtcaatctgcgcacgctcaccaatgacggcggtagcgcggtaatcagcgattacggggcgcatctgctgcgctgggccccggcggggcagccggatgtaatctggacgccccgcacatggcatttcgaagctggtcagccggttggcgggggagtgccggtgtgcttcccctggttcgggccggggtttgtgcatggcgggcagactgcgaagcgaccgattcatgggttcgcacgattgcgccagtgggcgctggacgaaggggcgtttaccggtgcccgtgtgcggtatgtgctggattccgaacgactgacgactggcgaagtgccatggatcgaggatgaacccaacgtgcgtttccatgccgcatacgaggtgtgtgccagcgatacgctgacgatgacgctgaccgttaccaacacgggaggtgagccgatgtcgtatgaggcggcgctgcactcgtatctgcatgtcggcgatgtgctcggcgcgcggctggtcggtttgcggggtgcaacatatctggatgccacggaagccggattcccgccaaaactacaagaacagccatcggtgatgttcggcgatcagccggtggaccgtgtgtattattccgatgctgcactggaattgcaggaccatgtgctgggtcgtgtgattcgcatcggcaagaccggctcgccgcagacggtggtgtggaatcccggagagcagggcggcaacgccattgcccatgccaagacgggtgaatggcgtggctttgtggccgtggaggcagcggcgtgccgagaccgtatcgttgcccttagtccgggtgaatcgtatatgctttcgcagtccattgccgtgatgccgttggggtagttggctgaatacagtgccgagaatacagtgccgagaatgatgaagccctactcgcgttgagtagggcttcatcattggttgcggggaacttcttcaacggaagttcaccgatatcggttactggccttgccggggtttctgggcattgtcgccggcgggagccgtgtgctcagaaggtgttgcggattcgtcgccggcgttttgaggcatcggcggaacctggccgtactgtggggccggtacctgaccgtaatcaggtgcgggtgcagccggctggccatagtcgggggtcggcatggccggctggacgtaagccagggccggctggttgaagccgggtgcgggcgcgttcggagcggcgaaattcgggggtacaggcgtgctgtatggtgcgccgtaagcaccctgaggcatgggggttgccgccgcgccatcgtcaaaacgtgcgccctccggcttgctgggaagagccatgaacacgatatagacaacgcagccggccagcgtaatcaacgcaccaatgaccgccgcgccaagaccgccggcggccatgctgccataaccatagtcataactgccaaggctcctgaacccgccgtacagtgccgcaccaccgccgataatcatgatgataaggccgataaccatcgcgatatagaaaatggcaacccaccagccaggcttgttcgtgtcatgcagacggcggacggaaagtgccagggtggggattagggtcaccagaccccaaatggtggcgaggaagccaagcttttcatctgtggcggtgttgaggatgtccagcactatattgatgccgaaagcggccagcacccaccaccagaattcactgcgggacgcgcggcccttgaacaccgtgtacttcttccagaagcgcaggaaggcttcttggaaggagcatccgtagtaaggcttatccagcggcacagtggcagtgggcgcggcgtattggccgtaagacggcggaaccgggccgtaaggattgccatcgggggccggtgtgccgtacgccggtgcggattgaccgtaggtgttggcgtcgggcgcgggctgaccgtaggttggtacggcctggccataagagttcgcggtcggagcaggctgaccgtatgccggctgtccgtaagcgggctgcgccggctgtgagggctgcgccggggccggtgcgccatactgcggtacgggattaggtgtgggcgtaccgttggcctcaggctgctgaggcaaaggcacattgttgggatcagacattgattcccctttcataagacctatgtgtcacatcatattcttccattgcatgagtggaaaactcaacaattgcgccaaataatgtccaaagttgtggtgaatgcactggaaagaatcgatggttatcaaatcgatatcagttgagggtgaacgttatcgatcggttgtgtaacctgttgcatgaatattgcgcacagttgcggggcggaactggaaagcagacgaagcttttggcgctatgcataaagcaacatacagagatgtagggaatgccatgaaccacgaatacacggatgccgccgttgagcagcgcgaatcgcacgaagacgaatctcaagactgggatctgctgttcgtgggcctggcctgctgattctcgtttgctgttttcttttcttttgattttgcttttaaaagaaaagcaaatggcaggcaaaagagatttcgttggaaaatggccgttttgggatggtgttggcccgaaacatcaataacgaagcaaaagagcgaggagcgctgctctccgcgtccggcgcgcgcggcacaataggggattatgactgatgctgaaaacaccaaacccgaactgcccaagaacgttcgtgttcgcttctgcccgtcgccgaccggaaccccgcatgtcggcatgattcgtaccgccctgttcaactgggcggaagctcgcgccaccggcggcacgctgatcttccgtatcgaagacaccgacgccgtgcgcgactccgaagaaagctacaaccagatcctcgaatccctgcgttggctgggtatcgactgggacgagggcatcgatgtgggtggccctcacggcccgtaccgccagtccgagcgtaccgccatctacaaggatgttgccgccaagctgctcgaagccggctacgcctacgagtccttctccactcctgaggaaatcaaggagcgcaaccttgccgccggccgtccggccgagttcggctacgatggctacgaccgcaacctgaccgatgaacagaaggccgccttccgcgccgagggccgcaagcctgcgctacgtatcaagatgcctgatgaagacatcgcctttgacgatctgattcgtggcaccatcgagttcaaggccggctccgtgccggactacgtgatcgtgcgcccgaacggcgacccactgtacacgctgaccaacccggtcgacgacgcgatgatggaagtcaacgtcgtgctgcgcggcgaggacctcctgagctccaccccgcgccagatcgtgctttaccgttaccttatggaactcggcatcgccaaggagatgccgctgttcggccacatgccgtacgtgatgggccagggcaacaagaagctctccaagcgcgacccagagtccaacctgttcaaccaccgcgacaatggcttcatccgcgagggcctgctcaactacctggccctgctcggctggtccattgcaccggaccgcgacgtgttctccatggacgagatgaccgagaagttcgacgtgcgcgacgtcaaggccaacccggcccgcttcgacatcgacaaggccatctccatcaacgccgagcacatccgtatgcttgagcccgaggacttcctgcgccgctcggtgccgtacctgcaccgcgacggtgtggtttccgccgacaactgggatgccctgaccgaccgtgagcgtgaggtgctgaccgccgccgctccgctggttcagccgcgcgtgcgcctgctgggtgaggttgccggcatggtcggctccctgctctccaccgagggctacttggagccggctgacgacgccaagaagcagctgaaggattctgccggcgaggtgctggacaaggccatcgccgcactcgaggctgtggatgaggctgactggaagaccgacaacctgcatgagaccctgaacaaggctctggttgaggagggcggctacaagccgcgcctcgctttcggtccggtgcgtgtggccatgtctggtcgtcgcgtgagcccgccgctgttcgagtccatggagatcgtcggcaagccggtttccctcgctcgcctgaagggcctgcgcgagcacctgtgagctaaggttccttccgtgctcggctgagctgtaaggacactcaaggtgggcgtctgcatgtgcagatgcccaccttttcttgtattcagtgatgagctggaacagctggaaagtcttaccgctgcgccgcatgccagtgagaatatgtacgaggttgaacatggctggtttgtgcagtgaggtcacgaaacgtgccttgtaggtggtttcgccttcatgcgtccatgaaacggttgataggtaaccgggcggcggtctttgacgtgacattgcattacaagcatcgcgacgcgctcgctgtcgcaagggaacataagcgcctcatttggttcttgaaggctgatttgccggctatgaatgtgcaaggcaaagatcattgcctcatctgcaatttcatcagtgcattagatggtaattcatcagtagtgcttactgataatccgtcagtagagttcatgcaaattcatcagtagtggcagcgtagcacttgaaatcgttgaaattccgcgcgacacgccgtaagttgcgtaagggtgaatacttgcgtatatttatcactcgttgcgcggttcaccgagcagccggttgaaaaactgaatatgcccccatcgtctagcggtctaggactacgccctctcacggcgccaacaccggttcaaatccggttgggggtacgacgaacaactccttggagttgctacgccaagccaaattgggatgtggtgtaattggcaacacagctgattctggttcagccattcttggttcgagtccaggcatcccagccaatgaccctcgcggaatgcgagggttttttgttttcagggaagtagccgcttgaaaagcgacttccctgcatatgagtgcgcataagagcgctaagagcgcatacgtgtgtatgaaagtacgagaacgaaggagatcgaagtatgtccgctgggcagcaggctgtaccggcaaacaacgccaacaatgcaagcaatgaaggcgctcagaagaagcacatgtctaaggcggccgtcgccattatcgccgtggtggtcgtggccattatcgtcgtggccggtgtgttcggcttccgcgcctactccgatgctcagtacaacaatgcagtcgccgcttgcgccgccgcttccgaaaatgtgcgcaacgccactaatgactacaacaacttggtcaatggcgatgcttccgaagctgctgcgctcaccaagaaggatgtaaaggatgcctccacgctggacgccctcaacaaggaactgagcgtggaactgccggtatacgaaggctgcgtagctgacgacactgccggcttcaagtccgctactgcgaagctcaacgagcaggctgattggtacaaggcttatactcaatcgctgcagaaggctgtggatgccgtgaacgcttccaagaagtaagcgagcacagcctcaccattgtcgtcaaagccgtcttgcggttgcgcaaggcggcttttgctattttgctcaatcggcttgctgctgtaatgctgctgcattgattgcgtcgaatgcaggtaaattcgtcttactttttttgcgcagtttttccctgcgcgtgtcgcgatgatgcgaatatagatgtgaaggttaacaacgtagtcgtttattgggttttgtgatttcactcacgttgtaattcaatgtcaaatatgtggcgattctccgtatttgctgagattgctattaagaatagcttcttgtaaagtgtcttatcgtaattgcgaatgcgtattcttcaatgaagaaggcatctgcttcacctcgaagaagagattaaggaaaatatagttaatgaaaaagaagaagactatatcggctgcgctggcaacagcgttagccttaacctgcatgggcagcgggggaggtactgcgttcgcagtgcccctgtctgatgctgacttgcagactttggcaagtcagattcagcaaatcaacgatacttctgattctgcaactgcttccgagactccttccgcacaagccgatgcggttgaaggctggactattgattccaacatcgctcagggcggcgaaatcctggagatggcaaacggttggctgcacctcaagtccactgcctctaacggtaatgcggcagcgaaccccagctccagcaacaactggccggcagtagccgtatggggcacagattacgacttctccaaggccggctccttccacgccaccatcaaatccccgcaggaaggctccgccaaccgcttcggcttctacctgggctacaacgacccgggcagcggcctgttcatcggctacgattcgggcggctggttctggcagacctacaccggtggcggtagcggcagctggtacagcggtgctcgtatcgctgctccgagcgccaacgaagagcacgacattcgggtctcctggaccgacgccaaggtcgccacactgaccgtggatggccagaaggcattcgatgtcgattactccgcaatgacgaacctctccaacaagcttgccatcaaggccggctcctggaaggagctgaacgaggtcaccgacgtgtacatcaaggacttcccggaggttgtcgaagccgccaagcacgcggtttccggcaaggttgtggacgctggaggcgctgccattgaaggcgcaacagtgcgtttggataagaccaaggtgaagaccggtgcagatggcaccttctccttcgccgacattgaagaaggcgaacacacgctttcgattgccaaggaaggctatgaggacgtctcccagcaggtgacggtctccggcgcggatcttgccatcgatcccatcaccctgaacaaaaccgttcaggtcgcctccgaaacgctgaagaccgagaagatggaagttcagattaagaagaacttcccctctgtgctgcagtacacgatgaccgacggcaaggtgatgtacggccagtccaaggatgtgcgcaccgttgaaatcaacggcaccaacatcgaactgggcgatgacgacgtgaccttcaagaaggtttccgacaccgaggccacctacacgctgaaggtcaaggatgaggccaagaagattgacgcggtgatcaccgttcagatcacggtcaaggccaaccagctgcacctcaacgtcaccaagatcaagaacaacctgtccgaaggcattcctgagggcaacggtgtggaggagaacgccatccagacgctgtccttcccgaaccagagtctcgtttccgtgcgttccagccaggaaaatgcccaattcactggtgctcgtatgtcttccaacacgcagaagcctggcgataccaacttcgcagtgaccgaagatactaacgtcaccgatagcgactacacctacggcttcatctccggtgctggcctgagtgccggcctgtggagcaactccgagcacgatggcacctatgtggcggctcctgtgcgcggcggcagccagaacacgcgtgtctacgccaccacccagcagactggtgacgccacctccctgggcctggccagcgctccgtggtactaccaccgcacggtcaccgattccaagggcaagaagtacaccgtggccgaaaccgctctgccgcagatggccgtggccatcgccggcgacgagaacgaagacggtgccgtcaactggcaggatggcgcaatcgcctaccgcgacatcatgaacaacccgtacaagtccgaggaagttcccgaactggtggcatggcgtatcgccatgaacttcggctcccaggcgcagaacccgttcctcaccacgcttgacaacgtcaagaaggtggccttgaacaccgacggcctcggccagtccgtgctgctcaagggctacggcaatgaaggccacgactccggccacccggactacggcgatatcggccagcgtctcggcggcgccgacgacatgaacaccatgatggaagagggctccaagtatggcgctcgcttcggtgtgcacgtcaacgcctccgaaatgtatccggaagccaaggccttcagcgaggacatggtgcgccgcaactctgcaggcggcctgagctacggctggaactggcttgatcagggtgtcggcatcgacggcatctacgatctggcatccggttctcgtgtaagccgtttcgctgacctcagcaaggaagtcggcgacaacatggacttcatctacctcgatgtgtggggcaacctgacttcttccggttcggaagattcttgggaaacccgcaagatgagcaagatgatcaacgacaacggctggcgtatgaccaccgaatggggttccggcaacgagtacgactccaccttccagcactgggcagctgatctgacctacggcggctacacctccaagggcgagaactccgaagtgatgcgcttcctgcgcaaccaccagaaggacagctgggttggcgactacccgcaatacggcggcgctgccaacgccccgctgctcggcggctacaacatgaaggacttcgaaggctggcagggccgcaacgactatgccgcctacatcaagaacctgtacacccatgatgtgtccactaagttcatccagcacttcaaggtgacccgctgggtcaacaacccgctgctgaccgccgacaatggcaatgccgctgccgtgtccgacccgaacacgaacaacggcaacgagcagattaccctgaaggattccaacggcaacgttgtagtagtctcccgtggttccaacgacacctctagcgcagcctaccgccagcgcaccatcaccttcaacggcgtgatggtggcttccggtgctgtctccgcaggcgatggttcctccactggtgacgagtcctacctgctgccgtggctgtgggattcctccaccggcaagctggtcaaggattccgaacagaagctctaccactggaataccaagggtggcaccaccacttggaccctgccggacagctggaagaacctctccagtgtgaaggtgtaccagctcaccgatcagggtaagaccaacgagcagaccgttgccgtctccggcggcaaggtgacgctcaccgctgatgccgaaaccccgtacgtggtgtacaagggcgaagccaagcagatccaggtcaactggagcgaaggcatgcatgtggtagacgccggcttcaacggcggctccaacaccctcaccgacaactggaccgtcagcggctccggcaaggccgaagttgaaggcgacaacaacgccatgctgcgcctgaccggcaaggtcgatgtctcccagcgtctgaccgatctcaaggctggccagaagtacgcgctgtatgttggcgtcgacaaccgctccaccggcgatgcatccgtcaccgtaaccagcggcggcaaggtgctggccaccaactccaccggcaagtccatcgccaagaactacatcaaggcatacggccacaacacgaacagcaatacggaaaatggctccagctacttccagaacatgtacgtgttcttcaccgcgcctgagaacggcgatgccacggtaaccctgtctcacaagagcaccgacggagcacacacctacttcgacgatgtgcgcatcgtggagaaccagtactccggcatcacctatgagaaggacggcacgctgaagtccctcaccaacggattcgaaaacaacgcccagggcatctggccgttcgtggtctccggttccgaaggcgttgaggacaaccgcatccacctctccgagctgcatgctccgttcacgcaggccggttgggatgtcaagaagatggacgatgtgctcgatggcacttggtctgtgaaggttaacggcctgacccagaagggcacgctggtctaccagacgatcccgcagaacgtgaagttcgaggcgggtgccaagtacaaggtgagcttcgactaccagtccggttccgatgacatctacgccatcgctgtgggccagggtgaatactctgccggcagcgtgaagctgaccaacctgaagaaggctctgggtgagaccggcaaggccgagttcgagctgaccggtggcgtcaacggcgattcctggttcggtatttactcgaccgcaaccgcacctgatctgcagggttccaccggcaatgcacaggacttcggcggatacaaggacttcgtgctcgacaacctgaagatcgagcgcatcgagtcccagacccgcaccaaggccgaagcgcaggacaaggtcaaggaaatccgcggcaagtacgattccaagcgtgctgagctctccgatgccgcatggcagcagtatcaggacaccttggtcaaggctcgcgtgctcatcaacaagaatggcgcaaccgctgaggacttcaccaaggcatacgacattctcgtggccctcgacgagtacatgaagaccgctcccggcaacgagagcagcgacaagtacgacgtggcagctgacggctccgatgagctgggtggctacaccgtggccacgggcagcgaagagcctaccgcaggcctgccgagcgaaggcccggccggtctggcacaggatggcaacgacagcacccactggcacaccagctggagcaagaacgcagtcggcaacggcaccgcatggtatcagttcaacctcaacaaaccgaccaccatcaacggcctgcgctacctgccgcgttccggaggtatgaacgccaacggcaagatcaagggctacaagatcacgctcactctggcggatggcaccaccaaggatgtcgtcaccgatgctgagttctccaccaccaccatgtggcagaaggccagcttcgacgccgtcgagaatgtgaccgccgtacgcttgaccgtcctgtcttccgcaggccagagcgactcccaggccaacaagttcgcatccgctgccgaactgcgtttgaccacggaccgcgaggttgaggaagagactgtcgctccggacaagaccgacctcaacgacaccatcgccaaggctaacggtcttaaggaatccgactacacggctgaaagctggactgctctggtcaaggcccgcgaagctgcacaggccgtggcggataacgataaggccaccgcttacgatgtggctctggcgctgacgaacctcgaatccgctatcgctggtctcgagaagaccggtgaggagcctggcccaggcccggttgaggtgaacaagaccgacctgcagactgcagtgaacaaggcaagcaagctcgagaaggccgattacacgaccaactcgtgggaagctttcgccgaggcactgaaggctgcacagcaggtgctcgacaacaagaacgccacccagcaggatgtggataccgcactgagcgctcttcaggacgccatctccaagctggaagctaccgccgagccgaagccgaatccggaaccgggcgtggtggacaaggctgctctgaacgcgaccatcaacaaggccgccgccatcaacctgggtctctacaccgacgactccgccaacgctctgcgcgccgcgctgaagaaggcccgtgaggtctccgacaacagcaacgccacgcagaagcaggtcgacgcagctcgtgaggctctcgagaaggcaattgccggcttggtgaagcgtaccgctgccaagggtgatggcaatgtcgtctccaacacgggtgccaatgtcgtcacgattgctgtggccggattgctgctggccggtgccggcgccgcaatcgcctaccgccgcaatcgcgagcagatgtgatcatgaaaccgtaaggttcgcgaccacataaggagcactccttattatctcggccggtgccggtcagcaatgcccagcgccggccgtttttgtatgaatcagtgttttccggtcacccagcgggcatcggaatgcacatgggggatcatcatcacaatgaccgcaatcagacagacgatcatcaccatcaaaataacgtcctcatgaccgcgcgtctgcagcgtggctccagtcaaagcaccgagcgccaaagccagcattacaatcgcgcgccggccaagtttggactgctcatgaccatgcgccgaagtgtcagcgataatcccagttaacgtcatcgtcaacacagtcgtgggcaaatctggcaccgaaagcttacgagcagtggaattctgaatgcccatagccggtgcgagcagcacaatcagcagaataatatgcaaatcaatatgccgagcagttgggaagttcagactgggctgtgccgtgcgggcgatggctgaagcatcagtgccacccatcgacggttcaggcgcaaactgattgagcagataaatgccgacgagcgcagctgccacaaaagccagctggattgacgtggacaccagcagatggcgcgcgcggttggcgccaaagtaatgaataatgcgtccgccgatgaacgcaccaatcatgaacgtggccagcgtgagcgccgaagtccaccagacgaagccctgcgcgtgggcgaatgcaaaaccaaggaacacaatgttgccggtcacattggccacaaatacatgaccgagtgccaagtaacttaacgcatccaccagtccggcgacaaacgtgagaataaccagagctggggaaagcagaccgtaccgatcatccttgcggggaatcagtgtgcgtcctgcttcggcaaggtgtgaggtcatggtgggagaggctttcctttgctgtttggcggtattcaatagctggcgcgcggccttgcacattatgaagtgtgtgccggacggtatatgtcaatgagtctgcgctcgcatgcggagtgcgtgcaacagttcgctatgagttcacctgcgattcgctgaacgcgcatagttcggtaacgcgatttcgctatatctggtcgtaataccgatgaggctaggaaaaggaatgattatgcagtcagataacagccatcatgaagcacatcagaacgacctgaactacagcagtgagtaccagtacgatatgtatatgtatgccgagtacggcatcgagtggtgattgagagccccgagtgagaattggactcacgacctcttccttaccaaggaagtgctctaccactgagctatcggggcgataatgtgcgcacggcttagggccgttgaacggcttgcacaacaatacgcgcaatcgcgtattacgcaaatcgacgggtgtacgaggaagtattcgggtgctctaagttgtacacatgagcgcaatattggctattttgcgctcatgtggcattcggatgtgccacgtaatcgcattttcgtgtttttatgcgctgttgtggcacgaaaattgtgggaattcggtcgtctcggaatatgtgccatgccacgccactgcaaaaacagtgaatgtgcacgattgtgcacatatttggaccgctgcgtatatgcatgtgggtgcggataacaaaagggttttgacaaaaaccaaaaccctgatggcggaggatacgagattcgaactcgtgaggctgttacaccaacacgctttccaagcgtgcgccatagaccactaggcgaatcctccatgcactgcagtgcttgctagaagtaagctccgtaggcaactcgaataagctaccacagctttcggataaatgcacattcagtgccggctgcggcgtgtcgctttgtggacaaggaccaccaatgagtgcctgcgctgatgtgcaggtcgttcgtacggcgtgtgcaacaggtgatctcaccgggggatgaaccagtgcaaataaaagcgactcaaggcaagtcagcaaacccgaggcaaaccagaatgaatatgcgcatgccatcgcgtgaattattgccagcctcttgccgtgatgcaacatagtgattttaggctatgaaccttggtgaaacagttggtcatgcaatatgagggatggggagtggccagtcgcggggagttcataattcgggaagtctcccatctgtgagcgggacaatatcgaatattgagacaatctgcggtaataattgatcgaaaaacagtgcctaatacctcttaaatcctaaaaaatcaagactgttcctcaaaaaagtttttctttatattgagtagttggtttttgattacttagccgcgcagagagagggataggcatggttcgtcgcgcccaggctgctcttcggtccgttgaacacaccagcgtgaggcagctgcgagttctggctgcgattgtatttctgttcgccatggtcatcgccactgtggctcctgcagtcacggctccgatggccttcgccgacagcagcaccagctcgtccagttcatcaagctcgtccagcgttgactacgccacctgggccgaagtctccaaggcgatggacaagcagctgaacagcggtcttaagacgtacaaggatggcaacaccgctggcgccacctccgatttcatgggcgcgtacaacaagatttacgtggcctccaacttcaccgcggtcgtgcacgacaccattggcgcggacaagcagctcgcccaacagcaggcattccaaagcgttcagaatctttcctacacgcctagcaacgacgatcaactggctcagcagattgatgcgttgaccgccgatcttgacgccacggcccagcagctcgacgccaacgccgatctcgccaagccgaaggcgtacgccgaagcgctgcaggcgcagctggccaaagagcgcaaggagctcgacgccaagaaaaagaagaacccgggcaagggcaatcgttcatggaccgacgtggccaacgaaatgaccccgattctcgacaatgcatacaaagcttacgaaaagggtgatggtgccaagggcgccacgctcgtgaacaacgcgtactaccagtattacgagaagctcggcttcgaaaagaacgtgatgaacgccatcagcggcaaccgcgtctcgcaggtggaataccagttcaagatgtgccgcaagtccatgaacgccggcgcatccctgaaagacaccaagaagctgatcgacgacctcaaggccatgctgatcaaggacgccggcattcttgacggtggtgccgccgataaggaagacggtttcaccaagctggtcaccagctcctccggccaggcgttcctcgtgcttatccgtgagggtcttgaagctctgctggtggttgcagccatcgtcgcctacttggtcaagtccgataacaagcgcttcgtcaagtggatttacttgggtgtgctcgtcggtctgctcggcgccggcttggtggctgtgatcttcgtgttcgccttcggcggctccggcccgattcaggagatcatggaaggcacctgcgcactgatcgccatgggcatgctgctgtggacgagtaactggatgctgaacaagtccagcgtggaagcgtggaaccgttacattcgcaagaagaccgaggctgctgtggctgatgccgaagccgccgcaagtgccgacaacgtgacgttgaaaaccgtggtctcgctggctatgctgagcttcctcgccgtgttccgtgaaggcgctgaaaccgtgatcttctacgagtccatctacacgatgagccgcgatactcgcggtatgtggatcggtggtctgaccgccgcagtggtgcttgtcggcatcttcctgctcttccgcttcacctccgtgaagattccgattggtccgttcttcctggtcacttcgattctgatgtctgtgctggtggtggtgttcgccggcggcggcgtccactcgctgatcgagggcgacttgctgcccgccttctacctgaacggtgtgccgacgaacgattggcttggcctctacccgtacgtcgaatgcctagtggcgcaggccatcgcagccgttgcggttatcgcgctgttcgtggtcggcttcatcaagcagcgcaagctgaaggcgcaggctactgccgaggtcccggccgtgaaggcgtagcccgtctagctcgtccgtttcctcccataactgcagacaactgacagacttgcggcacggcctcggatcgatgccaattcctccagcccacgccgcacttatctcataactgaataattgcaattatctaagcgtgaatcctaattcaccagagatagagaaaaggaataacaatgatgaagaacaagaaactggccgctctgctcggcctgctgctcgccggttccatgaccgtgtccatggctgcctgcggttccaccaactccgcatccgacactaaggctgactcctcctcccagtcttccgactcctcttcctccgattcttcctccgattccggcgccggtttcgaagaggttccggttggcccgtccggtactgctgaagagcaggatcaggacgccggcccgctgaccgtgggcgctgtgtacttccagccgatcgatatggagccgtcttccatgggcctgaaggctgctgacgcttccttccacctcgaggccgacatccatgccaaccagaagggcaccgagctcggctacggcaagggcgacttcgtgccggatctgaccgtgaactacaccatcatcgataagtccaccggcaaggaagtcgagggcggcaccgccacctccggtaccttcatgcagatgaacgcttccgatggcccgcactacggcgccaacgtcaagctcgacaaggctggcacctaccagctgaagctctccatcgaatccccggcctccaagggttggatgctgcacgttgacccggagaccggcgtcaagggccacttctggaccgagccgatcgaggtcaccttcgacaactgggattacactcctcgccagtggtgattgactaagcagaaagccccctcgtcagagggggctttacgccgctttagggagataattcttaggacggtctaaaactcccctcagtccgcttcgcggacagctcccctcagagaggggagcctaaggtgaacagagaaaggacgcgaatgcttgaacaattcgtggcagtgatgccgggcactttgccccccgcattgctggtgatgagcctgagcgtgatgctcacggtcggcgaggggcgagataagccgataagctcgcattggcgtctcatcggcctgatcgtcggtctgatcgccgccatcgtattcgccggcctgcgcgcctcggccgtgatcaatcagcgcacgttcgtcaactacccggtgttgtggtgcgcgatcattgccgacatcctgaccatcgtcgtggtggtgttcgcacgccgcatcaccaccaattggcagcagcacaaggtgttcatgcacatcgctaacgccgtggccgccatcgacatcgcactcaccctgttctacgcgctgccggacgtgattctgcagctcaccatctgggtggaaccaggggagaccgcattcacttcggccatgctgctgcgcgctcttggtttcctgcttggcgtggccatgtccattattgtggccgccatcttccgcacgatgcgcaccactgccgtgcgctgggcgttcaccgtggccgtcgcggccatgatggtgattctgctgattcaacacttcactggtcttgcccagattctgcaggcgcgaggcttcccgatgaaccatacgatgttcgtggcgctggcttggtccatcaaccagaactccacgatgattatggcgcaggcgctggtgttcctgattcccgccgtggcctccatcgtggccggtttccgtatgaaaacccatgatgtgccgggagccaacgaggccacgttgcgccggcataaggtattccgccgccacgccatcgccgctgccgtgtggagccttatcgcagccatcggcgtcacagcaaccctgaccgtgggcgttgccgcgacccatcagaccatcaccctttcgccgccggaagcctactcgctcaaggacggcgtggccaccatccccttcagccaggtcgaggacggccacctgcaccgcttcgaatacaaggccaaggacggcaccgtcatgcgcttcatcatcatccgaaagaacggtggcgcgtacggcatcggcctggacgcctgcgagaactgcggcgacgctggctactacgagaaggacggcaagatcatctgcaagaagtgcgaggtggccatcaacctggcgaccatcggcttcaagggtggctgcaacccgataccattcccgtacaagaccggccacggcaagatcaccattcaaactacggatctggacgcgctgagcgcccacttccggtgagtcaggcaggagacaagaatcatgttctttctgtgcatgattactcgctcgttcacccgacagctgcgccggcgcctgcttatcgcgctgaccgtatgcctgtcggcgaccgtgtccgtatcgatgctgggcgtcgtgttcgacgtgggcgacaagctcaacgccgagctgtccacctacggttcgaacatcaccgtgcagcccaaggcggatgcggtcgtttccgacctgtacaacaccgagtcgggcggcgcgacgtccaccagcgacccgaccgcttttctgaaggagtcggacgcggccaagatcaagacgatcttctggtcgttcaacatcaccagcttcgcgccgcagctcaacatccacgccacggtgaacggtaccaacgtgccggtcgtcggcacgtggttcaacaagaacctcaagatctccaccggcgagactaccgtcgtgggcgtggaaggcatgcgctcgtggtggcagctggacggcaagtggcccaaagacgattccgaccagggcgtgatcggcaagacgctggcctccgaactcggcgtgaccaccggcgacaccatcaccctcaacaaaaccaccgcctcaggcaagaagaacgagcagaaaatcaagctcaccggtgtctacgattccggcgacgaggacaacggctcgctctacatcgcctcctccacggcccaggtactcgccgacctgcccgattcggtcgacaaaatcgaggtcaaggccctgaccacgccggagaacgacctggcccgtaaggccgccgcgaacccggccgcgctgagccaggaggaatgggagacctggtactgcaccgcctacccgagctcgatcgcctatcagatcgaagaggtgattccgggcgcggtggccaagcaggtgcgtcaggtggccgcgttgcagggcaatgtgctgcaaaagacgcaggccgtgatgattctgatgaccgtgctgagcctgatcgccgcagccgtggccgtggccaacctgatggtcgcctcgatcggcgaacggtcgggcgagctggcgttgctcaaggcgctcggtgccaccgatgccgcggtatcccgcctgatgctggccgaaacggcggcaatctcgctgctgggcgcgattgtgggcgcgctgctcggttccggcgtggcccagctgataggccgggtggtgttcggttccggcattacgatgcggccgatggtgttcgtgctggtgttcgtgctgctggctgtcaccgtgctgctggcgtccgcctcatcgattcgttcgattctgaatctcaagcccgcggaggtgctccatggtcgctgagtttatctacgtaggtgtggaaggagggaaccgatgaccaacaccggtatgttcttcagaatgctgttcagcgccgtgttccgtcggcgttcgcgcgcggtgatggctgtggtggcgtcgctggtcggcgcagccacactgttctgtctggcgatgatctgcctcgctgtgccgcagcagatgaacgaggagatgcgtgcgtacggcgcgaacctgattgtcacgcccaccgaatcgaccaatgctgacggcaaggccggcatcgacaaggcgatggtgcagcacaccactgaaatggtcaaggccaagggttccgcgaaatacgccacctaccgctacgagaacgtgcgcgtcaacgcctcgccgtacgttatggccggcgtgaatgcggcgcaggtcaagaacctcaaccatcactgggtggtcgacggctcgtggccgaccgacggcaaggtgctggtcggacgcgacatcgccgacgccatcggcctgagaatcggctccgccatcaccatcggctaccgtgcatccgataacgccagcaccaacggcacttcgtcgaactcctcgatcgaccagcaaaccaaagacggccgtgtctccagtgacatcatggacacctccggtaccgaattccgcgtggccggcatcgtggacaccggcggcagcgaagactcgatcatctacgccaccaacgccgacgtcaacaagctcaccggcatcacgcgcggcgtggacgtcatcgagtattcggccggcgccagcgacctcgcaggcctggtgtccagcatcaacgacatgacctccatgcacgtcaaggcacagcaggtcaccaagatcaccgcctccgacacccgcatcatcaccatgctgcagacgctgttctggatcgtctcgctggtggtgctggtgctgacgctcgtcggcgtcggcaccacaatcagctcgatcgtctcgcagcgacgcaacgagattggcctgcgcaaggccctcggtgctagctcgcgtgccatcggcaccgagttctacatcgaatcgtcgctctacggcctgattggcggcctcatcggcaccgcaatcggctacggactcgccagttggctgtgcgtggcggtgttcgaacgctccatcgtattcaactggtggctggccctgatttccgtgctgttcagcgcgctggtcgccatcgtcgcctccatcccgcccgtccaccgcgccacccgcatcgaccccgccgtcgtgcttcgcgaagaataaagaaagagaaacgtcatgctacttgaactcgaccacatctcgaagatctacggcgacctgcgtgccgtggacgacctcaatctgaccgtgccggaaggcgaatggctcgccatcgtcggctcctccggctcaggcaagaccacgctgatgaacatgattggctgcatggacacgccctccaagggctccgtgaagctggaaggccgcaagctggaggacctgaacgccacgcagctggccgacgtgcgcaagaacctcatcggactggtgttccagaagttctatctggtgccgcacctgaccgccgtggaaaacgtgatggtggcccagtactaccattcggtggtcgatgagaagcaggccatggaggcgctggaaaaggtcggcctgaaggaccgcgcccaccacctgcccggccagctctccggcggcgagcagcagcgcgtgtgcgtggcccgcgcgctgatcaacgacccgaagctgattctggccgatgagcccaccggcaacctcgacgagaagaacgagaaaatcgtgctcgacctgttccgcaagctgcacgagcagggcaccacgattatcgtggtcacccacgatgcgctggtcgccagctgcgcgcagcgcgagatcatgctcaaccatggcgtgctcgtcggtgagaagtggaatgacgaggatgcgcgcaaggcctacgaggcggccggcggcaagcccgcctccacgggtgcacaggtcgagggcgcgcagaacggcgagaccgccattggtttcactgaccccaccaaggccgcgaaaaccggcggcgaggagtagggccgtcaggggcatcgagcagtatgtgaggaatacatggcaagctgatggtctctcccccagtcagcttcgctgacagcccccctcgtcagaggggggcttaaggagcgtgaatatgaccgaaaagagtacgttgaagaaatccgcgacattggcggcggccggactggtcgtggctggcgcgctgctggccggatgcggcgaatccaaggccgcgccgatggacgatgcgtacgccggcaactcgggcgagaccgagaagtcgcaggaagagcagtcgcaatcccagtcgaacggctccgatagctccgacggctccgattccagctcgtcgcacaacgacccgtccaccaccacgtccgacaagaaggacaccggcaactacaaggacggcaactactcgatcaacggccagtacggcccggtaggcgaggattccatcgacgtccatctgaccatcaaggacggcaacgtcgagaccgtcaatatcattgggcacccgttcaccacgatttccaagaaccatcaggacgacttcgccaaagccattaacggcgtggtggacggcaaacctctgaagggtctcaaagtggacaaggtcgccggcgccagctggacctccgacgccttcaacaaagccctcgaagtcgcccgccaggaggcttcgattcaggagtaagaccgctacttcagcaatgctggccacagcagatcggccatgcgcgaggcccaggcggtgtcgtcgtccattgctttgccctcgatggcctcatacgccaccaaagatccgataatcgtggacaacagcaacttctcgtcaacgtcctcgcgaaacacgccctgcgcgactccctgcttgaggaacgcccccacacgctccagccacggggtcaccacttggtcgacgatgtgctggaagaactcggcctcgctggacaatacaatgcccacgcgcttgacgtcgatgtcgttgtcgcgcacccaatcgaccaatcgctgcaatagttgcgtgaaatgctcacgcgtggggctgggcactgggtcggaatccgggatggccagatacatcgcgctgatctcgtgcagcagctcgtcggcattatgatatcggcggtaaatcgtggttttggccacaccggagcgccgggccacctcctcgatggtcacgccgctgatgccgcggtccaccgcaatctgcagcgtggctcgcatgagcttgcgatccgtcgcctcgcgcgtgcgctcaccgcgcggtgtcgccgtcgtgtctgtcatctccgtcatctcttctcttcgaaatatgctcccgtacgctcccgctggcgagagctggctggcaaagccagactgagggtggtaagtccatgccgtttgtaggcaactcccggataatacctactagctcagcactttagtgctctcgacttgggctacataccactggttgaaccgcaccagtggcttcctgagcaacagcccaagcaacagtagcggcggcacgaatgccagcagcattccggcggcccgccagtaatccatgtcgtagatgccggcgatggccgcacgcatcatcgtcaccgcatgggtgagcggcaagagcggactgactttggcgatgaagtcgggcaacatctgcaccgggtaggcagcgttcgcacccgaaatctgcacgatgagcataagcacgccgattgccttacccacattgccgaaactcaccaccatcgtataggtgaagaacgagaacaccagcgaggccagccatccagacaacataaacagcagcggatgcacggcctgcacgcgcaggaacagcaaatcgccaccgagcgacaccgtggattgcagcagcgcaatcagcgcgaacaccccgtaatgcccaaggaagagccgatgcggccgcggatcgcccaatgctttgcgcgtccggcgagacacggtggttttcagcgtcaccaccatcagcagcgcgcccacccacagcggcagcagcgtgtagaacggtgccatcgacgaaccgaaattcgccaccgggaatacggccttgcgcctgagctgcaccggtgcggccaacgtactggccagcgtttcgggatcattgcccagcacctctttgaccatgcccatatcgccactgtttagtgcgtcgctcagtgtgctgttgaacgaagccagttcggcgccggcggaacgcagtttgccggacaccttgtccaaggtagtgcgagcgtcgctgagcatatcgctggcgtcgtcggaagtccctttcaggtcgccgagcgtggagtccaactgggtggcgccggaactcagtatgccggaggcgtcagcgacggtggacgacagggagtcgatttgcggtttcaccgtggccgagaaatctgacttgatattggcaatactgttctgcgcttgatcagccagattcttgacctgcgcatgctgatcctgcgcgtcctgattgccttggcgaatatcggtcgccgccgtattcagcgcttgccgcagcctgttttgtcgtgcgattgaacggtcaatcgccgtgatgatggatgagtcgttgcccagtatgccggccaacgtgttgcgaatttcagtgtatttctccgtctgcttgccaatggccgtggcttgacggtccaattcgtcggcgaccgtggtggcaccatcattcgcgtcggaatacagcttgtctatggaatcggacaccgcgccgaaactggaggcgctcgcgtccagtgcgctgctcatcgcgtcagcggtggtgcccagggctccggccacgtcggtgacttcctgtttggcgctggcaagatccttgccgccttgtttggcggcagaggaaacctgagtgattagtgagttcgaggtgtcgagcaaggcgccggccgtatcggtcaatgcgctgtatgtgccaagcagatccgcagtatcgtcaagctgtgtggcgaaattggcgatgttggcgttgaaggtattcagttgctctttggcctcgggcttggacagctgatcggccagcgaagacgcgatttccagcccggccgaagtgatggtcttagcgaacgtggtgttgatttccgccgcaacctcatccgtgccctcgttgagcagattcggtgccagcgcgttcttcttctcgttgcggtaataggtcagttcggcatgctgcacgtcgtcggagaagaaggtcatcatgtctttgctgaacgacttcggaattacgatggccgcgtagtatttgccggatcgtgcgccctcgacggcatcggctttggacgtgatcgtccaatcgagctgactgttggcgcgcagcgcgttcaccacctgatcgccgaccgtgactttcaccgggatcaggtcggaacgatacccctcatccacattcgccaccgcgaatttcaggttcttcatattcgagaacgggtcccagcatgcggccacgttgaaccaggtgaacaggccgggaatcatcaccaagccgatcacgatgatgatggagaccacgttgctggtcaggcgtttgatgtcgccggtaaacagtttccacatggtgttcatcgtgcgtgcctgccttccttggtcggcggaatagtggggatgattgcggtaacagcggcgctcgggtccgcttcttcgtggcgttcggcggaggtgtcgcgacgcttggccttatgcccgtacagcatggcgcggatcgactcgtcggagaggctgccgagctcggtttggcggcggatggaatcgcgcatgaattccacgaccatcaggaagcccatgatgatgagcacccatgccagccatgtgcccatgactacgattttctcgctggtggtcagcgcaaacacgataatgagcgcggccggcaccacgaatccggcaataagcgcacccagcagcagccggggataacggtaggcgaatttggcggcccgacgttcgatggcatgacggtattcgtcgtggtcggccagtgctgcaatggcctgagtgacacggtattcgctgccgggcagatgcaccggctcgccgataatcatgtcgctttccttgatttcccgcgcgaacaggcggttgagattggccagtttcggccgggcgccgaggccaagcgcaaaggccagaaccacgaaaaccagcaatttgccgatataggcgaaccagaggccgtcgtagaagccgccgatggtttcacgcatcgcgtcaatcgaataggtgaacggcagcagcgggtagatggcgcggaagaacgcgggcatcatttcaatcgggtacaggccggaggcgcccggcacctgcagaatgaccagcgccacgcatacgcctttgcccacgtgcatgaacgtggtggagagggcgaaaatcaccgacatatacaccagtgaggtgatgacgcaggtgagcagaaacactggggcgctcgcgcattgaatgccgatgacaagatcgccgatggccgtgaccaggccttggacggcagccagcgtggccagtagcaggaagcgaccgagatagccttgggttggtgtgagatcgtcgatgccctcatcatcggtttcgagtttgggaatgaccacgagcacgaacgcgcccacccacaaagacagggtggtgaacagcggtgccatgccggaaccataggaggcgaccggatagacggcctgttcgctgataacagtgggggagagcatgaagtcggcgattgtggcggcatccagtttgccgtcggtgccgatcagggaactgagtgaactggagatgctcagggctttgatgtcggtgaccagcgtatcgagcttggtttgtacgccggccagcgccttatcggtgtcgcgcagcgcggtcaccgtggtggaggctgctttgtcgagttggtcgagggtatgcttcgactgatcgatgagtgagccttgcgacgtgatgccggtcgacagagtgctggcggtcgagctgagggcgttgagaccggtgttgagctgaggaatggcgccggaggtgatggtgccgcgagcggtattggcctcgcgcaccgtggtttgggtggcggtattgagatgctgcgccaatccggcggtgtctgtggaggcattgccgatagtggtgttcaggctatcgaggttgcccagtgcgccggcaagctcgctattgcggctttccagtgtggcaatggcggattgcagcggttctcgattggcgttcggcagccctttgagttggtcgatgatgtcggcgttcgcttggttgatgtcttccgccgtattgatcagtccgcctacctgctgattggcggcgctgatggttccggttaccgtgcccacgctttggttggcctgtgctgcggcttggctcagcaggcttgagccttggtcaagcgcttcggacgtggaggtgacgaagccgttcagactggtctgggtagtgccgatcagggtggagacgccggccagaccttctgcagtgtcgatgccaagtgtgcgcgcgtcgtccagcgcctgacgtgcggtgcgtgtctgctctggggtgtcggtgagtttggtggtgagcttggcgatggtgctgcgtgtgtgctgcacatcgtcggaggccttggcaagggccgtgagggccttggctttggtggtgtcttcggtactgatggctttgccgtcaaccgtattgatgacttcggtaagtacttcggatacggtggagacgaatgtggaattgaccgtgcggtccacagtggacgcgccgacgtcggtgactttgggggcgatggcgctggctttttcgttgacgtaatactccagagtgggccgactcttgccgccggtcaccacgccggcgagatcgtcggaaaagtctttgggaatgatgatggctgcgtatgccttgccggattccacttggtccatggcctcggcttcggtgacgaaggtccagccgagctggtcgttgcttctcatctgcttgacgatttgatcgccgaggttctgcttgccgatgagcgcgttgtcggtgccgtcgtcattgttggcgatggcgacggtgatgcctttggtattgccgtacgggtcccagaagccgacgatgttgtaccacgaatacagtggcgggatgaacaccatgccgaacaggatcacccatgcggccggcaccttgaacaggcgcaggaagtcgcgtctgaggaccttgaagatattgcccactgatacctccggagcttggtgttgcttggttgctacgttttccgtagcgatacgttaatcgtagcgctacgtttgtagtagcgtaatacggctgccggagattaatggggtgattgatgatgtttttggcggaataacgctgctgcccagcggcttatcgtgtgtcgctgggcagagcgaaaggcgttctggaacttattgacaagatttctggatggtttttggacgtttcctgaacgcgatggataggctcggtgctcggcaatgtagacagacatgtaccgaccgcccatcaagttcagcaaaaccgcaatcgggtgatagggtgaggggacgctatgtggggaggaaaccatggttgaattcaaggacgatggcacggccactacccccggcaagctgcgggagaaccgtgacgccgagtccgcagtcgtggccgatctggtggccgtcgaactggacgacgccggcttgaacctgaacgccaagcgattaccgattctggcgcgcatctatggcgcggtcgtgctgctggacggactcgccacattgccgattatggtgatttccatcctctatgccgtgcgcgagattctggatggtcatgtgcacgtcgatgcgatgagcctgaccttcatcctgtccgcgattcatgcggtggtgctggtagtcagtgccgcatgcctgattgtgctcggcgtgatgctgctgcgcaatcatcgccggtatgccgcgcgctggacctacgtgctgatgccgttgacgttggccgacggcatgctgtcgctggccctgaccggccttggcttcaacctgctgctgccgctgattcagatgattattctcgtcgtgatttcggtgaccgccgatccctccctgagcgaggaacgccgtctgcggcgcgcgctcaggcgtatggacgatcgcgatgattatgaatcggctgtggcggccggcatgctaggccgcgaccagtccggcaagggctatattgcgctggactttttcaatatcttctggctgtttaccatcgcttcggtgggtggcctgattgtggagacgatctaccatatggcgctgtataacggtgaacttcaggaccgcgctggtttgctgtggggcccgttctcgccgatttacggctgtggtgcggtattggtaaccgtgtgcctgaatcgtctgtggaaggcgaatccgttcttgattttctgcgcttcggcggtgatcggcggcgcgttcgaatattgcaccagctggttcatggaagcggcgtttggtattaccgcgtgggattacaccggccgttggctgtccatcgacggacgtacttcgggccaattcatgttcttctggggactgattggtgtggtgtgggtcaagtggctgttaccgcgactgctggctctgattaatcgcattccatggaaagtgcggtattcgctgactgcgatatgcacggtgctgatggtgatcgacattgccttcacgctgatggccttggattgctggtatgggcgcatggccggccagccgcaggattcaccggtcgcgatgtggttcagcgaacgctacagcgacgcttacatggccaatcgcttccagaccatgcatatcgacccttccaaggccgggcgtatgtgaatggccggcaagtaattacgcttcgcgggcagaaggtgcgtagaacctaagacagccctcgcgtgtgggtggtaagcgggatacactttcaagcgttgaaggaatgattccctccgctgatgcgctgttttgtgacgcgcgtgatgacgatgggacaatcaaacgaaaggcaaggcacatggccgaagctacagcaaacattggtgtgattggactggccacgatgggctccaatctggcgcgtaatctggcgcaccatggcaacacggtggcgttgttcaaccgccactactcgcgtaccgagaagctcatgaacgagcatggcaccgaaggcaacttcgtgccggccgaaacgctcgaggaattcgccgcgtccctgaagcgtccgcgtaccgccatcatcatggtcaaggccggtgctccgaccgacgcgaccatcgcgcagctggaagaggtgttcgaaccgggcgacatcatcgtcgacggtggcaactccttcttcaaggacaccatcaagcgtgagaaggaagtacgtgccaagggcttccacttcgtgggttgcggcgtgtccggtggtgaggaaggcgcgctcaacggcccgtctctgatgcccggtggcactgcggaatcctggaagaccttgggcccgattcttcagtccatcgccgccaaggtgaacggcgaaccgtgcgtgacccacatcggcaccgatggtgccggccactttgtcaagatggtgcacaacggcatcgagtatgccgatatgcaggtgattggtgaggcgtatgacattctgcgccgtggactcggcatggatgccgaggagattggcgacgtgttcgctgaatggaacaagggcgaccttgactcctacctgatcgagatcaccgctgagattctgcaccacaaggatgccgagaccggcaagccgttcgtggacgtggtcgtggatcatgccggcatgaagggtactggtacgtggaccgtgcagactggtctggaatgtggttctcctgtggctgccatcggtgaagccgtgttcgctcgtgcactgtcttcgcacggtgagctgcgtgaagacgctcagaaggaaggtctggctggaccgaacaagaccatcgatctggccggagaagacaaggccgcgttcgtcgaggacgtgcgcaaggctctgttcgcttccaaggtcgtggcctatgctcagggcctgaacgagattcaggacggtgccaaggaatacggctgggatatcaacctgtccgaagtggcccgcatttggcgtggcggctgcattattcgcgcccagttcctgctcgaccgcatcaccgaggccttcaggggcgataacccgccggcttccctgctgttcgatccgtacttcgagaagatcatcggcgaatcgcaggatgcatggcgtcgcgtgatcgttcgcgcggtggaggccggcatcccgaccccggtgttctccagctccctggcgtactacgatggtctgcgctccaagcgcctgcctaccgctctgacccagtcccagcgtgacttcttcggtgcccacacctacggtcgcgtagacaagcctggcgtgttccacacgctgtgggctgaagaaggcaagcctgaaatcgaggcgtagcctcgtgatttcaggtttaggacagccctgtgggctgtccggccttcttcaggctcggcgatagccgagctgagaaaacagcaagtccgagattgaggcgtagccatagacgaattaagccccctcatcagagggggcttaattcactcacaactcggtgacggtttcttcggtggagaaccagatgaactcgtccactccgttggcgtaggaggacgggtaatccggtttgttgggctgctcgaagacatgggccagcgattcggctttgccggcaccggcggcgaagaaccacgtatggcgtgaacgcgcgatgagcggcgcggtcaatgaaacacgcagcggcggcatcttgggggagtggttcacacccacggtgagcctatcagtaaccttgacctcatcatgaccagggaacagcgacgcatagtgaccgtccggtcccatgccgagaatcatcagatcgattaccggttccggccccaattcattcaccaactcgcgctcatagtcgctcgcgacatcgtccagcaacgcatcattcgcggcatcggcggcggcgcgaacggaagcatcatcgctgtcggcctgatccatcacatcggcgatgtcatcggctgaacgggtatcggccgccatctcatgaatattcgactcaggcagcttgccatctgccaccagctggtcaagcagcaggcgacgggcctccaaagcattgcgatcggtgtcgtaagccggcacaaaacgttcgtcgctccaccagaaatgcacgcgcgaccaatcaatcgcgtcagccagcggatcgttcagcaccaagcccagcggctgcgcggccgaaccgccagacagcgccacatccacacgcgtgcgatgcgtgccatcaggcaatcgttcggcgagcaaatcgagtagcgccaagacaaaacgttgcgcgccagcctgaatcatcagatctttattcggatacacaatgagttttcgagttgccatgtatggtccttgtatggggtatgtgtcgtactttgcaatgtggattgtgttgtcagttgacaacacaatccacattgtgcgacatcgcatatgtcactttattactccgcgggcatgagcttcggcatcgcatgaggtaggaaacgatgagcaacggcgttggcatggctcggccacaattgccgaactcattccaacgccgctgtggcaacgggttctaccgacttcagtgacgaatcagatcccagccttcgttgatgacctcggcgtagatctcatcgggatcgatgcgacgcagttcctcggtcaggcagtcctcgatggtgcgcatcggcacggacacttcctgcggagtctggccgggcagcgagatcagcgcttggtcctcatacgggcgttccagcgagatcacaccgtcctcacgggtcaggtacacgccggtcacggcctgcgcgtcgggcacgaactcagtttcgactggtacgccgagtttcagacgcagccatgcgcacagcatttccataggcaggaagtcggccttgccggtcaccttcgcggcggtgatgggcaggtgcggcggctgatcgagcatcgaggcgagcattgcgcgccagacggtcagtcgtgtccaggacaagtcgatatcttccggtgtccaattgcggcgcaaacgctcaatcgtggcctccggattattggagtgcaacgcgtcggtgatgcgactgcgggccatcgcacccatcagatccttggccgggttcgacggcggtgtggtcggccaccacgccactacaggcgcatccggcacaagcagcgggataaccagcgtatccgggtggttgataaggccaccgcgcggacgcaagacgatgatctcaccggcaccggcgtccgcgccgaatcgcacttgggcgttcaggttggaatcgttcggatcgttcgggccgtcggtcaaatcgacggccggattatcgcgactcgcgctcacctcggcggccacttcggccgcgttcggttcgccttcgccggactgatcggcaggattggtatccggtactacggcaatcacgcggcacgggtgctcacggctggccgagttcgcgatttccagcgcatgctctaggtccgcgtcctcggtggcgatgagcagcgtcagcacgcggccggtcgccgattcgccgcgctcctcgtgcagctgttcgattttgtgcgcaatctcgcgggtgcgggtgttcggcatatcgatgatcatggcatcctccagtggcggccgtcgcgcgccagcatttcgtcggcctgtgccggaccccacgtaccggcgcggtaggcctgcggctggccaagcgtggaccagaattgttcaatcggatcgaggatctcccagctgaggttcacctcttcggtggtcgggaacaacggcggatcaccgagcagcacgtccagaatcagtcgctcataggcttccggcgagttctcggtgaaggagcggccgtagctgaagtccatgttcacgtcacggacctccatggtggagccgcccggcaccttggctccgaagcgcatggtgacgccctcgtcgggctgcacgcgaatcacgatggcgttcttgccgagttcgcgcacggcggtctgctcgaacggcagatgcggggcgcgcttgaacaccacggcgatttcggttacacgcttgccgaggcgcttgccgcaacgcaggtagaacggcacgccagcccagcggcgggtgtcgatatcgaggcggatggcggcgtacgtttcagtggtgctcttggggtcgatgcctttttcctccaagtagccgatcacttcgtgcgagccctgccagcccttggcgtactggccgcgcgcggtgttggcggcgaggtccttgggcaggcgcacggcggaaagcaccttggtcttttcggcggtcaggtccttggcggtgaagctcaccggctcctccatggcggtcagagccatgagctgaagcaggtggttctggatgacgtcgcgtgcggcgccgatgccgtcgtaatagccggcgcggccgccgatgccgatgtcctcggccatcgtgatctgcacgtggtccacatagttggcgttccagatcggctcgtacatggcgttggcgaaacgcagggccagcaggttctgcacggtttccttgccgaggtagtggtcgatgcggaacacggagctcgggtcgaacacttcggataccacgctgtcgagttccttggcgctggccagatcatggccgaacggcttctcgatgatcacgcggcgccatgcgccctcggacgagcgcgacaggccggaggcggccagctgcttggcgacctgtgggaatgcgcgcggcggcaccgacatgtagaaggcatggttaccctgcgtgccgcggtcgcggtcaagctcctgcacggtggcgctcagacgctcgaaggcctccgggtcgtcgaacgtaccctgcacgaagcggatgccggcggccagattgcgccaagtcgactccttgaacggcgtacggcaatgcgcctggacggcggccttgacgaattcgatgaaccgttcctgtgtccagtcgcggcgggcgaaaccggtcagaccgaagctcggcggcagtaggccacggttcgccaggtcgtagacggctggcagtagtttcttttgtgccagatcgcccgtgacaccgaaaatgacgaggctgcatgggccggcgatacggggcagtctgaggtcgcgcgagtcgcgcaggggattgctccaattgggggattcactcataatgtacaagggtagtcgccggcggctatctatcgctagaggcgatatgcgatttgggctgcgatttgggccacattgcgtgtgctgtgccgtgcgttgggccaatcgcgtacgcaaacgtgtacgcaacgccgtagttgaaatatcccaaaacggtgtgtattttagaagagttgcccctttagctcaacggttagagcagcgtccttttaagtcgtgggttgtgggttcgaatcccacagggggcacaacaaatcctcggaatcgcaatggttccaaggatttttttgtttcgaccagcctggctcctagagtggtgtcccatgtcatgcaccacgattcttgtcggcaaaaatgccagttacgacggttccaccatcatcgcccgcgatgacgattcgggctcgggccgttacgatcccaagcgcttcgtcgctgtcgcccccgacgaccagccgcgccactaccgcagcgtgctgagccatgtcgaaatcgaactaccggacaatccttgccggtacaccatcgcaccgaacgtgctgaataatcgtggcattctggccgaagccggtgccaacgaacacaacgtggcgatgagcgccaccgaaaccatcgctgtcaacgagcgcgtgctcggtgcggacccgatggtcgagttgcggccggctgtcggcgaaccggacagcaccgattatcaggccgagcagcccggcggtatcggtgaggaagacatcatcacccttgtgctgccgtatgtcaccaccgcgcgcgagggcgtcgcgcggttgggcgaactgctcgaaacctacggcacctacgaatcgaacggcgtgattatttcggatgtggacgagatctggtacgtcgagaccatcggcggccaccattggatcgcccgccgagtgcccgatgactgctatgccacgatccccaaccagctcggcatcgacgacttcgacctcgccgatgcgttcggcgagcagcgcgaatacctatgcagcgccgacctgcgcgagttcatggccacgcatcacctcgaccgcacaatgggaacgccggtctcttccaacggccgtcacgcgcatagcgccggattcggaacaaccgttgcccttcccacccgtttcaacccgcgcaaggccttcggcaccgcgacgccgaaggaccatatctacaacacgccgcgtgcctggtacatgcaacgccgcctcaaccccagcgaggactgggattcgccggccgcccgctacacgcccgaatccgacgacatcccgtggtgccgcgtgccggaagacaaggtgagcctcgaagacgttgatttcctgctgtcctcgcacttcgaaggtacgccgtacgacccgtacggcacgaccggcacggcggaatcgcgccaccgttaccgtccgatcggcgtgaaccgcaccggccatatggtggcgattcaggtccgtccgtatgtgccggcggccaatcgcacggtgatgtgggtatcgttcggctctggtccgttcaccgccgccgcgccgttctacgcgaacgtcaacgacacgcctgcctacctgcgcgacaccacgcccgaagtctccaccggcaacctgtattggacgaaccgcctgatcgccgtcgtggccgacgcacactggtatgagacgaaccggttcatcgaagggtatgccgagggcgtgcgcgcgttcggacaccggctcatcgagcgcacggatgagcagttgcttgctcgaagcgatgccgaatcgacggatacgaatgcatggccgctcgatggcggccacggcgatgagaaggatgtgcagggcgtggcggatgtgctcgaagcggccaacgacgagatggccgactacctgcgcgagcacacaaccaagctgctgaacgatgtgctatacacctccagcaacctgatgcacaacagcttcgcgatgtccgaccgttgggccgagtagcaaaacctcgactggggaggtaatagggatgccctgctgataacgcgtcagcagggcaaaaccacaatccgaatcagttaaagccgacgatgcgtttggcgatgagatagccgttgcgcacgatccagcggccggttttgccgggcagattgagcgcgcgggacatcagctgcgagcgcacatccttgccgatggccggcgaataggcgtcaatcgcatcccacagctcggttttcttaacgtagttggccggatcgcgcgagagaatcaggaacgtcgaggtaacgcacgattcgatcgccaggaagtgaatcatgtaccggtacagcccctccggcaccgtaccgcgttcgggcgtggcctcggtcatcagccgattgacgagccgcaactggtccacacgcttaatcatcacgtcggtctgcacgctctgaccctcgcgcccgatgaagtagtggtagaacggcacatcgaggtactggatgcgcttcacccacgggaacggctggtacgagtaatagaaatcgacgtagaacgtgtgctccggcagcttcagcccggaatcgcgcaccacctgcgtgcggaaggtgagcgcatgcatgatgatgtactgcgccagaccgaacttgcccaggtcatcccagccgagcacgcggccggcctccattacacggcggaagttcactacggtcttgtgacgcttggccaccttgtcatacacgtaattggtcaccagcatgtcaatcggttcgtcggtgtcatgctgtgcacgcaacgtggccagaaccgtgtcgatggcctgcgggtcgacccaatcatccgcatccaccactttgacgtacatgccggtcgccgccgcgataccggtgttcaccgcgccgccgtggcccttgttctcctgatgaatcgcgcgcacggcgcccggattggtgcgttccagcttgcgcgcgtactccagcgtgccgtctttcgaaccgtcgtccacaatcagcacctcgaggtcgctgatgtcgcttgccgaaagcagcgagttcacgcaacggtcaaggtaggactccatattgtatgcggggatcacaaaggtgagcgtctttgccgtgctggccatgaaagtcttacgtcctcacatatttagtcgttatgttcagtttcctgttcaaaccgtagcacttcgcctcccgactcggcagagtgttgcgtaacctgtgcccctgaacgcatgttctgcaaccctgaatcttccccggtggcgtgctcgggatccgattgggcagaactcgtctggtctgaatccgggctgccggaatcggactcgcgcttggctcggcgctcggcctccttccgcgccttggcgccctcaaagaacaactggggcttggagtcaagccggctcaggccatgccaggccaaatccacaatgtatgcagccagctgctccttgctcacctttggccggtcggcccagtactgcccggtgaatacggtcatgcccaccagcatctgcgcgtagtacggcacgcccttggcagacagcttctgccgtttgaatgtttcggaaagaatgtcttcaacgcgtacggcgatgtctcccatcagcgagctgaatgagccggacgggtcggtgctcggcgagtcgcgtaccagtacctggaacccctcggcattctcttcgatataggtgaggagcgcaagcgccgtgcgttccacaatctggcgcgggtgcacggtcggatcgtcgagcgcggcggtcagcgtaccggtcagcgcgcgcatctcacgatccacaatgacggcatacaggccctctttgccgccgaaatgctcatacacaatcggcttggagactttggcgtgcgcggcgatttcctccacgcttaccgcttcgaagcctttggcggcgaatagcgagcgtccgacttcaatcagctgctcgcggcgctgcagcgacgtcatacgtgaagaatgtgccatgcggttcagcttaagtcgccgggtggaattgtcggcctgagactgccgaattcgtaggggattccatctgcgggctagacttgacaggtatggatatgaatactgtgctcgccgttcttggcgtgattgtggcggcggttatcgtaatcgccctgagcatctggttgggcaagtcccgcaagcgcgatttggatcgtgcgatgggcaaggttgcccccgacaacaagaagacccgcgacgccaaggccgccgccgacgctcggctggccgccgaagccgaggaagctaaggctgcgactgccgccgagccggccaagtcagccgaatcggccaaagccgagcctgcgccagccgcgcaggccgaacccgaaccggcagctgcgcccaagcccgagtcccaacctgcctccaagcccactcccgccaaacctgaaacccccgaatcggtcggctctcgactgacccgactcaaggcaaaacttgccaagtccggcaacccgttcggcaaggccctgttcgacatcctcgccaaagacaatctctccgaggccgattgggaagacgtcgaagacacactgctgcttgccgacgtcggtgcggatgcttccgcccaactggtcgatgacctgagaaccgacgcccgcatcactggtaaagccgacccagccgaagtacgcgccacgctcaaggagaagctgctcgatctggtcggtcgagatacggaccgccgcctcaatgccgaaaagccgggtgccgccaagcccagcgtcatcatcatggtcggcgtcaacggcaccggcaagaccaccactgccggcaaactggctcgactgttcgtggccgaaaacaagcaggtcatgatgggcgcggccgacaccttccgcgcggccgccgccgaccagctcgaaacctggggcgcacgcgtcaatgtgcccgtcgtccgctccgacaaggacggtgccgacccggcatccgtcgcctttgaggcatccgccaaggccaaggaagcgaacgcggacgtgctcatcatcgatactgccggccgactgcagaacaagtcgaacctgatggacgagctcggcaagattcgccgtgttaccgaaaagaacctgccggtggatgaagtgctgcttgtgctcgacgccaccaccggccaaaacggcatggcccaggccaaggtgttcgccgaagccatcggcattaccggtgtggtgctctccaagcttgacggttccgccaagggcggcatcgtggtcagcgtgcagaaggagctcggcgtgccggtcaagctcgtcggtcttggtgaaggtccggacgatttggcacctttcgatcccgaaggtttcgtggacggcattctcgcgtagacggtcgagttcttctcagtctcgctttgctcgacagctcccctcagcgaggggagccctgcgtccgtccacgttgtgggcgcgggaaacgcccgcaacgcaccaaacctagccccgaagcatattcgaaacatgattcggggctttcccatatccgttggaatcatgccggaatcagcccatccgatgccaacctaactgtcaggtgcgcttaacaatcgcgtaacttgccgtaacgaaaccaaaacgagaccggcttttactgacgaactgttagcccccacaagggggacggcattgtagagacaaagtcgacgccggccgcgcaaagcccccggtgccctgaacgaaagagagggaggtagacatgggagcgattgattccggtaacaccgcatggatcctgacatccgcgtccttggttttcctcatgacgcctggtgtggcgttcttctacggcggtatggttcgtgccaaggccgtcctgaacatgctgatgcttgaggcggccgccctgtcggtcaccatgattgtctggaccctgtggggttggtcgattgcttacgccggttccgacatcggaggcatcttcggcgacccggccagcggcttcctgctgaaggactccatggtcgcccaggacggcgtgttcaccgccaccggtctgaacggcaacaactacccggtttccgtggacgtcgccttccaggtcgctttcgcgatgattaccgtcggcctgatctgcggcgccattgccgagcgtgtgaagtacagcacctggatgattttcgtggcgctgtgggtcaccttcgactacgctcctatggcccacatggtctggaacggtggtctgctgtctgctgacggcgccatctccaaggccatcggcgcggccgcccacgatttcgcaggtggtactgtcgtccacatcaacgccgcagtcgccgccctgatcatcgtgctcatcatcggcaagcgtaagggcttcggcacgcagccgttccgcccgcacaacgtgccgttcgtgatgctcggcgccttcctgctgtggttcggctggttcggcttcaacgctggttccgccttcgccgccaacggtactgctggttacgcttgggtttccacctccgccgccaccgcagccgcaatgctctcttggggcttcaccgagaagattcgctccggtcactacaccgccatgggtgccgcctcgggtatggtcgccggcctggtcgccatcaccccggccgccgatgtggtttccccgctgtgggccatcgtgatgggtgccatcgctggtgtcctgacctgcctggcctgcggtctcaagttcaagttcggctacgatgactccctcgacgttgtcggcgtgcatggcgttggtggtttcaccggcaccatcctcatcggcttcttcggtgaaggcaccggtctgctggctggtggcgactggaagcagctcgtcgttcagctggtcatcgctctcgtcgccatcctctactccgcagtgatcaccgcgatcatcgccttcgctctggagaagaccatcggttggcgcgtcaccgaagctcaggaagtcggcggcatcgatcttgccgaccagggcgaacgtgcttacgattttgctggtactgccagctccgttctcaaggaggtgaagtgaaatgaagctgatcaccgctatcattcagccccataagctcgacgatgtcaaggaggccctcgcggccgccggcgtgcacggtctgaccgtgtccgaggccaacggctacggccgccagcgcggccacaccgaggtctaccgtggcgctgaatacactgtggacctgattccgaagattcgcgttgaagtgctgtccgatgacgcggatgctgaaacgctggtcggtgtgatcatcaagtccgccggcaccggcaccatcggtgacggcaaggtgtgggtcgctccgctggactccgtggcccgcgtgcgtaccggtgagaccggttccgccgcgatctgataacacagacgtccatgcttagaaggggatggactgcataggaaaggtccccgcacgccgcgaattgacgccgtgcggggactttttttggcaatgaaagatgaagcaatgacttcagcagtagatggcttgaaacaacgattcatggatatgagccagccggatgacgacggcgtctaccggaatggtgcgaccaagcgcaaagcccgcacggaactggccatgcaatgcctcactgagctgtggaatgcggcctgcaaggatgtctctttccccgtgcccgactccggcatcggcttcgccgcggtaggctcgctggcacgtggccaactgggccccagctccgacctcgacctggtcatcatctacgagcctcgcacgttgaacgaccagcagctcaacgagttggccaacaaactctggtacccgctatgggacagcggtctggacctcgaccactccatccgcacgcgcgcccaatgcgaggaagtcaccgaccatgaccttcccgccgccatgggctggctggacgtgaagcccatcgccggcgacaccgctctgatcaccaccaccgccacgtccatcctcgaacgctggcgcaaggccgcccgcaagcgcctgcccgaactgctcgactccgccaaagcccgactcgacgaattcggccggctccaatacgtcaatcagcccgacatcaaagaggcccgtggggggttgcgcgattcggtgctcgtctccgcgctcgccgcctcatggctggccgaccgcccgcacggcatttacgacgaagctgtggaacgtctgctcgacgtacgcgactgcatccatctggtggccggcaaggataccaacctgatgctgacgccctatcaggccaaagtggctgccatgcttggccttgccgatccgacttggcccgaaaacgagcgtgccgcctactcgatcgacgatctgcagacactgcttgcccgtatcggtcggcgcatctccttctcgcttgattccaccgcatcccgcgccgaacattcgctgacccacgaaaagccgcgattcgcgttcttccagatgttctctcagcgctctggtggcaagcgcgaagccccgcaattcgacgtggtggctcccggcgtggccaagcacgaaggcgaattggtgttggcgcccggtgccgagcctgccaaggatgccaagctggcgttgcgtatggccgtggcggccggcgaattcggtcttcccatcaacccgtctaccttggttaatctgaagcgctgcccgattcacgacaaccagtgggatgacgaatcgcgcgagctgtttatccgtctgcttgcgtgcggatcgaatcttatggaagtgtgggagagcatcgatttcgtggacattccgggtcgatggatgccggaatggctcggcgtccgcaaccgtccgtccgcctcggccgcccaccggtacaccatcgatcggcatatggtggaggtcacgtcgcgtctgggtcgtgagacaccgtccggtggacggtacgatgacgatcatttcaaggcattgctgttggccggtattacccatgacatcggcaagcgcgcgttcgtggccgatcacgccgccgagggtgcccgccatgtgccggtgattctcaagcgtatgggctacgcgccggacatcgtcgactgggctaccgtgctggtgcgtgagcatttgacgctatccgaatttgccacgggtaaggacccctatgatccggccgtggcggaggagttggccgaccgcttgcaccacgacaagatgctgctggatatgctgttcgacctgacccgggccgacggctcctcgctcggtgccaccgccggtgagaccatcaccaagcaatacggctggtccaagtggcgcgaacaaatcgtccgcggcatgtattccgccgcccgcgccgctatgtaaacggaatcgcccagcgcttcgcgcggccgatacctacctcatccatgcgtccgagcgcacgcgtagtccgttggacagaccgcgcccacccatgagcaccacgttgaacgcggcccagagtacggcggtacgcatcaggtcgctcgtcagcgccggcgtcaccatattggccagtatgagtatgagcgtcacatacaccacggcggtcagcgtgcatgtgacggccagatagcggtagtcgcgcgcgccgataagaatgccgtcgattgccatcatccagccttgcagtgggaagaagatgcccatcgtcaccatgcccacggcgatcagcgtctgaatatgtggcgtaggggagaagaagtgcccggcgaacaggccgactaccgcaaaagccgtgccgattaccgcgccggtgaccagtcccgcacgcccggtcgcccgcgtcagccgccgcgcctgctgcacgctgccagcgcccagcgctgtggccaccagcgtctggccggcgatgcccacggaatccagcatgttcatcgcaaaattccaagaggagttcacggcctggaacccggccaacacggcagtacccatgcgcgcggcacaggcgaccgtagtcaccatggccgcacgaatcgccaatgtgcgaatgaacaatggcagtccgtcgcccccggctgccgcaataccggccaaacgaggccgcagactcgcaccatccgcccgggaccacagaatggcggggattaccaggaacagccccatgaaccactgagctaccagcgtcgccactccggagccggcaatgccccaattcagcacaataacgaacaacacatcaagcaccgtgttcaccaccgcgccgcccaccgcagcgatcagcgtgatacgaaccttctgcaatcctcggaaaatgccgttcgccgcatataccatcagcatgcctggcgcacccagcacgattgcgcgcgtataggtcacggcttgttccaatacttcgccctgaccgcccagtgcccggcataatggctcggcagccgcgaacaatcccaatcccagtacggtgccgatgctcaaggccagccacaggccatcaatgcctgcctgcagtccctcgcgacgacgacccgctcccagcagatgtgccacctgcgcagtggtcgagtaggccaggaatatgcatagtccgactgccgtgaggatgatggtggagccgattgacaggccggccaacgccgcatccccgatatggccgacgatggctgtgtcgataaggatgaaggtcggttcggcgatgagctggccgaaggtcggcagggccagcgccatgatccggcggttggtggagcgggcgtcggtcgggccgttgctgacgtttgtgtttgcgccggcatgcggggtgccgaagccatcgcggcgtgtagtatcgccggaactggtggctttggcgtcggaagagtctatgggcacgctcacacgcatatcacgcctgactgcgttgcgcaagcacctgttgtgggcgcggaatgttatccccagactatccaccaagttatccccagtatgtggataacttagtggattatccccagaattatccccaaaatgtggataacttatttttctatccacattttgctttctgcgtgtcgtggcgctgactcataggtgaataaggaatgaaccgatgcgggcaaccgtttcgtttccatacgatatcgttcacctgccacgccacatcctatacttggaggctatgccagaaggaagtgaacactcgtatcagaatgggttcggcggtggcctggatcgtggcgatcgtggcgaccgcgcgggccggggcggcacgcagacgtcggcggcggccggcgacccgattttcgaccgcgtgcccccgcatgatgacgacgcggaaatggccgtgctcggcggcatgctgatgagtaaggatgccatcggcgaggtctcgcagaccattgacgtcaccgatttctaccagcccaagcatcagacgatctataacgcgatcatcgatctgttttccgccagtcagccggtggacgtggtgctcgtggccaaccagctgttggcggatggcaacctcgacaaggtcggcggcgcggactatctgcacagccttgtcgcatccgtaccgaccgccgctaatgccatgtactacgcggagatcgtccatcagcgggccattttgcgcaatgtgatcgccgccggcaccaaaatcgcccagctcggttattccgccgagggatcgcaggctgaggatgtggttaacctcgcccagtccgagatctacgagatgtcgatgggcaaggtgcgtcaggactatgccgccatcggcccggtggtccacgacgcgctcgaccagctggacaaactgcagcaaggcctcgtcaacaagggcgtgccgaccggcttccgcgacatcgacgacgtgacccagggcctgcagcccggacagatggtcgtcgtcgcaggacgtccggccatgggtaagtccacgctcggcatcgacttcgcccgcgccgccgcgttgcaccacaacatgacttccgtggtcttcagcttggagatgagcaaggtggagctcgctcagcgtattatctccgccgaaaccaatattccgatggccgccctgcgccgcgccgacgacatcacccccgaacgctggaacaccctgaaccagttctggaccaagatgcagaacgcgccactgttcattgacgacagcccgaacatgagcctcatggagatccgtgcgaaatgccgtcgtctgaagcagaccaacgatctgaaactcgtagtcatcgactacctgcagctgatgacctcgggcaaggccgtggaatcccgccagcaagaggtgtccgaattctcccgtgccctgaagctcttggccaaggaactcgaagtgccggtcgtggccctttcccagctgaaccgtggcccggaaatgcgtaacgacaagaagccgcagctctccgatttgcgtgaatccggctcaatcgaacaggacgccgacgtggtgttcctggtccaccgccctgacttctacgacaaggaagaccgccccggcgaggccgatatcatcatggccaagcaccgtaacggcccgaccgaaaccttccacctcgccttcctcggtgccacgtccaaattcaaagacatgccgcaggactacaacgccaatcagggggtgtgatgatggcaagcaacgtttcacgcgatgtttcgcaagaccaatcgtccgtggtgcagacctgcaaaccgtggtatgcgttcgccaccgtggccgcaggccgcttcgtgcggtttgcatcccgcgtcaccaaacatggcggttcggctttgcccggcaaagtcgtagaaaagattgaccccggcttcctgacccgtacgctcgggcagttgccgcttggcgtggtattggtgtccggcacgaacggcaagaccaccaccacccgcatggtcgcctcgatgctctccgatctggggctgaaggtgttcaccaatccgaccggctcgaacttcgtgcgcggcgtggtctccgcactgcttaccgaagtcacgctcggcggcaaattggacgcggacatcgccgtgctcgagctcgatgaggcgtacgccgtccacttcgtcaagcaggtcaagccccgttatgcattgctgctgaacgtgatgcgcgatcagcttgaccgattcggtgaaatcgacaccacggccaaactgctcagccatgtggctgcggcgactaccggcactgtggtactgaaccgcgaggacccgcgtatcgccgcgctcgccgcgaaggccccggctggcaccaccgtgcgatacttcggcctcgccgacgatttgcgccactatttcccgtccgatgacgacatggccacgaccgtgtcggtggaaggtgcggccgggccgctcccctcagccagaactcctctcagtccgcgaagcgaactgagaggagcttccacaggcacggcagaacttcccgccgacgtgacacttaccgccgtgggcgaccacaaggccaccttccagatggacggtcagggctacgccaccgacgtcaagcttgaaggcgtctacaacctgtacaacgcggccgccgcgctcgctgtggtacgtgcggtgatgcaagacaatgccgccgcatccaaggccaccgccgcagccaacgcctgcgccgtgtccgccgacgagcttatcgctgccgtttcccgcgtcacgccggctttcggccgtggcgaggtcatcgacgtcaacggttccccggtcgaactgctgctggtcaagaacccgatgggcttccgcctctcgctcgccagcttcgacccggccaacgcggacaccatgatcgccatcaacgacgaatatgccgacggccgcgacatgagctggctgtgggacgtggacttcacttccctgcgcgcgtccggtgtcgccatggtctccggcgtgcgtgcctgggacatggcattgcgcctggggtatgaccaagtgccagtcgccgatacgaacaccgacctcgaacaggccgtcaccgcattcgtcaacgccaatcccggcacacgcaagcacatctactgcacctacaccgccatgctcaaaacccgcgccgtactgggccgcatcaccgaagtacgggacgcgggcgtgggcaagtaactatcctctagcgcccgcgcgccacctcccgcctgcgggaggacatggtgaggaataagacgcttcccgtcagcgggaagacatcgacaaggagaacgtgacatggccagaacaattgatgtggtgtccctgtatcccaaagacatgaacatctacggcgattccggcaacgtgctgactatccgccgccgtctggaactgtacggttatgaaccggtcgtccaccagtacaatcaaggcgacgactggcccgaccaggtggaccttattctgggaggcggcggccaagacaccggccagaagaaaatcatcgacgacttctaccatcgcgccgacctgttgcgttcgcttgccgcagacggtacgccgatgctgatgatctgcggcctgtaccagctgttcggcgagtactttgaaaccgtggacggcacccgtctggacggcatcggcgttatcggtgcttataccgtgggccagaacgtgcgtatgatcggcaatcttgttgagcattccgaccagttcggcgatgtgattggctacgagaaccactccggccagaccttcctgcgcgaaggcgttcagccactcggcaccgtcaatcaggacggccgaggcaacaatggcgaagaccataccgagggcgcgcgcgtgcacaacgtgatcggcacctacatgcacggctcgttgctgcctaaaaaccccgccatcagcgatttccttatcgaaactgccgtgactcgtcgttacggtacgttcgatacgtccgatcagacccccgaacaagccaaggagctcgcccggctcgatcaagtagccaccaacgcgcgcaaggctgccgccgaacgtcctcggtgaattctcggtgagtcctcggtaagtaccaatcagcgaaaaatcagtcgaaatcagtctgagggtctagtacattgccctgttgtttgcgctaggcttggtggtacgagacatggcaccaggccatgtcggacctcgaaggaggggtatcatggctgattttgatcttctgggtgatggcctgcgcaaggtcctgctggcgggcatcggagcccttgccaccggatacgagaagagcagcgagctcgtcgacgaactcgtcaagaagggtgagattacggtcgagcagggcaaggcgctgaacaccgagctcaagcgcaaggtgagcgagacggtggatgacgccaagaaggccgccgccgaagccggcgacaaagctgctgccgcagccgacaccagtgccgccgacaagcccgctgacgagggcaaggccgagtgaccaagcccacacgcgctacgccggaatcagggtcgaccccgctttccagcagggtcgaccctattctgacgcctgcgaaagccgaacgtgaggcggcggcgaaccggtccgtcgacacgtcggacacgctcaagcagaccgttaccaaggcgactccgagcgtatccgacgaaacgctggcactgttcggacgcaggaacgatttcgccacgcgctaccatctgacgcgtcgtggcaagatcaaacgactggggcagatcaccagaatcgtcgagcaattcgacgtgctgcacggcctgactccggtcaaaatgcgcctcatgttcgaggcgctcggccccacgttcgtcaaagtgggccagattctgtcgatgcgctccgagattctgccgcaaagcttctgcgacgaactcgccaaactgcgcgccgacgccgacccgatgccgtattccacggtgttggatgtgcttgccgccgaatacgggcgtcccgccgacgaggtgttcgcgcatatcgaccccaagccgttgggctctgcttcactggcgcaagtgcatcgcgccacgctgaaaaccggcgaagatgtggccattaaagtgcagcgcccgggtgtgcgcgaaaccatggcccaggacgtctccatcatgcgctccatagccaaggccgccactaaggtgattcgcacctcacagatcgtggacctgaagggcgtggtcgaggagctgtgggacaccttcgaatcggagactgactttctgatcgaggcccgcaatctcgccgaattcaagcgtttcgccgcccgattcaaatacatggactgcccgacggcgtacaccgaactgtgcaccgagcatgtggtggtcatggagtacatcgacggcatctccgtctcccatccgggccggctcgtcgatgctggttatgacttgaaggagatcggcaccaagctcgtcgacaattacgccacgcagattctcgacgacggcttcttccacgctgacccacatcccggcaatatcatcatccggggcggccagatcgtacttatcgacctcggtatgaccggtcggctcgaccagcgcacccgtgcagtcctcaaagaaatgattttcgccgtcgccaaacaggattcgcccgctctggccgaggggctgctgcgatttgccggcaccgaggccgatccggaggactacccagcactgctggctgatctggacgtgatcgtcaaggaattcggcaccgtggatctggccgaactggacattgccgccttcctgaccgcactgacgcagatggccggccgccacaacatcgaggtgcccagtacggtgaccaccgtcggccgcgcgttggttacgctcgaaggcttgctggacgagttcattcctgatgtgaatatgatcgaaatcatttccgaccatatcgccacgtcgaaatcgctgaagaacgccaccaaagacgagatcaagtcgctgggcgttgagggacatcaggctttgcatgccacgctcggcaccatgaccgaactcaagaccgtggcccgtatgctgacccgtggtcagttgcgcgtcaacatggaactggtcggcttcgaagagccgttccagctgctttcggatatggtgaatcgtctgacgatggccctgattgtggtcggtttgttcgttggctcgtcgattgtctactacgccggcatgaagccgattatcttcggcattccggtcatcggcttcatgggctacgtcgtggccttcgccctcggcgtatggatcgtcatcgacatctacttaaaggggcgcaaaaccaagaagcggtagggcatcgattgatatcagtccagcgggagggtggattcgcgctggataaggtggcagggtacgtagtcgacaccgtgatgcgggttgccgtcgatggcatcgaccaagtatcgtgccgcacgccgtccgatggtttcggtttcgttgtcgatcgacgtcagtgcgggcctcgagctggaggtcagtaccgaccagttatcgtggccgatgacggcgacgtcatccgggatgcgcagtccctgctgcttgagcacgtcaatgcagccgcgggccaactgatcgttctggcagaccactgcatcgaacttgaccccttggtcgagcagcaggcgggtggcggcgcggccccagccttcgtcccatttgccgtaacgaattgggccggcgggttcaatacctaattcggagagtgcctcgagcgcgcccttggtgcggtcggtggcagcggtataggtttcgtcgccgccgataatggcgatgtgccggcggccacacgagatgagatggttgatggccatgcggccggcgtccacgttgtcgcaagtgaccgagcagtctttggggtcggtggaggggccgtagacgtagaccagtggcacgccccagtcatggccaagcgtgggcctggggttggtctcgcactgcacgatgagcagtccgtcgaccttgagggacagcagtttctcgacatgctgacgttccaaggcggcgtcgccacgagcgttggccaacaatactgaggtcgattgggctcgcaactcgttctccgcgccgataagaatcggtgtggagaaacgaccctgcagatcggaggtgaccaggccgatagtgccggtggtgccgcgggctagggattgggcgagtttgttgggagagtagttgagttgcttggcggcatccagtacacgctgcttggtttcttcgctgatacggggtttgttgtgcagtgccttggatgcagtggccgtcgagactccggccaatgccgccacatcctcaagtcgcgctgcccgtccggttgctggctgggtcatcatgcctcgattccttggtccttcagcagtatatagcgcattgttttgcgatgaaatacctcatacggtgtggtgcgccattgcatctgggaataattgtagcttcaatgcgaaaactttcgcaaacatctttttttcggcgtggcgtagtcagggaaattgttcaagtgcaaggtaagtgaaagaaagcgttacttccatgttcgcttttgtttgatttgctcgacacgccggaataatcattgatattaagccaattcaagcacgttattcatagtcgaatcacagtctcgaacccgtttgatgtgagaaaaaacgcgaaaatgcgaaagcgcttttgcaaaaacttccatgtttgtttatattgagaaaaggctttcgcagtgttacctgctccgggcaaaggagcgagcagggcgaaaccaaggaggcggaccgtccgccaccgcctctcatagttgagcggatatatagagaaagaagcgaacatggtgtctttcaataaactgacccgtactcttgctggcatcgctgccgccgcgttgatcgttccgctggccgcctgtggtggctccggcaatggtggcactgccaccgccgaaggtatcccggccaagggcaccgacgatggtaccgagatcaccctgtggacccgttcccctctggagcgtcaggccaagaacgtggtcgaggcttacaacaagagccacaagaaccaggtcaagctcgagatcatcccgaacgacgatatggaaggcaaggtcggcggcgcttcgcagaccgactccctgcctgacatcctcgccggcgacgtggtccgtattccgtactgggcttccgagggcatcttcaccgacatcaccaagcaaatcgatggcctggacaacaaggccgacctgcagcagggccacatcgaagccggtactgttgacggcgccgagtacaccctgccgttcatcactgacgtttccgtgatggtctggaacaagaacctgtacaaggaagccggtctggacccggagcagggtccgaagagcatcgaccagttcgtcgagcaggccaagaaggtcgccgccctcaacaaggatggcgtcgcaggctcctacctcgccggtcagtccggtggtgctctggtcttcgacctcttcccgtccgtgtgggctgacggcgaatccgtcatgaacaaggatggctccgaggccaccctggacaacgactccatgaagggcgtcttggacgcttacaaggagctggccaacaccaccaacggcctgggtgcaggctccaaggaagagaccggcgccacctggaccgctccgttcgcgaacggcaagatcggcgttatgccttacccgaacacctccaccactgctctgttcgatgctgagaaggacggcggcttcgaggtcggcgttgctccgatcccgggcaccaaggaaggcaagacctccacgttcctcggcggcgatgccatgggtatctccaaggactccaagcacgttgctcaggcctggaacttcctctactggctgatgcagtctgacgctcagaaggaagtcttcgctgaccaaggcgacaccgcctccaacatccagaccctgaagaccgcttacaaagacgctgacccacgcatccagaccatcaactccgtgattatcgacggcaacggccagaccccgaagtccccggccttcaacgaagccttcaacgccgctggctccccgtggcagctgctcgtgcagaacgccgtgtggggttccggtgacctcaaggccgacaacaaggccgtcaccgacgtcctgtctgcccagtgattcggtggtgatgctcctcaccatcactcatcaaatcacagcaataactgaataacaactgaacagattgagccggtccctcccttgtgagggcaggagccggctcaaccacataatcgaacttctatcttcttcttcattccttttcttccttcatcactacataccttatgaatgcggtgtgttggcggggcttcggagtcctccttcctcgaagccctgacatcggattgcattcggattccgtgattaccatttcacagtaatttcccaaaggagagagaaacatgtcgagtgtttccaagagcgccggggctgtgcccgtgcataagtccaaggcgaaggcggcgcagaccaggcgaggtctgctgtacgcacttccggactggctgatgattatcgtcctgttcttcgtgccgattgttctactggtcgtcatggcctgctctcgttggagcctgctgggtggcaaccgcggcgtgaacttcccggacaacttcgtcaaggtgttcgagaacaaattgttctggccctcgatttggttcacgctcgagtacaccgtgatcgtcacgatcttcctgttggtccttggcctgggcatggccatgattgtgcaggagagctcgaagtggaacaacgtgctgcgtacctgcttcctgctgccgtccgcgacgggcctggcgtccgcgtccctgctgttctacgccctgtattccccgcaggtgggccctgtcaccaagattctgagctcgttgggcctgatgcaggagggtggttcggtgctggccaccggccagtcggccctgtgggccacgattatcgtgattgtttggcgtttctcgggctactacatgctgctgatgatgatcggtctgcaggccatccccggtgatctgtacgaggcggcccgcatggacggcgccggttcctggcgtatcttccgctccatcaccctgccgctgatgaagccgaccatcgtgatgtgcctggtctactgcgtgaccggctcgatcctcgcgttcgatcagttcttcattctgaccaagggtggtccgaacaactccaccatgaccgtggtgcagctcatctacaacttcgccttcgattccaagaaggatctgggtatggccgcggcgctctcgctgatcgtgctggtggccttggtcatcatcaactccatccagatgcgcggcatgcgcgacaacaccaagtgagaaaggggaggtaacacattatgactaccccattgtggaagcgtatcatcgcccggatccttgaggccctgctggccatcatcttcatcagcccgctggtctgggtcatcatctgctcgttcagcccgcaggccggttcggcccagtccaagggctggggcgtggccaactacctgaccctgttcggttatcaggaaggtctgcccaagtacctgttcaactcggtaatcgtgactctggtcgcggtcgtgttctccgtggtcgtctgtacgctggccggctactcgttctcccgcttcgactacccgggccgcaacctcggcttcatggtcaccctgtcgatcctgatggtaccgtacgcctcgctgctgatcccgctgatggtctggtacaagcagatcggcctgaacgacagcctgctgggcgtgggcctggtcatcaccctgttccagctgcctatgagcacgttcatcatgcgtaacgcatttgacgcgattcccaaggacatggaggaggccgccatggtcgacggctgcaacagcctccaggccttgttcaagatcctggtgccggtggtcaagccttcgatggttacggttggcctgctcgccttcctcgaggcatggaacaacttcatgattccgctgtacttgagctcttcgtccaagtccacgctgccgctggcgatggtgaacatgcgtcagcagaccatgggcgtcatcgattacggtgccaccgaggccggcgtcgtgatcctgctgattccctgcgccatcctgttcctcgcactccagaagtactacgtcaagggctttatggccggagctgtcaagggctgacggctcgtgccgccggcccttggctgggagcccggtgggctcccagcaagctccgtgctgagacgcgacagcgtcgaagccaatactgagcccggctgaaaccggtccttaattgcagggccggaggcggtgtggtcaagggccttaaaaaaaggacaatcatgaacgttacaatcacttccccgttctggaagcggcgtcgcgaccagatcgtcgaatccgtcatcccctaccagtggggcgtgatgaacgacgagatcgacaccacggtgcccgacgacccagccggcaaccagctggctgacaacaagagccatgcggttgccaacctgaaggttgccgccggcgaattggacgacgagttccatggcatggtcttccaagactccgacgtctacaagtggcttgaggaagccgcctacgcattggcataccacccggatcccgagctcaaggcgctgtgcgaccgcacggtcgatctcatcgcccgcgcccagcagtcggacggctatttggacaccccgtaccagatcaagtccggcgtatgggccgaccgcccgcgcttcagcctgattcagcagagccacgagatgtacgtgatgggtcactacatcgaggccgccgtcgcctaccatcaggtgaccggcaacgagcaggcccttgaagtcgccaaaaagatggccgactgcctggatgccaacttcggccccgaagaaggcaagatccacggcgccgatggtcatcctgagatcgagctcgccctcgccaagctgtatgaagagaccggtgagaagcgttatctgacgctttcccagtatctcatcgacgtgcgcggtcaggatccgcagttctacgccaagcagctcaaggcgatgaacggcgacaacatcttccatgatctcggcttctacaagcccacctacttccaggctgccgagcccgtacgcgaccagcagaccgcggacggccacgccgtgcgcgtcggttacctgtgcaccggcgtggctcacgtgggccgactactcggcgatcaggggctgatcgacactgccaagcgtttctggaagaacatcgtcacccgtcgcatgtatgtcaccggtgcgatcggctccacccatgtgggcgaatcgttcacctacgattacgacctgccgaacgacacgatgtacggcgagacctgcgcttccgtggccatgagcatgttcgcccagcagatgctcgacctcgagcccaagggcgaatacgccgatgtgctggagaaggaactgttcaatggttccatcgccggcatctcgcttgacggcaagcagtactactacgtcaacgcactggagactactcccgacggactggacaacccggatcgtcaccacgtgctctcccaccgtgtcgactggttcggctgcgcatgctgcccggccaacatcgcccgactcatcgcttcagtggaccgttacatctacaccgagcgcgacggcggcaagaccgtgctgagccaccagttcatcgccaacaaggccgattttgcttccggccttacggtcgaacagcgttcggacttcccgtgggacagtcacgtggaatacacggtgagcctgcccgccagcgctgcggacagctcggtccgatttggactgcgcatccccggctggtccttgggctcctacacgctgaccgtgaacggcaagcccgcagtgggttcgctggaagacggcttcgtataccttgtggtcaacgccggcgatacgttggagattgcgctcgagctcgacatgtccgtcaagttcgtgcgcgccaactcccgcgtgcgctccgacgccggccaggtggccgttatgcgcggtccgctggtctactgcgccgaacaggtcgataaccccggtgatctgtggaactatcgtctggccgatggcgtcaccggtgcggatgccgctgtggctttccaggccgacttgctgggtggcgtcgataccgttgatttgccggcagtgcgcgagcacgccgacgaggatgacgcgccgctgtacgtggatgccgacgaaccgcgtgcgggcgaacccgcgacgctgcgcttggtgccgtactactcgtgggccaaccgcgagataggcgagatgcgtgtcttccagcgtcgataaatatcggcgatatgccggcctgcgcgcaactggccggcaaaaaatacttatgccgccatcgtctgtaataagtcgatgacggcataggccggatgtcagtatcgattggagccgaaaacacatccggggaatgaggtctcctgtgcggggtaatacccgtgcaggagattattttttaattatatgctcctgctgtgagagctgtcggcggagtcgactgagggcggtcataagcggtaccgtgtaagccaccctcagtctcgctttgcgagccagctcccgccagcgggagcctgttggttcctgattcagcgaggctgaatcgttgcgccgtaggtactgcgacacggcgaaacgcagcaatgctctaatgcgaaaataaatgcgaaagctgagaaattaccgggtttttgttgtataagatggttgatatcactgagggaaagttgtgaaaccgtattcgctcggttatgatgtggaatcagcttcggtgaattgctccaaccgggatatccatggcggatatcacaccagatttactgaagacactcattccggtgaacccaataaccaataaaggaaactgatggagaacgggctctgcggcccagcatccacagaagaagtcctggtcgcatagacgcgacgtagcctgagcgaagacgcgaaagaccggggcggagaggtccaagcaggaatgcatcaatcaacacgaaagcggtggcttgcgtcaatcggcgcggttgcagcggtcgccacactggccaccggcggtgcagtcaccgcgcaggcagccgatacgcccgtcatcaagaatgcggatgtggcatatccgtcgttcaagggatctgatgatccgatgaagacggcggcgaacaacaccacatataaccctgccgccagctatctgcaggagacattcgataacgacgtgaagaacctggccggcaccgacaccgaccatgacttctggatcgataagattctcacccgtactggtgcacagccaactggtaaaggcacgaacgacaagggttcttactcgtatgaaggctccgacggcaacaactacctgttcacccgtggtcgcgccgcctacatgtacacgcacacgcctaatcggctcggttttgtgggtaacaccgcctactgggatgagaccaacagggatggctttaccgttaccgtaaacgctgacggtgcaaaccagacccttaacgaagacgcctcccagcgcaagcagacaccgagctacttcacctccctgttccagaccggtggcaagagcctcaagatcaaggaagttaagtacatcacctacaacaacgtgatggttgcgaacctcaccgtggaaagcacgcaggaccgcgatgtcacactgaccacggcctcgccgttcgccgccgagggtgctgatggtgccaccgaacttactggccgcgtgaacgtcaagaacaacctgacgaccatctatccgcgcttctccgccaacaaccaggacggttccaactggatcgtcagcggtggcaaactcaccagcacgttgagcctcaaggccaacgaaccgcagaccgtcaagattcagctcggcctgatcgccaacgaactgcctgactccaccaaggaatatgaggcccgttacaccggcgactttaaggatgctgccgcctcctacaaggattccgtgaccacctacaacaagtggtgggtcgataacgctccctatgtggacactccggaagacaacatcgataagaccgtggtctaccgctggtggctgagtcgtttcaacatgctcgacgccaacatacctggcaacaccttccagtacccgacctccatcgagggtgtgctcggctacaacaaccagatcgtgctcacctccggcatgttcatgatggacaccaagtggttccgcaaccccgagtactcctacggcacctggctttccgccggcgataccgccaagaagagcaaggcgggctattactactaccacgacaatccgggcgacccggccaactggaaccatagctacacgcagtacatcacgcgcgccggctgggactcctacaaggtgcacggcggtccgtccaccgtggccgagaagctggccgaccagggtgccgaggacgtgcaaggtctactcgcttccaagagcgagccggacaacaacgacaaccagaacaacaatgacaacagcttgattgactggtcctggtggtcgatgaccggtaacgatgccgacgccgtttccttctctgagccgggtcgctccggccagcgcatggatcgcgccgatggttccgccaatatgtgggccaacgctaacgcggctgctcaggcatacaaggctgctggcgataccgccaacgccgagaagatgcaggccatcgccgacaagatccagaaagaagtcaccactgaactgtgggacaagtccgacaacctgctcaagcacaggtggctgaacgacggtgctttcgccaagtacaaggagatcaataactactacccgtactccgaaggcctgatgcctaccggcaacgaagattacaacaaggctctgcgcctgttcgaggattccaacgagttcccgatcttcccgttcttcaccgccaaccaagcggacaaggccgcgttgaacttccccggttccaacaacttctccatcattaatgcgcagccgctgctgcaggtctactcggccggtattcgcaactacgatgcagccaagaatggctacatcaccaatgagcagttcaagaagctgctgtactgggtggcgttcgcgcactaccagggcggcgataacaactaccctgatcagaacgagttctggaacgaggacaacaacaacgtcggcgatgtgaacggtgacggcgtgatcaacaacctcgacaagaaccttgacgccgcacagaacggcggcaagatcacctaccgctcctggatccaccacacccagctcggcaccacgaactggacgatggtcgaggacgtagccggtatggtgccgcgcgaggacaacaagattgagctaaacccgatcgaaatccccggttggaactacttcacggtaaacaacctgcgctaccacgatcaggatgtctccatcgtatgggacaaggacggcagccactacggtggtcctgctggctacagcctgtacgtgggcggcaagctcgccttcacctccgacaagctggcgcacctcatctatgacccggctgcgggaacggtcgaggtcaaggacgattccagtgcccaggttaccgtcggcgccgaagccgtcaagaacgtgaaggccgccaatcaggttaccttcaatgccgatcagcgcgtgaccgacctgttcgccaagtccggcaccaacgtcgactccgcctccaagtccaccacgaacgtggccaaggacgcggacgtgaccggtaccacctacgccgagaaggacaccaactacccggccaagaacgcggtggacggcaagaccgtgatggaatcgttctggggtaccaagggctctgagaacaagaccgacacgctcaatatcaagttcaaggacggcaagcagaagatcgacgacatccgcttgtacttctaccagagctcgtccagccagaccatctccggctatgccgagcccgccaactacaagttggagtaccagaaggatgacggcacatgggccccgattgcggatcaggtgcgcaccccgaactacgcgggcgcgaactacaaccgtatccagttcactccggtggagaccacgaccatccgcgtcaccttcacgccgcaggccggcatggccgtcggtgtcaaggagatcgaagcctacaacaccggtatcaaggctgacggcacttccgagaaccagactccgcaggtggatgcttacgtgtcttccagcacctcatctggtgccaagctcgtcggtacggtgaaggatgacggtctgcccgcagaaggcgacgtcaccaccacatggtcccaggtctccggtccggaaggcggtactgcgaagttcgtggacgcctccgctgccagcaccaccgtcaccttcaacaaggagggtgactacgtcctgaagctcaccgcttccgatggcgagaaggaaggctccaaggaaatcaccgttcacggcatcccctctgacggtaccgtgaacgtagccccgcagtcgagcgcctctgccagctacaccaacggctaccagccgaaggacaacgccaagaaggtcatcgacggtcaggtggtatacgccaacacgccgaacgagacctggaacaactggggcgactccactggtgtggagccgtggctgcaactgaagtgggccggcaaggtgccgctgaagaaggccaaggtcttcttctggaccgatggcggtggcgtgccgatggtctcatcttggaagctccagtacgctgacgctgacggtaactggcaggatgtgaaactggctgacggccagtcctacacggtcaaccggaacgaaggcaacgaagtgaagttcgccgacgccgtcgaaaccgacaagctgcgcgtggtcttcccgaagggcgccatcgtgggtgcttccgagttcgaggcgtacgccatcgagccggtgagcgtggacgaagtcaaccgactggtgcagaccggttccaaggctgatgatctgaagctgccatccaccgtgagcgccgtatacaccgacggttctcgccgtgacctcgccgtcgcgtggggtaaggtgaccgacgctcagctggccgccgatgccgtattcgatgtcaagggcaccgtcgccggtgcgctgaacggtacggttgcacacatcgcggctcgttccgataccgcatcgcagaccgtgggtaatgcgcagccggttgagcagaccgtctaccagaacgccaagtccatcgacctgcccgccacggttccggtgaagttcccgaacggatacaacgacgaccgcaaggtcacgtggaaggatgccgacatcaaggccatcgacctgaccaaggttggtgactacgaggtggctggtaccgtcgacgacggttcatcttccgcagctgccaagctcactgtccacgtggttgccgacccgaacggttcctccactccggagcctgagcctgagccgttggtcggttggattgaaggcaaggcgaccaggaccaccatttcgcctgattccgaggcgacctggtcactggccgaaggcaagctcaacgacggcgtagtcgtcgatgatacttggccgaccacggatgatcagaacgtcaacgacaaggtctggggttcttggggcaaggcaaaggacggcatgtacgcccagtacgacttcggtcagtccgtgaccattgaccagagccgcgcccagttctgggccaacttcgctgagactgacgattcgaagggtggtctggaagtcccggacgcttggaagattcagtacctcgccgaggatggttcttggaaggacgtcgagcccaccgaggattacaccgtcgtgcgtaattcgccggcttctcgtgcggataccgatgccaagggttggagcgctgtgaccttcaagccggtcaccaccaagtcgctgcgactcgtgctcactccgtacaccggcagcagcaccttcggggccgccgtggccgagtggggcgtgcatggtattgacggcaccgagcctgaacctaccccggtcgacaagaccgcgctcaagtcggctcttgacgcagccaacggcctcgatgcaagctgctacaccgccgcttcatgggctgagttccagcaaatcattgacgctgcccaggctgtgtacgacgatgtcaatgccaccgaagaacaggtcgccgagcaagtgaccaagctcgaggacggccagaaggcgctcgttgcgctcgccaccgacgtggagaagtccacgttgcaggcggccatcgacacggccaaggccgaggccgcttccggcaagtacacggataagagtgtcgaggccttgaacaaggccatcgaggctgcggaagatgtgctcaagggcgatgaggccggtgaggtcactcaggccgccgtccaggaagcgttcgcttcgctgaacaaggccgtcaaggccttggaagagaagcccgccgccgaaacggtgaagaaggagtctctcaaggcttccatcgagcaggccaagaaggctgacaagtcgaagtacaccgagaaggcatggcaggctctgcagagccagattgccgccgctcagaaggtgtacgacgacaaggacgccaagcaggccgacgtcgatgccgcacaggatgctctcgacaaggcgttctgggccacgaagccggagcagaagcccggctcccagcagcccggcgtggccgacggcaagcagaacgacaacaagggcagcctgaccaacacgggtgtggctgtgctcggtgtcggaattctcgctgtgctgttcgccgccgcgggtgtgaccatcctgaagcgccgccagtccggtgctcacggttcggcccgccactctgcctgacccgcaacggagtcattctgccgagtgagccccctcacagagggggctctagccttttccttctacccatcattactcttttcactcactcaatgaggagcactatgagtttccatatatccgcgcaatcggttcgcgcggtggccggtggactcgtcgccgcagcgacattgctgccaggccttgccctcgcgccgaccgcaatggccgcagattcagccaccgctgacaacgcgcccagcgttgccggtcacgcgtataacgaactgccgtataacaatcctgatgttactgtcacccaaatcgacaatagctcactgcccagctacatgcgcaaccccatcgggcagaacgagggtattgacaccccgaacgatctttcgcagaactactactctgcggatgcgtccgcgctgagctatgacggcaaactcttcgttttcactggtcacgatgaggcttcgcctgactacggctccttcaatatgaaggattggggcgtatacgtcaccgatgaagatggtctcaatcgaggcaaatggacacattacaagaccatcgccaaggccgacctattcagctgggctaccggtgatggcgcatacgctggccaagttgtgaccgacgataacggcactccgaacgacacctccgatgattggttctactactacgtaccggtgaaggacaaggcttctgaggcggccggacaggacccgttcgccatcggcgtggctaagtcgaagagtccgctcggcccgtggaaggatgccatcggtaagccgctgctcaccacatcgcaaacccagattgaaaccatcgatccggcattctttgtggacgaggatggcaccggatatttgcactttggtacttttggcacccagctcgcaatcaagatgaagaaggacgccacaaccggccgcacctcgtacactgagaccgaaaccaaggctgatggcaccacgccgaacctccacaccatgaaggacgcggacaataacgcgaatggtccgaagggcttctttgaggcggcatgggtgttccgtaagggtgacacctattataacgtgtacgacggtggtaagccgggctcaggtacagccacctgcgtggaatcgaactaccaagcttgcatccagtactccacttctgacagtccgctcggaccgtggaagtatcagggcgtgatcgtgccttccggttccgctaccaccatgcacccctcagtgctccagttcggcgacaaatggtatgtgacctaccacaccggcgataaggaaggcggcaccgatttccgccgtgccgtgtgcatcgatgaagtcgactggaccgctgacggccagatgactttcaccgcacatccgaccaaagcggagaaaacgcagccctccaccaacgtagcctcgtacgcaaaggtgagcgcaacgttcaccgagacgccggcatacaagggatcggtgaacgatgggcgtgtactgcaaaccattgtggtgccaccgaaccactggaccaactaccgctccattccgcagccacaatccggcgactcgctggtctaccaatgggatggcactgtgcgcgccaactcgtccaaggtttggttcgatgtggattccaacgcgctgcgcgcgcccgcttcgtggaagattcagtacttggacgcggacggtacatggaaagatgtcaccagtccgagcggttatacaacaaccaccggcaaggccaaccccaacactgtcacgttcgatgcagtgaccaccactgctctaaagctcgacatgactggccaagctgtggatggaggctacgcctccgtggccgtggctgagtgggaagtcggcgctgctgatagcgaatcgccggcaatcactgcgccgaagggcgtgacgaccgccaccggcaccgcgcccacgctgcctgccaccgtcgacgtgaagtatggagacacgaccgttgcttccccggtaatttggcgtccggtcgctgcttcttcctatgccaaggccggttcgttcaaggcctacggtgtggttgctggcgtgcccggtgaggcaagcgagcaaggcaatgtgtcgatgaacgtcactgttcaggatggctacaagcccgccgccgataccacgaagccgaccgtgaccgttgccgtcaccgccaacgcgggcaatagcgaatggctcactgccgctccgttcgccaccgtgcaggccacggacgataccacgccgattgccaagctggagatctccaccgaccaaggtaaaacctggatcaccatcgcggcgaatgccaacgcaactattgccgcgctttcccagcagggtgatgttgacgtgtgggctcgtgccaccgatcagaccggtaacgtttccgacatcgccaaggccagtggcaaggtggattccgccgcgccgaccgtgaaggtcactgtcgacagggaggagcgcacgctgaccttgaccgctgatgacggcaccggttccggtgtcgcatcaattgaataccgcattggcacagacggtcaatgggccacgtacagcaagccgattgctgcaccgagcgcgtcgcgcgccaccgtgtactaccgcgccaccgataaggccggcaacgtgtccgcttcggcgaaaaccgacattccatccgacacttccgtgccgctgaccggctacattgagggcgatgccaccgccaccgatgtggacggcaaggcatccggctgggtcaagggtgccgccgcgttgaacgacggcaagatcattcccgatatcaccattgccaacgaggatgtctggggcacttggcccaacaccggtgagatgcgcctcgactacgagtgggatcgtgaagtgactatcgactctagccgcgtgcaattcacctcggatgatggcggattgggtattccggcatcgtgggaattgcagtactgggacgccttggcgaacaacggtgccggcaacttcgtggatattcccgatgccacctacactgtgaccgccaattcaccgtctgctggctgggccaccggcgatgccaaggggtggtctgatggcacgtggaacactccggtcaagactaccaagttgcgtatggttatcacgtccggctcggcttctccggctgttgccgaatggcaggttcatgccattggcgacagtacgcttgagcccacaccgatcgacaagaccgagctcaagcaggcgctcgctgactcgcctaaggctgacgatgcctccaagtacaccgagacttcatgggcggagtacgcggcggtattggattcggcgcagcaggtgtacaaggctgaggatgccaccgaagctgcggtggcggatgccgcaacccagctgaagcgggcagcgaagaagctggtgcttgtagctacggtgcaagatcgtgccgcgctgagcgctcagctcggtgccgctgctgccgtggatcggacgaagtggaccgatgaatcactggccgtgctggattccgcaatcgctacggcgaatgcgctgattggtgacgatcgggccacgcagtctgatgtgaaggccgcgactgaggcaatcagcaatgccattgcgggtctggttgagaagagcaccacgaagcctggccagggtggcgataagcccggttccggcacggacaagcccaaccaaggcaacgattccaaccagaacaagggtgatgccgactccggcaagcacaagaagatacctgacaccggtgcagccgtgcttggtgttggcatcctcgccgtggtacttgttgttgcgggtgtaatcatcctcaagcgccgcaagtccggtacctgctagtcccactcgctcggcctagcatcaccaagcccccgcgcagaacagcgggggcttcacttttgttcaataacaagcattatgtgcgcgtatgagactacgatggtggggaatctacgaacaggggcagcaatgacggcatacatggaccataaggatctcgccaacgaagttatcgatcaggcgcgcgcacaagagattactgatggtgtgcatcgcgtgcttgaccagattgccgcagcggagtccgcagccgggcgtgctgccggttcggtgcaattgctggctgccaccaagacgcgcgatgtcggcgagattctggcggctatcgatgctggtattcgcgtgattggtgagaatcgtccacaggagattactgtcaaggctgacggtctggcaaaacgactgggggagcgtggttattcgctaggcgtgattgatgccgctgaggctgacacggccaatgccgcagctgcaacgcatattcctttccacatcatcggccaattgcaggctaacaaaatcagtaaagtgctgccggtagtggacaccatcgaatccgtggattccattgaactggcggagaagatcgctcgtcgtgccaccatgcgcggcatcacggttggcgtgctgctggaagtcaatgaatccggcgaggaatccaagtcaggttgtgcgcccagtcatgccatcgatctggcccaacgcatcggtgcgatgggcggactgcgcttgcagggattgatgactattggtgcccatgtggatgatgagcgcacgattcgtgcgggcttcgcgcatctgcgccgcactcgtgaccagattcttgcctccggtgccgaaggcacggccgactgcaccgaactgtcaatgggcatgacccacgacatgacctacgccattgaagagggctccaccatcgtgcgcgtcggcaccgccatcttcggcgaacgcgccttcatctgattggagctatacgaaaaaaacgccgcttgatcaatagccaagcggcgtttttttcgtaaggattttcggcgtatcaatcacgcatagatattgcgcggacgcatgtcctcgggcagaccgtcgagcagaatcgccacagaaccttcctcgaacacggagcgaatacccgcggccagcagcggtgcgcaagacagtacggtcatattcggcaggcgcttctcttcaggaatcggcacggtgtccataaacacgatttcatgcgcgccacagttggccagtcgctccacggccgggccggaaagcaagccatgagtggcgaccaaggtcaccgacttggcgccggattcgttcagggtgcgcacggcttcgcagatagtaccggcggtatcgaccatgtcgtcgatgaccacgcagtcgcggccgtcgacatcgccgataatgccatgtgcctcggcatggttcggacgagtaatatcacgctgcttgtggatgaacgccagcggcagattgcctagcttggcggcccactgttcggacaccttgatacggccggcatccggggacacgatggtggtgttgcccagatcaagggcggaacgcacgtaatcgagcagcaccggcatggcggttagatgatcgaccggaccatcgaagaaaccctgctcctgagcggcgtgcagatcgaccgtcataatgcggtcggcaccggcggcgtggaacagatcgaaaatcagacgggcggtgatgggctcacgaccgcggtgcttcttatcctggcgcgagtagccgaggaagggcgccaccacggtaatcgacttggcggaggcgcgcttcaaagcgtcgatcatgatgagctgttccatgatccacttgttgatatcgcccgaatgacactgcagcacgaacacgtccgcaccacgcaccggttcggtgaaacgcacgtacatctcgccattggcaaagtcataggacgtggtttcgaggatttcggttcccaagcattcggccaccttctcagctagctcggggtaggcgcggcccgtgaccaatacgagtcgtttatccggagtgccttcaagaatcgccgacatgcgttcgcatcctttgtttgagtcgctgtgtgatttacgccttaaccagtgtacaagcaccccgccgcagcgaacgccacggcggggtgcttatttcgtaagagtgttgagattgccgaaatcactcggagaactcgacactgaccttattgtctttgatggtgaagttgccgttgacctccttgccttcaagcgtgtacgtcagctgggcgctcacggtgccatcggcattattggaggtctgcgagatgcgcgcgttggtgatgcgcgtgttctcgcccgaggatgccttgctggtcagcagtgcgcgctggttcgtattcacgtgaggatcggcgatggtgttggccttgtcgtagttgccggaggagatggcggccacatagctgttcgcaacgctcttcgcgctgaacacggcggaagacagcacgccatacacgataccgaacagcacgaggaagccggccacggcaccaacgatgatgaagattttcttctgttgctcattcatggtggtggaggtcgcgccaggtgcggctaccggtgccgctccgggagtgatgggagccgcgggctgcgtgggcttggccaaaacggtgggcatcgcgaaaccggcaagaatatgggcataccctgtcccgcctcatatatagactgtccaagttgcccgaagaggcggtgccggtttggtgctgcgtcatgggctaacacgcatacacactcctgccacggaacgtccgtggccgaatagtccgaaggaggtgggtgatgtctgcgcacaagtacgaactgatgttcatcgccgatcctgagctggatgagcgcggtctgaagaagctgaccgagcagtatctggaactcgtcaccaaggaaggcggctctttcgatgagcccgattactggggccgtcgcaagctcgcctatgagattgccggtaagaccgaaggcaactacgtcgtggtgaagtacaccgccgagcccgctaccagcgatgagcttgaccgtgttctgaacctcaacgaatccgtgatccgtacgaagattcttcgtaagggctgaatcaagcgtttagtcagctgaacagctggtattcaaggtaagtaagaaggaccgttatggcaggtgaaaccgtcatcaccatcgtgggcaacctcactgcggaccccgagctgcgcactattggcagcggtgcgaccgtggcgagcttcacgattgcttccaccccgcgaacctggaatcgtcagaccaaccagttcgaggatggtcaggcgctgttcatgaggtgctccgcttggcgtgatctggccgaccactgcgcccagtccctgaagaagggcatgcgcgtgattgccaccggtcgcctccagcagcgttcctatcaggcacaggatggttcccagcgaaccgtcgtggagatgcagctcgatgagatcgggccctccctgcgctacgccaccgcacaggtgactcgccagtcgtccggtcagggcggcttccagggtcgttccggtggtttccagggtggtcagcagtccaatcagggctatggcaaccagggtggccaaggtggttatgccggtggccagggcggttacaacggtggctatcagggtggtggcgctggatactcccagcagtctgccgctcccgccaacccgtccgctcctgcggtcgacccgtggagtaatgccggtgcatctgatgccggtagcttctccacgttcggcgcttcctccgatttcggcggcgacgattccgacccggagttctgatcagtacttgcctccccgctgccagcagcaatcaatatcaagatttataaggagaacatcatgtcacgtaagaggccgcaaccgccggtcaagccgttcaagaagaagccgaacccgctgaaggccgccaaggtcaccgagatcgattacaaggacgttgcgctgctgcgtaagttcatttccgatcgcggcaagatccgttcccgtcgtatcaccggcgtgaccgtgcaggagcagcgtgagctgtccaaggcgatcaagaacgcccgcgagatggccctgctgccgtacgccacctcgggtcgctgagttagggaggctttgaacaatggctgaaaccaaggttattctcaccaagaccgtgtccaacctgggccattccggtgacgttgtcgacgtgaagtccggctacgcccgcaactacctgttcccgcagggcctcgctttcgcgtggaccaagggcgctgaggctcagatcgtcgctatgaagcgcgctcgtctggccaaggccgtcgctacccgcgaggacgccgtcgccgctaaggccgccatcgagggcactaccgtcgagatcgccgccaaggtgtccgagtccggcaagctgttcggtggtatctccaacgaggccatcgccgtcgctctgtccgacaaggctgcggtgaacccgaaggccatcgaggtcgagaccatcaagaccaccggcgatttccccgccaaggtggccctccacccggagatcaccgcttccttcttcgtgaaggtcgtggccgagtgagtcattccggcctagtgctggaatcacacagaccaagagtctgagcttaagcatcatcccccgtgcggtttgcgccgcatgggggatttttgtattagcaaaaacgccggaaataggcgcgacacgccgagagttgcattcgcttcaaatctgagtatatttatcacctgttgcaaggaatacttcaacatctaaccaagcccctgtagctcagttggttagagcagctgactcttaatcagcgtgtccagggttcgaatccctgcgggggcacagacaaccggaatcgaaagattccggttttttgttttttccagtatcagtccgtagctggtgcggaaaggccgtcttcgcgcgtgacggccggacgtgtaaggagcaacgtcatgcctcagatattcacgttcaccgtatccgaccccgaaggcatgcacgcccgcccggctggccggttggttgccaaagcgcaggaatatgaatcgagcatcaccgttgcctacggtggaaaatccgtggatgccaagcgtatcttcggtgttatgggacttgatgttcaacaaggtgacgaggttacggttcgggtgcagggcaacgatgaagctgtcgctgctgcagagttcgagcgattcctcaaggagcacctgtaatgagaacgatacagggcgtcagcgtatccgctggcattgctatcggcacggtccgcgtgctcgccgccgtagattatgccgtagaacgccgcttaatcgacgacccgcaggccgagatggatcgattccgcgcggcccgtgacacggccgtcgctcagctcaagcaactgcgtgacaacgtcgccgctgagttcggcgaaaacaaggccgaactgttcgacgcccatcggcttatgctccaggacccggactatgcggaatgcgtcgaaggtttgattgcgcaagacaaggtgaacgccgaattcgcggtgaagagcgccgccgaacagttcgccgccatgttcgctgcgatggatagctcgaccatgcaggctcgagccgctgatgtcaaggatgtttctcgccgcgtgatgaacgtgctgcaaggcaaacgcgatagcacggcgcaggatggcagtgtacaaggcgatgctgtgcagaacggtattgtgcagaacgggatcgcgcagaacggcgaaagccacatcatcttcgccgaagatcttgctcccagcgataccgcgcagctcgaccgcgctaaggttttgggcctcgtgaccgccaagggctcagcgaactcgcacaccgcgattctggcgcgcacgatgggcctgcccgccatcacaggtatcggcgacgcctttgacccggccgatgatggtcacgttgccgtaatcgacggcaccagcggtgcggtattcgtcgacccggacgaggccacgctgaccgaataccggcgcaggaaggccgaggctgaggagcacctaagcctcctgcggaagctcaagggcaagcccaccgaaaccaagtccggtcagcgggtccacctgtacgccaacatcagccgtccctctgacgcagccgccgtgctggccaacgatgctgagggcatcggcttgttccgcagtgagttcctgtatctggaacgcgaggactggccgaccgaggaatttcagttcgatgcatacggacaagtcgcacaggagatgggcgaccgtccggtcatcatccgtacgctcgacatcggcgcggacaaacaggtcgactacttcaatctgagccacgaggataatcccgcgcttggttaccgggcaatccgcatctgcctgacccgcccggagattttcaaagtccagttacgcgcattattgcgcgcctcagcatacggcaacatcgccattatgctgcccatgatcacctctgtgcaggaggtacgcgacgccaagcggattcttgaagaagccaaaagcgagctgcgcggcgagcgcatcgacttcaacgagagtatccagatcggcgttatgattgagacgcctgcgtcggtcattatggccgacgagctggccgccgaagtcgatttcttctccatcggcaccaacgacctgacccagtacacgctggcctgtgaccgtcagaacccgagtctcgaacgctttgccgacccgcattcaccagctgtgctgcgcatgatccagatgactatcgaggctgcccatcgtcatggcatctggtgcggcatctgcggcgagcttggcgcagacttgagcctgaccgatacgttcctgcgcctaggaatcgacgaactgtccgtctcgcccaccagcgtcctgcccctgcgcaacgtcattcgcaaccactgagattcaaggtcgcttcggctgattccgatggctttttgggcattgcattcggctggacattcgacatcgcatcttgccggcatttcgtcgtggggcaaagtgtacaatcaccacgtttgctttcgcgcccagcgtaaatcgcgtcgccggctccgcgaacggatttccagtcacacagaatgccgtgaacagtcagccatgcctgttgcgcggcgaagagaaaagaagaagcagtggattatcctctctttaccaagctggccgccgagttcttcggcaccgccattctgatgatcttcggcaacggctccgtggccaacgttgagctcaagaacaccaagggccaccacgccggctggctgaacatcgccatgggctacggcttcggcgtcatgttcccggtgctcatgttcggtagcgtctccggcgcgcacatcaacccggccatgaccatcgcccaggccgtcaacggcctgttcccgtggagcgacgtgctgccgtacatcgtcgcccagctgctcggcgccctgctcggccagctcatcgtctacatcacttactacccgcactacaaggagaccgaggacgccgaggcgattctgggcaccttctgcaccactgacgcggacaaccagaaggtcaactacttcctcaacgagatgttcggcaccctggtgctcgtcttcggcgccctgtgctgcctgtccctggcttggggcaagcaggattacgccgccgcctccatcgtcgtcggcttcattgtgtggggcctcgtgacctccatgggtggcccgaccggccctggcctgaacccggcccgcgacctcatgccgcgtctgctgcacgccatcctgccgatcccgcacaagggctcctcccgctggggcgaggcctggatcccggttgtggccccgattgtcggcgccattatcggcgcttggctgttcgtgttcttcttcgccagctgattcgttgattgattcatatatgcaaatggcctccgctcgttttgggcggaggccattgtcgttgaatcaggtaaacgcagagactactgctccaggaacacctgcggggccttcatgaagttcgtggcacagtgttcgccgcagaagtaataggacttgccctcatactcgcgcgtgatcgcatcggcgttcacagccacggtcatgccgcacaccgggtcggtggcggtttcgccgtccgcgggggcggtgtggtgcatgtgcattcccgtatccatagtgttctccttgttggttggattattggattggtcagatacgtgattggtttgattcagcgtggtgcgatcgtcgatgatgacggtcggctcgtgaggcgcgttggatgtggcggagccggtgatgttggcggcgttggcggattcggccgatccggctgattcgacatccgccgtgctgctgcccgaaccggcgggaccatcggcagcacccacgttgatgttcgctccatgcagccggttcgcgttcagcaccaggcacactgagctcaacgccatcgccagacccgcgatcatcgggctcaacagccagccggtgaacgggtagagtacgccggcggccaccggaatgccgatgacgttgtagccgaacgcccaccccagattctcgcggatgttgcgcatcgtggcattggacaggttgatggtcttgatgacgccgcgcaagtcgccgctcatcaaggtcacgtccgccgactgcatcgccacgtccgtgccggtgccgatggcgatgccgagatccgcctgagccagcgcgggggcgtcgttgatgccgtcgcccaccatcgcaatcagagtgcgggattgtgcggccgtgcgggaggtgccgtacgcggacttggcggcggcctcgtcgcgttcgcgctgcagtttggcgatccagtaggccttgccgtccggcttgacctcgcagatcaccgtatcgatgccgacttcgcgggcgatgcgcccggctacctcggccttgtcgcccgacagcatcaccgtgcggatgccgcgtgcgcgcaacgccgcgacggcctcacgcgagccttccttgactgtgtcctgctcgtagctcggcttgtcccagtcggcggccgcgtccaccacgccgcgcgtgatggtgccggtcttgtcgaacaccacggtgccgatgcgacgcgcctgttccagcgccttggcactggtgaccagcacgccgttggtggcgcccaagcccagcgagaccgtcaccgacagcggcgtggccagtcccagcgcgcacgggcaggcgatgatcagcacactgaccgcagtgaccagcgcgtgcgccagttgcggcgccgggcccagtgacacccagatggcgaacgtccagatggcgatgatcatcaccgccggtacgaaataccgggcgatcttatcggccagttgctgcaccggcgccttggtcgcctgggcgcgggccaccatcgccgcgatctgcgagagtaccgtgtccgcgccgacttgggtggcgcgcatcacgcagtcgcccttgagcagcacggtggccccggtcaccgggtcgcctgcggttttggagaccggcttggattcgccggtgatcatcgattcgtcgatacgcgcctcgccggccacgatcacgccgtccgtgggcacgcgctcgccgttcttgacgatcagcaggtcgccggtgacgatggcgtcgatgtcggtgtccgtgaaatgcgccggattacgccattcgatgccgtccacattgtctgcggaagtggcgttgagcttgtgcgcggtgcgcgggcgcagtctgataagcgactgcaccgccttgccggtgccttcgcgggccttggcctccagcaggcggccgaccagcaccagggtgatgaccacgccgaccgattcgaaatacggctcgcgcgagccctccgggaacacccacggggcgatgcaggtcaccagcgaatacaggtaggcggccgaagtgcccagcgagaccagcgagttcatgtcgggggagcggtgcgccagcgcggggaagccgaccgtgtggatcggacgcccgcagtagaacatcaccggcgtgatgagaatggcctgcagccacgggttcaccatccaatgcggcaccagcgcgggattggccatatgcagcatggtgacggcgaataccggcaacgtcagtaccgcgcccacaatcaccagcttcgtcagcgccttgatctcattggcgcgttcagccgcctctcgccgctcggcctccgccgcatccacaaccggagctccaacccgcaagtctgagggagagaccccctcggcttcggccgagccgtcagcacgcgggcgaagcccgtccttatccgcaccgtccttactctcctctccctcaaccctcaacaacccatgcaccatattcatgccgcatgcaaacggatattcgcccgccggcaacgccggtagttccacgtcggtggtggcgttgcccggcagcatggcgtcaagccccagatccgcgaacaccacatgcgaagtgcattcgccggtctcctgtcgatcgaaagtcagcgtgatcggcgtacccgtgcgcatgctgatcacggcgggggagtacccgcccttgacggtgattgttgcggattggcgttcgccggaggcgtccatggccccggccgtggctttctgcgttccgaagaagaaccgcagtaccagccatgtcaatgcggccgccgctatcagcgccgtggcggccgagaagatgctgagctccataaccgttccttccccttgtttgttgtactgaacaacagtgtataccctatacccctagagggtatataatggggtgtgttcagctgacggataagtatcagggggtttgcgatgcatggttatgacgaagacaaggccaaggtcatcgcacgattgcgccgtatcgaaggacaggtgcgtgccatcacgcagatggtggaggatgacaaatactgcatcgatatcctgacgcagatttcggcgtcgaattcggcgctgaaatccgtggcgttattgctgctggacgatcatctcaaccattgcgtgcggcaggcgtcgattcagggcggcgaggtggccgatgaaaaacttgcggaggcttccgcggccattgcgcgtctcgtcaaatcgtgacgagttttaccgtcattcaccatcgatgacatactgggtaccatgtttgagcaaataggaaccgtgattatcgtcatcgtcgtgctagtggttggtgcagggcttggcctcttcgccggcttcgtgctaggccgtcataagggtcaggagatggctcgaggcgtcaaaagcgaggagctggaagaggccaagacctcgctggagaatgcgcgattcgagaacgctgagctcagtgctcgcaatgctgccgcacaggctcagattgaaggcgtgaaccagcaattggctttcgccaagtcacaacttgcccaggcgcagcaggctgagcagattcgcattcagcaggaacgtgagcgtgcagctgcggaggcagaacggaagcgtcaggcggatgctcaggccgccgaggccaagcgtgctgaacaggaagcacgtttgaaagaacagagcaaggtgctcgaggcgcttgcgccagtggccaagaatcttgataccttgcagaacaaggtcacgcagatcgaagagggccgcaagagggaaatgggcgcattgggagcccaactcaaggggctcaacgatcagcaggcccgtttggacaaggaaaccagttccttgtccgccgcgttgcgcaacaacaaggtgcgtggcgcgtggggcgaggcccagctcaagaacattgtcgagtccgccggattgctggaacatgtcgatttcgacacccaggtggtggtcacggatgccgatgggcgtacgttgcgcccggatatgatcgtgcatctgccgggaggcaagaccattccgattgatgccaaagtgccttatgccgattaccagcgtgcctgcgaaatcccggacaccgccagccccgaggatattgcccgccgcgatgatttgctgcggtcccatgccaaggcgttgcgcgagcatgtacgtgctctcggcgaaaaggcctattggaatgcctttgatgtagcacctgattttgtggtggccttcatccccaatgaggcactactgcaggccgcgctcgaagccgatcccacactgatggatgatgcgttctctcgcaaagtggcgctcacctcgccggtcacgctctgggccgtgctgaaatccgtggcctatgcctggcagcagcagtcgctcaccgatgacgccaagcagctgttcgatttgtcccgagaactgtacgaacggttctccacgctgggtgattatgccatcaaattgggcacccagattactaagacggtcagcgcctacaacaagttcgcgtccagtttggaacgccgtgtgttgcccaccgctcgcaagctgcaaaaaatcgaaccgaccaagatcatcgaggaagtaccgatcatcgaatcagataaaggcaatgtgagcgaactgtccgcccctgaagtggtgccggccgatgaaggtgatactcatctgactgcctcaggcgatagtctggagtcatgactgaatctggattccgccccactggtaccccggaccttgccgtcgcgaagagccataatgactttgccatgctggagccgcgtgaacagctagccaccttgctgaaggagcatgtggtgggccgtccgttctccgaacttgccgcggtgactttcgaccaccgtgccgccactgtcatgggccatgtactgattgacgctttggaagatgcgggctattcgattgatgacttcgatgctgttggtgccttgaccgcagcatctgtgcccatggtgtctgccatgatccaggccgccgcctctcgtggcgaggacctagatggattcgtgatggacttcgtctacccgtccatcaagggcccctccatcgaaggccgccgtgtggtgctgttggatgcttggctgtccgaaaagtcgtacgtgcagacaagctcgctggtcaccctgcgcaacggcaatgagctgagcctcgactttggcatagtggagcagctgggtgccaaggtcgtggccatcgcctcgctggtcggtggcggtgccaaagacatcaatgtggtcaacccctccaccggcgacgagcaaacgctccccttcatccaggtcttcgacgaatccgaactgcggtaaatccacctttgacgtccctcgcataaagtcagccgggctgagcagcgaagctgactaagaggaaccggtgaatagcgttatcgaggagaaagattgcacgcacccaaccagatttctttggctgccaaggcttcaggtgaaccggaattccgtgaaatcggccttgggccgtggtctgagacccatcccggtgagcctcgtcccgatgatccgacttcttcgaattatgacggtcgtttcgactcggtgctgttgaacgacggagaccgccgcaacgtattggaccgttaccgctactggaccgttgctgccattaaggccgatcttgacgctcgagggcgtcacgacttcgaagttgcggtggaaaactggacccacgattttaacatcggttccatggtccgcaccgctaatgccttccaggccaagcgcgtacacattgtcggtccacataagtggaatcgcaagggcgcgttgatgaccgaactgtaccagcacgtcgaacaccacccctccatcgccgaactggtggaaagctggcatcatcgcatcgccggtgaaatcgcctatgaacgagccaaggccggtgccgccgccatccatgcgcatgatgtggctgtggatggagacaacaagcaccttcatgagctgctggccgaaatcgatgcttgtgatgcacgcatcaaggagcttcaagccgcccgcgtcatcgccctcgacattattcccggcgcagtgccgatggaagcctatgccttccccaagcggtgcctgctgctcttcggtgcagaaggccccggattgagcgagaaggccctcgcattggccgacgatgtggtctacatctctcaattcggttccgtgcgctccattaatgcaggcgctgcggcggccgtggccatgcacgcatggattgcccaacacgccgtatcaggcgtgtagccatgcgccgacaatcctgccgcatggatcggcggtctcatcgtcaccagaaaagcggatatcaaataatgacccgagtgcctgccctgctgaaatggtctcaaagggtaggaaaatgcggtttcccgacaactgcgtgtcacatacggctcatatagttatggccatgccaacattttcacgcgaagaaatcgtgcatttgggcgatctggcccgaatcgcgctcaccgatgaggaaatcacccgtctgcagggcgaactgaacgtcatcgcagactccatcaacaaggtccaggaagtcgcctccgacgatgtgccgccgaccgccaacccggttccgctggaagcctacctgcgcccggacgtcgccgaaaccccgctcacgcaggaagaggcgctcgccggtggcccgaagaccgaggccggcatgttcgtggcaccgcgaatcctgggaagcgaggagtaatcgatgagcaacgaaaccgcaactctcgtcaaactgtctgctgccgagcaggccgctgccgtcaagaagggcgacgtcacctctcgcgagctcgtcgaagcccacctcaaggtgatcgaggctgccgagccgtccatcaaggccttcctgaaggtttccggcgatgtggctctcgagcaggccgacgccttcgacgccaagtccgccgaagacaaggccgccctgcctgagctggctggtgtgccgatcgccatcaaggacatgatcgtcaccaagggcatcgaaaccaccgccgcctccaagatcctcgaaggctgggtgccgccgtacgacgccaccgtcatcgaaaagctcaaggccgccggcatgccgattctcggcaagaccaacctcgacgaattcgcccagggctcctccaccgagcactccgcctaccagaccacccacaacccgtgggataccgagcgcgtgcccggcggttccggtggtggctccgcctccgcagtcgccgcattcgaggcaccgatcgccctcggcaccgacactggtggctcgattcgccagcccggcgccctgaccggcaccgtgggcgtcaaacccacctacggcggcgtctcccgtttcggagccatcgccatggcctcctcgctcgaccagatcggcccggtctcccgcaccgtgctcgactccgcactgctgcaggagatcatcggtggccacgacaagcgtgactccacctccatccccgaaggcccgcgcccgatggtcgccgccgcccgcgaaggcgccaagcgcgatctgaagggtatgaaggtcggcctcatcaaggaactcggcggcgacggcttccagcccggcgtcgaggcccgcttcaacgaggccgtcgacaagctcaaggagatgggtgccgaggtcgttgaggtctcggtcccgcacatcggctactcgctaggcgcttactacatcatcatgccgtccgaggtcagctccaacctggcccgttacgatggcatgcgctacggcctgcgcgtgatgccgccgaccggcgtgccgcagaccgccgccaacatgatggcctacacccgtgaagccggcttcggcgacgaggtcaagcgccgtatcatcctcggcacctacgccctgtccgccggctactacgacgcctggtacggctcggcccagaaggtccgcacgctgattatcgaagacttcaagaaggccttcgaacaggtcgacgtgctcgtggcccccaccagcccgtccaccgccttcaagttcggcgagaagatggacgacccgctggccatgtacatgaacgacatcgccaccattccggccaacctcgccggcgtgcctgccatgtccatcccggccggcctgtccgacgacggcctgcccgtcggcttccagttcatcgccccgcagcagcgcgacgaagtcatgtacaagccggccgcggccctcgaagccgcgctggaagacagctggaacggcccgatctggaacgacctcaagaccccgtggcttgacggtctgggcaagtgagcatcggaaggaaagaaacaacatcatggctgaaaaactgatgaagtacgccgatgccaccaagaagtacgatgtggtcttcggtctggaaacccacgtggagctgtccacgaacaccaagctgttctgcccggcccacatcgagttcggtggcgagccgaacaccgagctgaccccggtgagccttggcctgccgggctctctgccggtgatcaacaagaccgccgtcgattacgccatcaagctgggtctggccctgcactgcgaaatcgccgagtggagccagttcgcccgtaagaactacttctacccggacatgccgcgcgactaccagatctcgcagtacgacaagcccaccaacggcaacggctacctggacgtcgagctggaagacggcaccgtgttccgcgtgccgatcgagcgcgcgcacatcgaggacgacgccggcaagaacacccacgtgggtggcgccgacggccgtatcgaaggtgccgaccactcgctggtcgactacaaccgtgccggtgtgccgctgattgagatcgtcaccaagccgatcgagggggcgggcgaccgcgctcccgaaatcgccggtgcctatgtgcgcgccatccgcgacatcgtgcgcgcgttgaacatctcccacgctcgtatggagcagggcaacatgcgcgctgacgtgaacgtctcgttgcgcccgagcccggacgctccgtacggcacccgttccgagaccaagaatgtgaactcgttccgcggcatcgagaagaccatccagtacgagattcgccgtcaggccgctcgtctggacgacggcaaggagattctgcaggagacccgccactgggatgaggctacgcagaccaccgctggcggccgtctgaagtccgatgccgacgactaccgctacttcccggaccccgacctcgtcatgctccacatcaccaaggagcacatcgaggagatgaaggcccagatgccggaaatgccgcgcgagcgccgcaaccgcctcaagtccgagtggggcctgagtgatctgcagatgcgcgacatcctcaacgccgacgccctcgacctgattgaggaaaccgtcaaggccggtgccaaggctgccggtgcccgcaagtggtggctgggcgagctttcccgcgaagccaacgccaagggtgtgtccctcgaagagctgccgatcaccccggccgatgtggccgaggtcgagaagctcatcgcctccggcaagctcaacgacaagctcgccaagcagaccgtcgaaggcgtgcttaagggcgaaggcactccggatgaagtcgtcaagaagcacgactacaagatcgtcgaagacaacggtgccatcgaggcggccgtcgacgcggcgttcgaagccaacccggacgttgtcgagaagctcaagagcggcaacatgaagccgatgggtgtaatcatcggtgccgtgatgaaggccacgcgcggtcaggccgacgccaaggccgtcaccaaggtcgtcatgggcaagatcaagggctgattagattcactggctcccgctggtgggagctgtcgaacggagtgagactgagggtggtcgccatgtacggatgaccaccctcagtccgcttcgcggacagctcccgccagcgggagcacttatttgtagggaaattctccagttcaaatccgttagacagctcccgccagcgggagcctttattgattctgtaagaaagtcgactcagagcatttccagcgttcacccagtcgagtaagatatgttcggcactggaccgtgagccgaaacaagccgaaccgggggacgtataccgatgaccgcaaccaacgagacgctgagcatggctaccgaagcgcaactgaagcgcgatctgccacagagcatcgtcattccgccaatccgtggcgaaatggtgcacctgcgccccgccaccgtcgaggacctgcctcgtttggatgaacttgatgccttctatggcgcatccaagatcacaggtaaggatgcggtcaccgaacgcgccatcgtacacacgtgggtccgccgctcccaggcttgggaagccggtcaggcacccgccgaatccggtgtgggtgatccggaatcccgccgcaccatcgcatgggccgtattgactgacgccgaccatgacgatgacggtcagctcgatgcggccagcaccgataatgtcatcggcatgattttccttatcgacatcgacggctggtccaagtccgcccgcatccagatcatcttgggccgtgaataccgtggccgcggctactcccgtgacgccatgccgcgtgtgatgacctacggtttcgcgcccgaaccggccggcttgggcatgcaccgcatctgggtgagcgtgccggaaaagaacagccgctcgatttcggtctaccagtcgctcggcttcgtgccgtccggcacctcgcgcgacgcgttgtgggatgccgaaaacaacaaataccaggaccttatcgtcatggacacgttggctgacgagtacgatccgattcgttcgcttgacgcttttggcatgcacttgattgaggacaacccgggtgtcaaggaagcgctgtccgcgcgcgagcattccatcgccatccagcagaacaagccggaacccgagccggcacagcgtggtgaggcagccggcgccacgacgagtgacgtgcagtcccaggcccagacgccggcggccgcacagccagtcgagccacaggccgagcaccacgacgatacgcagaagaacacgcgccacagtctcgaagaggaaagcaactggccgtacggtcaggcagaacgcaagccctcaaaggaagcatggtggcgtacgctgggccgcggccgcaaacgcgatacggaaagtgagtgagtaaacaagcatgagtgccgaggatctcgacaattacgaaaccgacgccgaactcgcgctgtatagggaataccgtgacgtcatcaagctgttcacctatgtggtggagactgagcgtcgcttctacttggcgaataaggtcgatttcaacgtgcgttccgctggtcaggacgtgtatttcgatgtgcagctgactgacgcatgggtatgggatgtctaccgttccagccgtttcgtcaagtccgtgcgcatcgtgaccttcaaggacgtgaacgtcgaagaagtccagaaaaccgatatcgacattcccgacgatattcactgacaggcaatcgtctgatacagcctgtattgacaatgcgcggcattccgtcatcttacggcggggcgtcgcgcattgttcatacaacgcatagcaaaagttcagactcgtaaccttgccatcgtgtgtcttgtttgcttgcggctgatagaaaatgctgcatgaacacacaccatatgcagcagggccttaagggctccatcgcgggcgtggttgctgccgccacattgctggccggtggcatcctgaccgttccgcacgccatggctttggaggccgatggccagtattacagcagcaagcagccatatgtggcacctagcgaagcgaccactgccagctatagccaggcgccggaaggctacgaaacggtatacaccgagtcgatggctcgccacggttcacgcggcctgtccagctacaaatacgacgcattgcttatgaagatggccgaagccgccgaagcggataacggttttaagtctgatgccatcaagtccgaattcatgaagaatctcaaagccatcaccgccgcaaatgtggagaatggctacggtatgctcaccggtcagggtgctgaccaacatcagggcattggcgcacgtgcctacgagcgcaacaagacgctgttcgacaacgcagccaaggacggtggcaagattgcctatcagtcctctggcgaagcccgcgctactgaatcaggcgagaattttgctcgcggtttcaacgcggcctcgaacaataaactggcgaacagcactgtgacgcccgccgatccggccggcaccggcgaggcggcggctttcgacaagacgccgaacacgctgtacttccacaagtccgaaaacccggacggcactgagaaaaccggtgaggccaagcagcgtgccgacgattaccagaacttcgtggaaaacgatgcgattatcgcaggcgctgagcaaaccatcgccgaaaacgaggacgtgaaaacagcctctcacgatttgctttcacaaatcttcaccgatgacttcctcgccaaactggccgacggcacgtacgcctggtacaacactgtcgatggcaccaagggcggcgaggccaactgcgcgccgggagccgaccccagcaaggatgccgacgcctgcggcgcagccaagaagaagatcgcctccgaatacgatgccgcgatggatctgtacaacctgtacatcatcgccgctgatatggagaacgagaacaccggcagccataccttcgacttcaaccagtacttccaaggtgagcaggcagacgacgccaagttgttcgcctgggcgcttgacgccgaggacttctacgagaagggcccgagctacgccggccaagacgagacctacacaatcgcacagccgctgcttgacgatttcttctcgtcgattgatgagcgcgtaaacggcggatccaccgttgctactttccgctttgcccatgccgaaacgatgatgccgttcgccgcgctgcttggccttcccggttccacccagcaggcggccgccagcaccaccgacgtgtacacctacgccaacaatgaatggcgcggtgaatcggtgactccgatggccgctaatgtgcagtgggatgttgccgtcaaatccggcaacgacccgaagaccggccgtgcctacacgccgctcgttcgtatgctctacaacgagcaggaaatcgccttccgctccgaatgcacgccgattgccgatggttccacgtggtacaagctcactgagcttaaaagttgcttggcctccgaccaccaaaccctaggcgacgatgcgcatctgactgatgattccacaacgcagccgggcacaggacctaacactggtgaaggaacgagtaccactccgaataacaatggtgcgggaactcatcagcccagcaacactcaggctaatggtacggaaaacgagttgagtcgtactggtgttgccgttactggtgttgcggggatcatgatgctgcttgcacttgcaggcatctcgctgaatctatggaaagttcgtcgctgacgaattagcctaagaccaaaccgattcgccgcgctgtgtgtgacgcaacgttgccgaatacccctacctcacgattcgatgcgtcgcctttctgctgatggaaagacggcgcatcggtcgtatatcgggagaattctgtaagcattcgctcatctttcggtgtgcgattccggggcttctagtagactgtctctgattttgcgtttataaggagcataatgaccgacaagcaatccgtagtgattatcggcggcggtccggctggacttaccgccgcatgggaactcatcaaggacggcggtgccgacaagtacgacgtgaccgtgctggaggggacccgcgaattcggcggtatctcgcgcaccgtgaagcacaacggcaaccgcatggatatcggcggccaccgtttcttctccaaagacgaacgcatcatggattggtggaagaccgttctgccgttgcagggcgcaccctcctatgatgacaagaagctcggccgcgaccacgacatggagccgggcggccccgatccggagacggaggacaaggtgatgctcaagcgccaccgagtgtcccgtatcttctggaaccgccacttcttcgattacccgatttcgctgagccccaacacgttgaaggccatgggcttcaagctcaccatggtggccggcttcagctacctgaagtccatgttccacaagctgccggaagacaatctggagaacttctacatcaaccgtttcggccgcaagctgtattcgatgttcttcgagggctacacggagaagctgtggggccgccacccctcccagatctccgccgactggggcgcccagcgcgtcaagggcctgtccatcatgggcgtgctcaagaacgccttccagaagctgctgcccaagaagcgctccaacgcggaggtcgagacctcgctgatcgaggagttctggtatccgaagtacggtcccggccagctgtgggagaccgtcgagtccaattgcgaggccgccggcgtcaaggtgctgaccgacgccagggtggtcgaggtccgccagaccgatggtgccgtgtcttccgtggtgtacgaggattccgagggcaaccgcaccgagctttccggcgaccagttcatctcctcgatgccggtcaaggacctggtcaacgccatcgacgcggccggcgccgatcccgaggccgttgattccaagcccgccccggccgatatgaccgaggtggccaacggcctgccgtaccgcgatttcgtgaccgtgggcctgctggtcaagcacctgaagctcaagaacaccaccagcatccccaccctcggcgatccgccgatcgtgccggactgctggatctacgtgcaggacccgggctacaaggtcggccgtctgcagatcttcaacaactggagcccgtacctggtcaaggacgtggacgacaccgtgtggatcggtctcgagtacttctgcgaggagggcgactcgttctggaacatgagcgaggaggatgtcaccaagttcgcgatttccgagctcacccgcatgcgtgtgatcaacggtccggacgaggtcatcgactcccatcgtgagcgcgtcaggaaggcgtaccccgcctacttcgacacctatgagcacatggacgagctcatcgagtacctcgacggcttcggcaacctgtactgcgtgggccgtaacggccagcaccgctacaacaacatggaccactccatggccaccgccatggaggccgtcggcaacatcaagaccggcaagacgtccaagaagaacgtgtggtccgtcaacaccgaaaagtcctaccacgaagaaaagtgaataaaccttgttgagctccctcgtcacagagggagcttttttggttttcggcgggccgttttgcgttggtcgagttggcgttgtacagtgaacgaagttcgcagagactcagagacgcagcgaacattcatgagcggtgcaaccgcaataatcactcttaacgcctggataggcatgggtctgttcggtatggaaagggcaaccagtggcaaatagccagaatcttgaggatatgaagctgcctgagctcaaagagctcgctaaacagatgggcctgcgcggcacgtcgaccatgcgcaagcccgagctgctcgccaccctgcaggcggcgcgcaatggtggagagccgccggccggtgtgaccgtgcgcgcccccaaggccgccaaaaccgccaaggtcgtcaaggctccgcagtccgatgccgctgaggccaacaccacagacaatgctgacgtggccacccagtcgccggctccggctccggctgccacggaaccgcagctcgatttgccgcttcccgtggccgacgatgccaagaaggacgagaccgaaccgcgacgcacccgtcgtaaggccgccgatgatgccgcatccgaaccgcgtgcggcccgccgtcgtcgcgatgacgaccagcccgatttcgctcgccgcaagccgcgcaagaaggccgatgaggccggcgatctgctggccacgctcgatttgggagatgcagcgcctaccgagcgtcgccgcgagcgtcacgaggacgtggaagttccgctgattcgccgagtccgtgatgatgaggacgagcagcctcaccgccgtcgtcgcactgcggaaaacagcgaagaaaccgtgcgtgacctcgacgatatcctggccacgctgcccacgcagaagcacgaggaaacgtccgaagacggcgagcagaacgacgatcacgagttcgtgcgtcgtaaccgccgcgaccgtagcgatcgcaacgatcgcgatacccgtaatgatcgcagcgatcgccgtaaccgtcgcatgcgtggccgtgatcgcgacaacgccgatgatgatcgtcgctatgatgatcgcgataatcgtagcgatcgcaatgaccgtgatagccgccgcgaagagccgcaggaggatctggtgccggtggccggcatcgtcgacgtgctcgactcctacgcttttgtgcgcacttccggctacctgcccggcccgaacgacgtgtacgtttccatgggccaggtcaagaagtacggcctgcgcaagggcgatgccgtgcatggttcgattcgcgccccgcgtgaaggcgaccgccgcaaccagcgccagaagttcgtgccgctgcaggccatcgattccatcaacggccaaagcgttgaagaagcgctcaaccgtccgcagttctccaagctcacgccgctgtacccgcaggagcgtttgaagcaggagaccgccccgaacaagctcaccggccgtatcatggacatcgtttccccaatcggcaagggccagcgtggcctgattgtctccccgccgaaggccggtaagaccatcaccctgcagaacatcgccaactccatcgccgccaacaaccccgaggtccaccttatggtggtgctcgtggacgagcgacccgaagaggtcaccgatatggagcgcacggtccagggcgaggtcatttcctccaccttcgaccgtccggcctccgatcacactacggttgccgaactggccgtcgaacgcgccaagcgtcttgtggagctcggccaggacgtggtcgtactgctcgattccatgacccgactggctcgcgcttacaacatcgcagcccctgcctccggccgcatcctgtccggtggtgtggacgcgcaggccctctacccgccgaagaagttcttcggtgcggcccgcaacatcgaaaacggcggctccctgaccatcatctcatctgcgctggtggaaaccggctccaagatggacgaggtgattttcgaggagttcaagggcaccggcaacatggaactgcgcctgtcccgcgagctggcggacaagcgactgttcccggccatcgacatcaacgcttccggcacccgccgcgaggagctcatcaccaacccgcaggaactgccgattatctaccgtctgcgtcgactgctgggcggcatggagcccgagcaggcctaccagacgctggtgccgcgcctcaagaagaccgccaccaaccgcgacttcctcgccgccatcgtgcagcaggccaacaccggcaacgcggtcaacggcaactgatcagaccgctgaacaatagtgtaagggctgcaccctgattgatacggggtgcagcccttgtcgtatctgatgcaaatacatcaactatcacattgcagttgtagtattgccgtcaacgttcacatgcacgctgacgatatatgagatgaaagaggcatcactgggttcgattgttttgggagtgggcagtggtgcggccatgttcggcgatgcggatgccagccatatcctcaccggcgactatgacatctgagatatctgactttgcgcatcgtgcaaagccgtaatcgggagtatcctcgaatctatgagcgaaacgagcagcgactggcaaaggaccaccatcgactccgcccaggcggcggcccacccggaaaccgcacaagcggtggcgcgcatcaaagcgctgcgccaaaccatcgataacatcgattcggcggtcatcgcattactggccgagcggttcaaggccacctcgcaggtcggcgtgctcaaagccaacgccggattcgcgcccgaagacaccaagcgtgaggactatcagatcgaacgcctccaccgcatcgccatcgatgccgggcttgatccggaaattgccgaaatgtaccgtgaattcgtggttaccgaagccaagaagcgccaccagcgcatagccgatgccggtggtgacccgggcgtactcgacgtattcgcctgattcgcccgcagcgaatgggcacctttcggatattcgtctatagggcaagttgcctgcagcgactacattaatacgggaatggaatgcccgtagtggtcgactgtatgaatgggatacgtagatgagatgtggtgccgcactggtcagttgcgcattgtgcgtggcttcgattctcggcggtgcttggatgtctcgtccgactccggttgattacggtccggtgctcgctacggcaagtgatatgtacgccgtcaccgatgccgaaggggagccggtccgttggtatgtggtagggaagggcggcgccggcaatggcgccagtgccgattccggcaatagcggttccactgataccgattccgccaatagtaattccggcacgtccaaggtttctcgtatccccgcttccgccgccaccctgccatggaaagtcagcgtcacctactcgcttgacggtccgaacgtcgaggcaaacgaggttgccggcgcgtctggactgatcggcgtgtatatcgatattaagccgcaaaccaaggaagccaaccgtacgatcccggttgtcgcctttaccgtgcctacgcaggtagccgatgatgtttccgctgacaactccattacggtgaccacgcaaggttccaataccgtagtcgccgcagctggaaaagccgcaaccggcttggaattcagctgctatatgaacgccaaagacttctccatgagttccgtggcgctcgccgtattgccttccaattccagcagtccggcagttggtgctaatcccgatgccgcgaatgctgcgaatgctgccgcacagcctgctgccgatacggatgtcgcccaactcaccgcctctgccgccacactggtcgattcactgaccgacgccggttctggtgaacagcaacagctcatcgagcagcttcaaaccctgcgcgataacgaacgtgcgctgaacaagtctgtagtggccgaacgcgaaaccgcccataagcggacgtttgaagactatatggccgcgtatgtgggctcatataccacgcacctgtctggatcgattggcacctccacccagttgccggcgttgatgggcacggccggcgaactgtccggggacacgcctttggctcaagccgtactcgacttggccaacgcggtgaacaacgtcagtgccgcacatcagcatgccggtgcggtcgatgcgttggacgaggtgattcgccgcatccagcagcaaggcaccaccggactggtggatgatctgatcgccgaggcttcggaggaagccactcaaggctccaagcaatacgccgatggccagagccagctctccgccgcaatgattccgtattcgatgaaatacacggacgtttacacggccaatttgagcgccctgaccggcggcacgtcctcgggcgccaccgcttacgagagccaagccatcgccgaaaccaacggtagcgatgaactcgccgacgctcaatccaaggtcgatgccgcgatgagcacgcttgccaccgcctccgagcatacgggcaaagccacggccttgcgccagattgtattgcgattctccgatcagttcgaaggcggcgcgtcctcggcttccggcagtgatggtgatggttcgtccggtgatgtctcttccgatccggtgaccgaggctcaggcactgaccggcctggtcgattcgcaatcgcaatcgttctacggcaagacccgggtcgcccaagccaagcgtaaggccgatgccgcccgtaagcaggccaaagccgcgcaacagcagcagtcgcagcattccaaggcctcactggtcgatgacaccatgtccatgtctgctggcgatgtgatgaactatgcgggtggtcttacttcggccatcggtggtggtgataagtccgactcgtctaagagcgctggttcgggaacgaacgactcagccaagtcgagcgacactggcgattccggcaacggcaaggcctccaacgccagcgattccggcaacaatcttgacaccgctccagtactgttcggctttggcactggcggcacgctgttcaagcacgatatgaacgcgctgattaatgagaccgtgaaaatcagtgatgctggcacgctcttggcgcaggccgtcgcgcagctcgacagccccaatacgcaacaaaaaaccgccgaaacccgatatctcatcgtgattccgacggtgtgatggtgtatgcgggatatttgcgtgccgtcccacagtcgtgtcatccgaacgtcaaaaaacaaaagaggggaacctcaataggttcccctcttttgttgttgtgcgtaacgttcagtgctttggcttcttagctggccgagccgttaagcgggaagcccggtgggcttcccgtaggctcggaacgagcggcattgccgtgagacctactgttgttgtgcgtaacgttcagtgctttggcttcttagctggcggctcaccgagctcgctggcttcgacggcgacctcggtttcgggcgtgccttcggcggcggattcctcggcgtgcttggccaccaagtcgaacttgccgaccacgcgaccggcctgcgcgatatcgcccaaggcggcgtgaatcgcttccacaccttccgaagcagcggacagtgccacagacaggattggggtcttcatggagaccttggcctcggacttgatcttacgcagctgctccacggccttgccggcccaagtcagcagctcgggggaagcaccggtggcggcctcgacatacgggtccacgaccggccaggcggcgcgatgcacggaaccggaaccggcgtgcatccagctccacacttcctcggtggcgtacggcaggtacggggccagcagacgtgcgaaggcgtccaggcccagacccagagcggtgcgggcggacttcacagccttctcggacggcacattgccgtgctcgtccggagtgccataggcgcggttcttgaccagctcgatgtagtcgtcgcagaactgccagaagtaggactcgatgacttccagcgccttggaatgctcgtaggattccagcgcctcggtggcctgacgcaccaccaaagccagcttggccatagcggcgcgatccagcggttcggtcacatcggccgggttccacgcggcctcggcggcagcgcccacgtgatggttctcgtcctcacggccgatggccagcgcgaacttggtggcgttcagcagcttgatggccagtcgacggccaatcttcatctggccgatgtcgtacgtggcatcgaggcctaggcgagcggcggcggcccagtaacgcacggcgtccgcgccgaacttctcgatcggctcgttcggcaccacgacgttgcccttggacttcgacatcttcttgtggtcggggtccagaatccagccggacagcgtggcatgggcccacggcaggcacttgttctccaagtgcgcgcggtccacagtcgagaacagccaggtgcggatgatgtcctgaccctgcgggcgcaggtccatcgggaaggtggaagcgaacagggccttggaggcctcgtccggctcggcccagtgggtcacgatctgcggggtcagcgaagaggtggcccaggtgtccatgatgtccttttcggcggtgaaaccaccgggcacatcacgctgggactcgtcgtagccctccggcacgtcgatggtcgggtcgatcggcagacgatcctcggacggagtgatcgggtgatcgtaatccggctcgccggaagcgttcaccgggtaccacagcgggaacgggacgccgaagaagcgctgacgggagatcagccagtcgccgttcaggccgtgcacccagttctcataacgcacgcgcatgaagtcggggtggaactcgagttccttgccacgctcgataagctcggcgttcagcttggcgtcggtaccgccgttcttcaaataccactggcgggaggtgacgatctcgagcggcttgtcgcccttctcgtagaagttcgtcatacgcttggtcggggtcggctcgccgtccagatcgccggactcgcgcagcttgtcgacgatgatcttgcgggcggagaacgtggtcttgccagcggtttcggcaaagacctcgcggccggccgggtcctcgatccagtccggggtatccatcacgatacggccgttgcgctggatgatcgggcgggtgggcagcttcaggtcgcgccaccactcgacgtcggttacatcaccgaacgtacagcacatggcgataccggcacccttgtccatttcggcggccgggtgcgccagaatcggcaccttgaccttgaacagaggggagtagacgtactggccgaagtactgcttgtagcgttcgtcgttcgggttggcgatcagcgaggtgcaggccgccagcagttcggggcgggtggtctcgatgtagatcggggtgccgtcctcaaagcggaaggccaccttgtggtagaagccggggtattcgcgcgattcgagctcggcctgggccacggcggtctggaaggtcacatcccacaggccgggggcgtcctgctggtaggcctcgccacgggcgaggttgcgcaggaaggccttctgggccacacgctgcgggtgctgaccgatggtgtggtaggtctgcgaccagtcgatggacagacccagcttgcgccacagggcctcaaacagcttctcatcctgagcagtcagacgctcgcacagctcgatgaagttcttgcgggaaatcggcacctgatccttggcgtcaatcttcttgccatcagtgccttcaaacggcggcttgaagtccgggtcgtaaggcagagacacgtccacgcgcacgccatagtagttctgcacgcggcgctcggtaggcaggccgttgtcatcccaacccatcgggtagaacacgtcgtagccgcgcatgcgcttgtagcgcgcaatcacatcggtgtgcgtgtaagagaacacgtgacccacgtgcagcgaaccggagacggtgggcggcggggtgtcgatggagtagacggccttgcggtcgcgggtgttgcggaatttgtaggtgccgtcttcatcccagacggtgcgccacttgtcctcaagtccgtccacgccgaccttgtcgggcagcggggtgaggttggcgttgatgatggatttgccttcagtcataaggccaaagtttatgcacgttgcatgacaagccgaactgtacagtaaacagcccagtaggctgttcgcaggcgaggtacgaacgatcgaacgatagtgagccaaggactatcgggcgtagcccgtccgtgactgaaggttgcctacttcaccgtcaacccggccagcggcatgcggcgattgatcatcgaggtcgggtagccggagaccttggtggacgccacagtgaagcatttgcgggtatacagccaatcactggccgcatcctcgctgatcagccgggcgtacgccttcattcgtgcctcataatcggcgtcattagtggcggcgcgagcatccgcataggcctgttgcgcttcggtatggtcgtaatggaacatggaatcggggtcggcgaatatgccggcatcatccgtgccgtccatgctcatcacggtcagttcccatttgccgtccttgattcgtttggcataatcctcatcggagagcacttcaaggttcaccgtggggcgcggctgccgctcgatctgctgcttgatggtttcggccaacgaccggtattcttcgggaaccaccagattcaccgtagtcaggtattgcgcaccaaagtaggagaacatctgcccagcttggttttcgtcatgcgggtacagtccggtcaaatcttcgtatccgggttccagcaggctgatggggccgcccaatgctccggctgcgtcgggttgggcggaggcgatgccggctgcgtcgatttgatagcggaaggctttacgcgcctgttcgtcggagagcagcgaatcggtgccgttgttgtaggccagcagcaccttatccgtagtggccccctccttgacggtcaggccatccttgccgttcaagccggtggccgtcgaagccgaaaccggtgccgccatatcgagactgccgtcggtcagggccttgctgagcgcatcggcgtcggagtattgcataaattcaacgacattgctggccgctttggtgccatggtaggtatcgctgcgcgccagcttcagggaatggccaggctggaaatcggccacggtgaatggtccggaacctatggccttgcgttgataatcggcactggacgactcggaatcgtagacaatgccgagtctgccggacagcgctcgcagcagcgtcggattgggcttggcaagcgtaatgaccaccgtggtggcgttcggattggcgaccgacgccagatcgcccaattcgtcgacgtccgccaccttgttggtcacgttctgttgcaacgaccacacggcgtccgaggcgtccaacgtatggccgttcgagaaggtgacgcccgattgcagtgtcagggtgacggtcagtccgtcatcggaagtcttccagcttgtcgccagtcccggctgaagcttgttgtcttgatcgacggtcactaatgtctcatacacattgtcgacgagcaggcgttcggctgccgcagaggaatcggaccgaatatccaaggattgcggcatatcgtcgatgccaatggtcacatcggcatcgagggatgatcccggctggaaccggttttgcatgaacgtccatcccacaaccacgagtgcgccgagtgccacggcgactccgagaaaaatcccccacttggaccatgtattgtcccgcttgctgtgctgcatggttttcagtctagcggtggattcagcctagaatccgcaattcaccatgatgaggtatgagttagcgcttggacgtgctcttgccggcgggcggcgcatagctagggcaggtgtcggacagcgggcagttggcgcagtcaggggtacgtgcgtggcaggtggcccggccgaacagaatcagtcggtggctgagattcgtccactcttcgggcggaaaacaggaggtgatttccttctcgattttcacgggatcggggtgtgcggaccgccaatccgaccgccaacgcagtcgtccggttacgcgcatcacatgcgtatcgaccgggaatccggggatatcgaacgcgttgccgagcacgacgttcgcggttttgcggccgacccccggcaagctggtcagttcatccatcgtgcgcggcaccacgccgccgaatcgttcgtccagtgccgtggccagtccgatgagatgctgggttttcgaacgatagaaccccagcggatgaatgatgtcttcgacttgggccgggtttgcggccgccaagtcacgggcggtggggtaggtggcgaacagttccggggtgaccgtgttgacacgcttgtcggtggtctgggcgctgagcacggtggcgatcagcaattcgagcggattcgagaaatgcagtgcgcaagcgggtgccggaatcacctggcgcagaatgtcgtattcgtcatgcatgcgcgtgagacgcgcggatttggtttctctcatcgtatggacctaagcggcgtaatatcgatgattgatagtttgcagcgccgctggtctgtcaggcgacggtgttgagatcgggagtatcgtcatcggtgtcgatggcggcagaggatgctttggcggcctgctgtgcggcggcagtttccttatccgtctccggcgggtcgaatcggtagcccacgttgcgcacggtgccgatgaggtgttcgtattcgccgccgagcttggcgcgcagacgacggatatgcacgtcgaccgtacgagtgccaccgtagtagtcgtagccccatacttcctgcagcaactgggcgcgcgtgaacacgcggccggggtgctggaccaagtacttgaggagttcgaactccttgtatgccagatcgatggggcgtccatgcagggaggcggtatagccgttggtgtccacaatgaggtcgccggagcgaatctggccatcttccaccgtggtggtggattcggcgggagaaccggctgctgcggctgcgggagcgttgccgcgctcggagaccaatcgcaatcggccctcgacttcggccggggaagcggtggcgaccaccacatccgcaatgccccactgggagttgaccacggtgaagccgccttcggtcagcaccagcacgattggcgtggacaggccggaagcgtggatgaggcggcacaaggttttggcggtcgccagatcatcgcgtgcatccagaaacagaatggtgttctccggcatcttcaccaagctggctgcatccatcggcagtacgcggacgcgatgagaaagcagggcgagtgatggcaaaacggtggcggggtcgctggcgaaagtcatcaacgtaagatccgtcacgctaatcccccttatcctgcaatgtgttacgcaattgctcggtgtggctgtacgagtcgtcagcggcgttatgccgctttcgcacggttttcattattctacgcgcttgtagtggacacataggttacaagtttgcggaatatggaacggtggacgtccatcaaccgatgatacggccgagcaccagtgcggttgcggcgatggtcacgcccatcagcattaccggcatcaggccggtaccgatccacggataacggatatccgggtccggatcggcgtcgcgcacccacaacgtggaagccacggccaaagccagtcccaaaacgatgaggatgatcagggcaacggttcccgcaacggtgcccttggcgagcatcgcgcccaaatcaggtaggaagcaccagccggccacggcgagagctgccacaccggaagtcacggcgtgagagagtgcgcggataagatgttcgcgcttctcacgagccatctggcgtccgaaggagaagaccaccagcaccaccagcagcaggcccatggccagtgcccatgaataccaaggaagtaccgagccatccgcagcggtctgatccggcggaacctcgctggtcgggaaaggtacgatgacgaaaatcagagaaatcgcgccaaacaccaaagtgacgatacgatccagtatgctgccgcggaacggccagaatacgacaaatgcggccaacgtcagagcggcgataatcaaagggatgatggggacggtgccaggggagggaatgaccgtggctgcgatgaacagtacataggacgtcagttgggccaacaacatgctcagagctttgttcttccaaccctcctgggtgatctcggtcatgatacgcctctcagataatcgaatttctatcccaatcctacgtcgggcattggaacggtgaaatcaaacaaaatagccccttctggtgaaggggcttatggcactaaatcagaacgcgataacgcccaaatgctccaatagcactttgatgccgagtagaatcagcaccacgccgccggcgatctgcgccggcttctgccagcgggaaccgaacgcgcggccaatgtgcaggcccgcagcggagaacagtccggtgaccacaccgatgctgaggatggcgaatgccatatgggctttggtgaacatgaaggccaggctcacgcccacggcgaacgcatcgatgctgcaggccacggccaggggaagcatatgcttccaatcgaactgggcggtctccttggagttttcctcatcttcttcgaaggcttcgtgaaccatgttgccgccgatgaacaccaacagggcgaagatgatccaatggtcgaattgggttacgtatttgctgaatgtagatgccgcgaaatagccgagaatagggaacagcatctggaatccgccgaaccagagggtgcttttcacggcgtcttgtactcgtacgcgggatacggtcaggcctttgccaatggatacggcgaatgcatccatagctacggaaacagaaataagcaggatttgaatgattatcgaaatcatggtgtgacagaaggttcatcgccggattaccgtgcgatgggcctcgaccagcgttcctacacgccgcctacgcctagttgaaaagacaaaacattactgtatcacaaaatacaagctccctctgttggggagctggcgcagtgaaactgcgactgagggagagtagagcggctttgccacaaatacaacaaaaggcccccgaaggggcctcctgtcaacgattcagaatcgaatcacttctcggaatcggcgagacgctgacgcgcggcaatgatttccttttcggcggcgtcagcaccagtccagtagtcgcccggcaggacttccttgcccggctccagagccttgtactgctcgaagaagtgcttgatttcggccttgtggtactcgttgacgtcgtcgatgtccttgatgtcatcgaaacgaacgtcggcgggcacgcacagcaccttgtcgtcgccgccggcctcgtcgaccatgtggtacaggcccacggcgcggcactcgaccacgcagcccgggaacacggagttcggaatcatcacgagagcgtccagcggatcgccgtcctcgcccagggtgccgtcgatgtagccgtagtcatccgggtaacccattgcggtgaacagggtacggtccaagaagacgcgaccggtctcgtgatcgacttcgtacttgttcttggagccgcgcggaatttccacaacgacgttgaaggtttctgccatgtcatttctccttgaaaatcgacagttacgttatcgtctcaccacaataccctgtttacgcctgcaaaacaggtgcggaactcaagaaaccgtgctgagattatgccgacactatgcccaaacagacgaaatcctccccttgaggggaggatttctagcggtttacgcgcacgataaacccatgcacgtcaacggcatcactgttgcattaccgttgcgtaccgcatcactgcacggacaggatgtgggccacatccgcccaaggagccagagacacgtagttgtcccaaccccactggaattcgcggccggtcagctcgtcgcgcacgttgagcgggcggtcggtgggcagacccagctcgctgagttccaggtgaatcatcgactggtgtgcgttgtgtccatcgaggttcacgaccacaatcagcgtgtccgcttggccggtaccggtcagttcggccggcgtgtggcgtgcgaaagccagaatattcgggtcggacgtaggcagcacggtgaggttgtggtagctcaacgcggccgggtgggcgcgacgaatcttgttgagtgcggtgagcatctcggccacgccgtactgcttggccttgctccaatcgcgaaccttgacctcgtacttctcgttgtcgatctgctcttcgaagccggggcgctgcttgttctcgatgagttcgtaaccgttgtagataccccaggacggcgagcccatggctgccagcaccgcacgcacgcagtggccggctacgccgttgtctcgcacgtaagcggtgagaatatccggcgtggtgggccagaaggtgttgtgctggtagtagccgtcgtcgccattggtgaccggcagatactcttccagttcgtccttggtgttgcgccacgggaagtagcagtgggactgggtgaagcccacgtagctcagggcgcgcatcatgcccgggcgggtgaatgcctcggccaggaacaggatctccgggtgcttcttggtcacggcggcaatcacgtcctgccagaaacgcaccggcttggtgtgcgggttatcgatgcggaagatggtgacgcccgcctcgatccacagattcatgatgcgttcgacttctttttcgatgccgggcatgtcggcgttgaagtcgatcgggtagatgtcctgatacttcttcggcgggttctcggcgaaggcgatggagccgtccggcttgtggcggaaccagttcgggtgggccttgacccacgggtgatcgggcgagcactgcagggcgaaatcaagcgcgatttccagacccagttcatgtgcacgctggcacagggccttgaaatcgtccatggtgccgagcagtggatccacggtgtcgtggccacctagctcggagccgatgccgaacggggagcccgggtcatcggggccggcgaccagcgtgttgttgcggcccttgcggttggtcacgccaatcgggaagaccggcggcaggtagacgatgtcgaagccctcggcagcggcgcgttcgaggccggccatcgaagtcttcagcgtaccctgaatgatcttgccggtgttcggatcgatggtggcgccttcggaacgcgggaagaactggtaccaagccgcgaagctggacttcgggcgttccaccttgaagcgctggggctggctgggggagatgccgtcgcgcagcgggtgagtctcgtgcagggcggcgatggtcgggttgtcgccggcggcgagacgatcctcggcgctcagcgtctgatcggccatggtctcagcggccttctccaaggtcttgcgatcgcgtgcggtcaggccggtgtccggggtttcggcccaacgggccagcaactcggcaccggaattgagtgcgttgtccacgtcgtccatcacacgcaccttgatgcgggcgtcgtgcagccaggagacgtacgcgtcttcccaaccttcgatggtcacggtccattcgccgagctgacgcttgacggccgcgtagccatcctcccaaggcttcagatcgctgtgctcgccgcacttgaccatcacggtccaacgatcgaggccgggatttacgcaggtcatggcccggcgcatggtttccttgccgcgcgggttgcgcacgatggcggtggcacccaccttggtacggccttcgatgaacacctgggcggtcatctcaaacggttcgccgagttccacacgggcggggaagatgccgcgctcctcggcgggagtgatgtccatgacattgatgcggccgaactggccgggctcgtttgcttcgatggacggtgcgggggcttcgacagccaggcctttcagcgctgctgcggcgcgtgccgtttcggcgctgactctcttgcgcttggttgcggggctctttcgggcagaagtcgcctttgacttcgttttcgtggtgctgttatcggtattactagtgcgcgtggtcgcgcgatgttgtactgctgccataaggccctattctaagggcttttgaacatatgttgcgcattgtggataactatcaggtaaacgttcggtcaaccgcatgaggtggataactcggcggaagagttatccacaactcgccggcaaacggcaagctcggaccacataggtcgaaaaaccggctgtagcgaatgaaaatctgccatgatcgtggcctacccgcacacagtgcagtatgcggggaaacgtaccaggaaaggacgaatgatgataacgacatggcggcaacggggcatggccatcgtagcgatgctgaccggtctgataataatggtgggagtggtgttcggctcggcgaatacggcgtatgccgcgacgttgacgcccgccgacgaaagatatcacgtggcgtttccatacaacgatatggaatattacgtcggtgtcgcggggctggacgcttcgggcaacaagtactactgcatcgaagcggggaaactgagcgactatgtgataggccccaccacggtgcttgcctccgatgagaacgcccggcgtatggcatggatccttgaccggtaccgcgacacggatgccgccacccatgcggcgatcggcatcatcgtgcaggatcacttcgggcgcgatcgggacgagtgggcgagacagatggcggtcattcaaggccggtaccccgagatcgtggcgaaggcggcccggatatgggatcaatcggccggcaagacgcctgcgggcacgacggtggaacgcaccgatgccgaggctttgcgcagcggttccatctcggtgaaagtggtgaaccgcgccggtgacgcgatcgcgggagtgccgttcaccgtcaccttgcagggggcggcgcggttcgtccaaggcggcaacacgttctcgggggtgtcgacgatcgccgggtcctcgatcgcgtgggaggcgaccggcgccggcgaggtgacggcgaacaccacatacgagtatgggcggatgcacgtcatggacagcactcaggacatgctggcctttgactcgatggcttccactggcggcgcgtcgacgacatttcgggtgcgtaaggattttgttccggcggtatccaccaaggtctccgagaaggtgcttgatgtggcttctccggtgttcgatgacgtgaccagtggcgtggcggatgcggacagttattgggtgcccgatttggaattgcaggcccgcggatactatttcgatggtcttgatacgggcgatgtgggcaatgtcattacgccgaatgcacaagagagcgccgatgcttttcttgcgcgattggcgactttgggttatgagccggtggcctatggcaaggcctctttcaccggggtggggcagcaggcacgtgtgcaggccatgaccaagccggatgacggtgccgcttaccggaccaagcagaatagcggttttggcacatgggtatgggtgtttcggcggtccgagcagagcaaacaggcgcaggaataccttataggcgactggataagtccgtttatggaggctacggaaagcaatacaagtcgcaggaagctagaagtcatgtcgacggtcactgagcattcggcggatatcggtgccgagctcagcgacaccattaccgtatcgggattccctgcggatcatggccagtatgccggcaacgaagagtatgagttcgcggcggatcggccgtatgcgacggtgagcgtatggtggtccggcgatcccgacaacccctccaacgatgaggcgtacaagccatccgggggagaggttcccacggaagacgacaaccaccggttgctggccacctgggagattcccgcgatgaacggcacgttcaaaatcggcgccggggcgttggacgcgcatggcgctcctatgtatctgaccgccgaacggcctgggtggtacgtgttcgtctggcggttcgagggggatgaccgtgtttccccggcgtccagccggtatgacgatgcctgggagcgtgtgcgggtgttgcccccatgcgagtcggagaaaccgtgcgaaccggagaaacccgagacgccgccggcgccggcggaggcaaccacgcccaaccctcgcccgtcactgcccgtcacgggtggcgatgtgtcgcttgcctcggttctggccgtgtcagctctggcgataggcgccatactgtccatcgtcgttcggtggcgtcgtcgctatgaccgattcaagcactggacgatgcgctggccgatacgttgacccgctgcggcatgatgccgatgatgtcggctggatggtgaaccacactccgcttctgagcagaagaacgggagctgggcacgaagtcgatcgtaacatacgacttgtgcccggcttccgcttcgttgagaaacttcacgcctgtcgcctcccgtggattagacaactgaagatccgcgatgaaaatgacgagacgtttatgatcgccgacttccctgggcaccgtagctgcctgatcgcctttcatccatatcgccacggtaaacggaaaggccgctgatttcggtaccgaaatcagcggccatataaccacgttcgtagcggggcatggatttgaaccatggacctctgggttatgagcccagcgagctaccgagctgctccaccccgcgtcggcttgtctctcagacagctctatctacaataggtgcagattccagaaagtcaacatcggcgtgtcgcgtcatcttcccgcggttttaaaacgtgaattggctcacgcagcgaggggtttggggcggagtcggagtcggggtaataacgcgccataaatggccgttataggaatgccctgaaccgttatcccgaatattgacataataggaacatgcctatcaagatccccagtggcctgccggccagagatatcctcgattcggagcgcatcttcgctctggagaagcccgaggcggagcgtcagcgcgtccgcccgctcaaactggtgatcctgaacttgatgcctaagaaaatcgagactgaaacacagctgctgcgtctgatttccaagtcgccgctgcaggtcgaaatcgacttcatgaagacctccacgcatgaggccacgcacgtttccgccgatcatctcgtcaagttctacgaaaacctcgatgcgttcaaagacaactattacgacggttttgtggtcaccggcgcgcctgtagagcatatgccgttcgaagatgtggactactgggacgagttcaagacgattctcgactgggcctccacccatgtgttctccaccatatacctgtgctggggtgcgatgggcgcactgtactaccgctacggcatccacaaggtggattaccccgagaagattttcggcgtattcccgcagtacctgcaggacgaatactgcttcctgaccaatggcttcgacgagattgatctgcagccgcactcccgcctcgccggcgtgaacgaaaacgaggtacgtgccaaccatgaccttcagatcttgacttgggggccgcagtccggcccgggcctgatcgccacgcgtgacttctccgaagtgttcgcgctcggccattgggagtacggcaagtacacgctcgccgaagaatacgagcgcgatatggccaagggcatgaccaacgtgcccttcccgaagaactacttcccgcatgacgatccgaagctggaaccgttgttcgcctggcgcgcccacgccaatctgctgtggcgcaactggctcaactgggtgtaccagaccacgccgtatgacctgaccgaggtgccgcagctcagggctgagaagaagctcggtactgatcgttcgattcggcatgagccgggcgggccgcgccaggatgatttcaagccgtttgtgcatgacgggtatggggtgattcagggctgagcctacgatctcccctcagtcgcctacgacgacagctcccctcgacggggagctcctttgcttctccttcgcggctcggcccatcagagggagctactgttggaggttgcgttcgtagcgtggacggttgttcgtccacgatgtggacggcttgatgaacgtaatgccacacatccgcgtaatgcgaccaatagtgcacaacgttcgcgaaacgcccgggaaaaccttgcagcagtagggatttcaggagactcgccggtataatattgacattgtctagacgcaggcaaataatcactcttcagtcattcggagccgaatgcccagcgcagactccgtgtccatgcccggcagactccacaccgaggagacaaaaaaagacgaaagtaacgagcacgtcacatttgcctgcccggtgggtttaaactgacacctgacattgaagaagcaggaggcgtgatatggtcggttcgctcagcgcaggattgctgttggctgacgaggcaggcgctcatctgccctcggttgatgacttccttcccccggagattctgttccagggaactccgtttgccatcaaccgcattattttgattcgtatcgtggcaaccatcgtgctgttggtggtgctcggcgtgaccgcaaagcgcgccaagctcatccccggccgttggcagggcgtagtcgagtacggtctcgacttcgtgcgcgacaaggtcgtgtatgacgtgatgggtgaggcccgtggcaagcgctacgtgccgatgatcaccaccctgttcttcacgatcttcattttcaacctgtgcggcatcattccaggtatgaacatggcggccaacgccacggtggtcatgccgctcgtgttcgctgtctggacactgatccagtactggatcgccgccatccgctcgcagggcctcggccactatctgcgccacgagctgttcacccccggtgtgccgtggccggtctatttcctgctggctccgatcaacctgcttgagctgttgatcatccgcccggcctccctgaccatccgtctgttcgccaacatggtttccggccaccttatggtcgccacctgcctggcgttcgcacagttctggatggttgacgcggtcaacaagctgcagggcatcccggtgggtgcgctgtggttcgccggtggtttcgccatgacctgcttcgaggcgttcgtcgccttcctgcaagcctacgtcttcgcgattctttccaccgtgtacatcaacctgagcttcccggaagagtgacgggcgactaacccgccgcttccggtccccggtctgggaaaatcgcagaccgaccaaaccccaagatttataacgtcgccaagtacgttagaaaggaaacacaatggatatcatcaccctcgcagaggtcgccggcaacctgtccgtcatcggttacggtatcggtactcttggccctggcattggtctgggcatcctcttcggcaaggccatggaatccaccgctcgtcagcctgagatgtccggcaagatccagaccatcatgttcatcggcctggctctggtcgaggtgctggcactgatcggcttcgtcgccgccctgatcatctgatctgcgcagatcaacagacgaaaaccgattatgtccatcactgaaaggagggcttgatgacacaagcagcaagcgggattgacctgttcattcctgaggtttatgacatcgtatggtcgctgatcattcttgtcatcgttgcggtgttcttctacaagttcttcatgccgaagttcaatgcgatcttcgacgagcgcgccgccaagattcagggcaacatcgccaaggcggagcaggctaggaaggacgccgacgaggccaaggccaagtatgaggcccagctgagcaccgcccgtgtggacgccgccaagattcgcgacgacgcccgtgcggaagcgtcccacatcatcgccgacgctcgttcccgcgccgagtccgatgcggcccagatcaccgcatccgcacagcgctcgatcgaatcccagcaccagcaggccatcgtctcgctcaagggcgaggtcggcgcacttgccaccgccctggccggcaagatcctcggtgccaagctggaagacaacgacgtgcagtcctcgatgatcgattcgatgatcgacgacctgggcgccaagaagtgaccgtgaccatccgtaaccagaaagggaggtgaccatgcgaggagaggcatcacgtattgcagaccgcgagtcgcgtgattcgctggccccgaaactgcgcgacacccgtgaggacgcgtggcggatcggcaacgaactgttcacgatcaccaaggtgctcgatgacagcattcagctggagcgcgcactgaccgacccgtcccgcccggttgccgacaaggtggccgtcctgaaggaactgctcggtgacaacgcgcatccgatgaccatggagatcatgactgacttggtctcccgccgttggagccgtgcgcgcgacatcgccaacgcagtggaagacttcggcgtggacgccatgatgtactacgcggacgccactgacgccacgctgcaggtatccatcgagctgtccgagctgcattccgcactgctgaacctgccggtcgtacgcgccaagctgtacgactaccaggccaccagcgaggcccgtgtgaagctgttccgcgaggtgttctctggcaagaccctgaacaaggtcaccatgaggctcgccgaacacgccacttgcaacctgcgccgccgccgctacttggagaccatccagtggctgatcaacaagttctcccgccacatgggcgagtcgatggtcaccgtgaccaccgccaccccgctgaagaaggagcagatcaagcgactggtcgaggtctactccgccaaggtgggccgtcaggtgcacatcaactcggtggtcgacccgaccgtgctgggtggcatgcgcatccaggtgggcgacgaagtcacggacaacaccgtggtcgcacagctgcagaacttgcatcgcaaggtgcagacggaggcgactccggcctgaccggccgagccaatccgtccaacaccacacacaagcaaagacttgactgaacaataaccaatagaaggagtgatcatggcagaactgaccatcgatcccgcctcgattcgcaaggccctcgacgacttcgtgtcgtcgtacaagccgagcgacacccccacccaggaagtgggctatgtcgccacggccggtgacggcattgcacacgtgacgggattgcctggttgcatggccaatgagctgctgacgttcgaagacggcacgctcggcctggcgttcaaccttgacgcccgtgagatcggcgtggtgatcctcggcgatttcgctggaattgaggaaggccaggaagtgcgacgcaccggcgaagtgctttccgtgcccgtcggcgacggctatctcggccgcgtcgtggacccgctgggcaagccgctcgacggcctcggcgagatccagggcattgagggtcgtcgtatcctcgaagcccaggcccccgacgtgatgcaccgccacccggtcgacgagccgctgtccaccggcctcaaggccatcgacgcgatgaccccgatcggccgcggccagcgccagctcatcatcggcgaccgccagaccggtaagaccgccatcgcgatcgataccatcatcaaccagaaggccaactgggaatccggcgacccgaagaagcaggtccgctgcatctacgtggccatcggccagaagggctccaccatcgcctcggtgaagcagagcctggaagacgccggcgccatggagtacaccaccatcgtggcctccccggcagccgattccgctggcttcaagtacatcgccccgtacaccggctcggccatcggccagcactggatgtacaacggcaagcatgtgctcatcgtcttcgatgacttgtccaagcaggcagaggcctatcgttcgatttccctgctgctgcgccgcccgccggggcgtgaagcctacccgggtgatgtgttctacctgcactcccgcctgctcgaacgttgcgccaaggtctccgatgacctgggcggcggttcgatgacgggtctgccgatcgtcgagaccaaggcgaacgatgtgtccgcctacatcccgaccaacgtgatctccatcactgacggccagatcttcctgcagtccgatctgttcaacgccaaccagcgccccgccgtggacgtcggtatctccgtctctcgagtcggtggcgccgcacagaccaaggctctgaagaaggtctccggtacgctgaagatctccctggcacagtaccgttcgctggaatccttcgccatgttcgcctccgatctggatgcggcttccaaggcccagttgacccgtggtgcccacctgaccgagctgttgaagcagccgcagttccacccgtactcgccggaacaggaagtcgtgtccgtatggaccggcacccacggcaagctcgacgacctcgacctgaaggacgtccttccgttcgagcagggactgctggactacatcgaccacaacaccgatatcctcaagaccattcgcgagaccgaggaattcaccgccgacaccgaggctgccctcgataaggccgtggacgagttccgttcgacgttcgtctcttccgccggcaagccgctggtcgagaagaagccggacgttgacaaggccgcgccggtcgatcaggaaaagatcgtggcgggagaaaagtaagccatgggctcgcaactcgcattgaaatcacgcatccgctccaccgagtcgttggcgaagatcttcaacgctcaggagatgatcgcgtcttcgcatatcgccaaggcccgtgatgtggccctgaacgcgaagccgtacaccgatgcgattttcgatgccgtgcaagcgttggtggcccacacccatatcacgcatccgatcgcggtgaaggacgagaagaacccgcgcgtggctgttctcgccctcacctcggatcgtggtatggccggcccgtacacctcttcgattatccgtgaaacggagtcgctgctgtcccgcctcgatgcggcaggcaagcagccggagctgttcgtgtacgggcgtcgcggttcgacgtactacaagtaccgtaatcgtgacatcgcggcgacgtgggaaggcgacaccgaccagcccggcgtggaaattgctgaaacgatctccaacaccttgatggacgcctacatgaagccggctgagaagggtggagtttccgaactctacatcgtctacaccgagttcatcaacatggtggtgcagaaggtgcgcgtgctgcgcatgctgccggtcgaaatcgtgaaaaacgagaccaaggtgcccgatcctgatgaagaggcaccggctactgcggatgtcgctccgctgtacactttcgagcccagcctcgaaaaggtactggatgcgattctgccgaagtacattcagtcccgtatccacgagtgcctgctgaccgcggccgcgtcggaaaccgcaagccgccagaacgccatgcacacggcaaccgacaacgcacgaaacctgatcgacgaccttacgcgcaagctcaacgcttcccgccaggcctcgatcacccaggaacttaccgaaatcatcggcagcgctgacgcgctgaccaagaaggaagagtaggaacgcatatggctgacaaccagaccactgcggccgagcctaccaacggtcgcgtcacccgcgtccagggctcggttatcgacgttgaattcccggtgggtcatctgcccgacatctacaacgccctgaaagtaacgatcgtcaacaccagcgccaaggaagaaggcgaggcgaaggagaccgagatcaccctcgaggtcgaacagcacctcggtgattccacggtccgttgcgtcgctctgaagcccaccgacggcctggttcgtggtgcctccgtctccgacaccggcgccccgatctccgtgccggtcggcgacgtgaccaagggccacgtcttcgacgtgtccggtaacatcctcaacaagaagccggatgagaccatcaccgtctccgagcgttggcctatccaccgcaacccgccggccttcgatcagctggagtccaagacccagatgttcgaaacgggcatcaaggtcatcgatctgctgaccccgtacgtgcagggcggcaagatcggtctgttcggtggtgcaggtgtgggcaagaccgtgctgattcaggaaatgattcagcgcgtggcccagaaccacggtggtgtgtccgtgttcgctggcgtcggcgagcgtacccgtgagggtaacgatctgatcggcgaaatggccgaggccggcgtgcttgagaagaccgcactggtcttcggccagatggatgagcagccgggtacccgtctgcgtgtcccgctgaccgcactgaccatggcagagtacttccgtgacgtgcagaaccaggacgtgctgctgttcatcgacaacatcttccgcttcacccaggccggttccgaggtgtccaccctgctgggtcgtatgccttccgccgtggggtaccagccgaacctggccgatgagatgggttccctccaggagcgcatcacctcgacccgtggtcactcgatcacctcgttgcaggccatttacgtgccggccgatgattacaccgacccggccccggccacgaccttcgcccacttggatgcaaccaccgagctttctcgtgacattgcctccaagggtatctacccggctgtggacccgctgagctccacctcgcgaatcctcgatccgcgttacgtgggccaggctcactacgactgcgccaaccgcgtcaaggcgattctgcagcgtaacaaggagctgcaggacatcatcgccctgatcggtatcgacgagctcggcgaagaggacaagaccaccgtgaaccgtgctcgtaagatcgagcagttcctcggccagaacttctatgtggctgagaagttcaccggtcgccccggctcctacgtgccggccgacgagaccatcgaagccttcacccgcatctgcgacggcgtgtacgacgacgtcccggagcaggcgttctccggcatcggcggcatcgacgacctcgaagagaagtggcacaacatgcagaaggaactgggtgcgtgatggctgcggaaaaaaccacgatgaaggtcaacatcgtcgccgctgaccaccctgtgtggcacggcgaggcgacgagcgtgaccattcccgcctctgagggcggcatgggcatcctgcccgaccatgagcctgtgctcacggtgatcaagcagggtacgctcaccgtggttgagcccgatggcgatcgccacatgttcgaggtgaccgacggattcatttccttcgactcgaacaaactcaccgtggcggtcgagcgcggccacgacgtccagtactccggcaccgccgagtgacctgaaccaactccttaaggggctctctggttttccagagagccccttttgctatgtatgccatgtgttgcgctacagtggtggcctatgcgagttattgttgccgactgttcggccgagtattcgggccgcctcaacgcctcactgcccctggccaagcgcgtattgctgatcaaggccgattccagcctgttgattttctccgaattgggctcctacaagccgctgaactggatgaccgcgccctgcacgattcgtgagatcgacccagccgccaaatccgcgcaacattcccgggaaagtgtcgctggtggggctgtggatggtgattctgcgacgcattccccggaaagtgtcgccgctggtgagccggaaaaggtgctacgtgtcagcgccgacaagggttcggacattcttgaagtgacgctgcagcatatctattccgaccgaacctatgatctgggcgaagatccgggtctcatcaaggatggcgtggaagaccatctgcagcgctatctggccgagcaaatcgagcgtatcggcaagggagccaagctggtgcgtcgcgaatacccgaccgccattggcccagtggatattatggccgtgaatgccgagggcgagcatgtggctgtggaaatcaaacgtcacggcggcattgatggcgtcgagcagctgactcgctactgcgaactgctcaatcgagatccgctgctggccccggtgcacggcatcttcgccgcacaaaccatcacgccgcaagcccaggtcttggccaaagaccgcggcttcacctgcctcatcctcgattacgacgatatgaaaggcaccgaggacgacagtctcaggctgttctagatatagcaggggctccctcatcagagggagcccctgctatatcttttagtacgcggcgagaatatcgattacgaagaccaacgtggagttggcgggaatcggaccttgctccttatctccataggcctgatccggcggaatcaccagcagaacctgagagccgacggtctggccgaccagacccttctgccagccctcgataacctgatgctggccgctggaatcgctgaacagatcggcgtcgattgtggaatcgcgatcccaggacgaatcgaactgcttgccattcgtaagccaaccggtgtacttgaccaccacggtgttcttgtcggtcagcttggcgccgttacccttgatcagcgtctgcgagatcagcgaatcaaccgaaccctgaccgttcatgtcgatggacggctcgccgtttttggctcgcgtcaccttcggcagattggccggcacatccttgacttcctcgccagtggccttctccaagtccttggacttggacacaaacgtcatcgccagaatgtaagagtacccggacgaatcctgagcgttgacgccaaagccaatcgtggtgttgatcttggcacccttgatctggttgtagtaggtcgaggagagggtcttggaatccaccttcagcgagcaatccggcgtgttcttggtccaggtgtccatgagctcggttccgtctttaacgttgagcgcgatgccttgggcgcagacgcggtcgccctcctcgatcacgtcgccatcgcccttctgcagcaccacataagagccgtcggacacggtcatcggcgtattaaaggagatggtcggcttctcgccgagcttgcccttggcggtcacgccggcaatttggcccttcttgtcagaagagtcggaagatgaagaggaatcggaagaagaggatttcgagtccgagctcgaactggagcaggcagccagcgacacgcacatcgccagcgagcaggcaagggcaacggccttgccgaggggagataacatagacttaacagacttacgcatgacacatcaccctactggtaaaccttgattttctgcgctcctaggtaataaacaggtgaagattgtagaatggttgagttatgagtgctgaagaacagactacaagaccggataagggcgccaagcgtccatcccgtcatgccaaaatcatgcgtggagtggtgacgcctatcttcggactattggccgtggcggctgtggtgttggggtacatgaatgccacgatgtggaagccctccactgaaatcaccgcttccgcaaccatgagcggctcccggtatgtcgtcactgatccgaatgtgctgaccttgttggatcagaatgccacgataaccgtggactcgggatcctctcaggacgaggcgtgcgtggcgttgggttcgtccaaggatgttgccggatgggtcgcgcccgagaagtcctatacccgcatcaccggattggcatcatggagcgagctgagcacccagaagggaagcagcacgagtcagggagcgcctaccagtgccgatgacgcggtgtcgttcaaggattccgatatgtggactgccgtgaaatgcggcactgggtccgtttcgctgaagagcaagaagaccggcgcctcgacggtagccattgtggatttgggcgaaaatgtcaccaacgccaaggtgcagctgcactgggtgcgctccgaagtgccggactttgcgatgccgttctatctgtccggcggattgctggccgtgctggccgtactgtgcgcctccgtgttcgccatgccgccgcataagcgccgcaagcgcatggtggaaggcatggcaagcgccgtaatcgaggaagaggcacccgccagcatcgcagtgtccgggaagccggatggtgcaagtcgacgtaatcgtcgccgtcacgccacacatcggcgttcgggccgtgcgtcctcgcaatcctcgcaatctgaagccaccgaaacaccggttatcatcgacccaagttcgcgtaacctggtcgccgaccagcagaccggtgccgaaagcggcgctgagcccggcctcagcgccggcgataacgaatcgacttcggtaatcacccctgacgaactgcaggcctacttctcccgcttggcccaagaggtcaataccggagacgactcggccgatgacggacaggaggaaagctgatgaacaagcgatggaacaaactgtgtgtgtccgccctcgcctgcatggcgttggtcgtgccgttgaccgcctgtgaaggccaactgccgacgccggctgctgatacctccaccaaggttgcgccggatttgaccgaggcgcaggagaagaagattcgtctgaagattctcaagacgatcgatgaagccgatcaggccaagaatcccgatgggtatgcgaccgttatgggcgggccccagctggacattcgcatcagccagaccacgatcaatcagcgtggcggcggtatgtccgaatatgcgaccattcccaaggacatcgcccagacggtgattcctacggacgacggatggcctcgctcggtgttcaccatcacgaccaccaccgaagatcagcagtccaagcgtttgctggtcttcgatcaggaatccgcccagcagaattacaagctgatggctatggctcgactgtttgagggcgccaagctgccgaagttcgagattccgactattggctcgcagatgggcaccgcaaaggatgagaagctggtggccgctcccgccgatgccttggcccaatacgccgatgtgctgcagaacggctccaagagccaatacgcttccaagttcgcagacgatttgctgcgccaggaactggccaataccacggccaaggtgcaggaaggtatgcaacgcaacaacggtacgcaggagcaaaaattcaccgctgtgcctgaacagatgtgggtgatgcgtgctgcagacggtgccggtgatctggtggttggccgtattaacggcgaatggactcgcaaggcaggggatggccgcgaatcgcggccggcttccgacgacgagaaggcgctgttcaatagcgacaagtacaccagcaccatgaaggtcacgtatgtgaacgtggtggccttgtacattccgttggcaagttccggtgagcaaatcaccgcagtgggcgccgaccgtcagccggtaaaggtcgaagcgctgtaattgttgccgccacccaccgcgcggttaacgcccccaccacgatgtgattcgtccaccacgatgtcgataaaactttacctttcgcataatggtgccgtttggggtcacatcgtggtgggcgttttgctacgtggtgggaattccaccgcgtagtggaagaatccctacgtggtgggaatcggcattacaatcaatgtcagcaaatgtgattgttgttgtacgcgaatcgcgtggaatcgggaggcattatggcagagcagcagttcaatccgggagtctcattggcgggcgccgtcgatttggaggcgctgaagcatcaggtcaaggccgagcccggacaagcgggcggcgcgcctgccgctggtgggtacgtgatcgacaccaccgaaaacaccttccaggcaatggtgcagacttctgcgaccttcccgatcctgctgcttctgtgggtgccgaccgatgaccgcctgttcccgatggcccgtgcactgggcgacgcggtgaacgccctgaacggccagattcagctctcccgtatcgatatctcgtccaatccctcgattgcccaagcgctgcaggtgcagggcgtgcccgcactgttcgcgttgattgccggccgtccgatgccgctgttgcagggccttccgggtgacgacgagctcaagcaacttactgacgaggtgattccgaagattattgaggccgccgcgcagtctggtgtgaacggtaccgcgccgtactcgggtgatcctgattccgatgccgccaagagcgctggtgccaccggtgccgtcgcgggtgctgagcaggtgccgccggagcatgccgaagcccatcgtttggccgaggagggcgattacgccggtgccgccgccgaatacgagcgcgtgctcggatccgacccgtccgatgcactggccgcccgcgaacgtgcgaaggcgctgttgctggcccgctccggggccgctgatgtacgtgatgtacgtgccgctgccgccgcagcgccggacgatgtggaagcgcagttggccgtggctgatatcgacatgattggtggccagattcaagacgctttcgaccgtttgctggactttttggccgccgggcacaaggccgatatcgagcaggttcgcaagcgtctgctcgaatacttcgccatccccgaacccaccgacccgcgtctgacccgcgcccgtcgtcgcctagccaccctcatgtactaagtggttttggctcccctctttgagaggggctgtcgtcgtagatgactgaggggagctcacgagcgtactcgattgctcccccctaaaccatccgattcttcccgaaatactgctggaaccttggcccctccagcgccagctcctccttgaaatcatccgcccacttacagaacggacggttggcgagaccatcgttattgaatcgcgcctgatcggtgatttcggtgatgcagaatttcggaatcgtcagattggtaaccggcccggatcgttcggcctcggctacgatgagcggcgcattcggcccgccgaacacatccacgctccagccgtcttcctcaatccacacggaataccggttcttgatgattaccgagccgccgcgcttgatgagttcggccgcgatacgcgtatcgatttcgcgctcgacttcgtagcgcgtgccgcccacggacggacctttgacggtgacatatgcttccgagaaccggtcgcggtattcgtccagcacggccaccggatttacgtcgggcgtcatgtcgacgtgaaccttgcgcgagaccagccgcacgcgcaaggcgtaattgtcggcatgcacgtagtagctctgaatgatgagggtcggggcgtcgccgtcgtcgtattccgccggcagttcgcggcagaagaagcggcgttcgtattcgaagtcatctgtaggttccgacataaccccattgtagagccgataatggcgattttctcgttattttggcgacgtatgtgccgcatgcaacgtgatgtggtgtacagtaaagaagttgctcgggtttgtagctcagtggatagagcgtctgtctccggaacagaaggtcgtgggttcgatccccatcaagcccaccagcatggctttcggctaaccgccggaagccttttgcatattcggcgcgtgcaaggctggtgctggtgtcggcaatggcaaggccggtgatgccggctcgcttgggtcgtggaaaaaccgtccggtttggcgagaacggtagccgaatcgtctggaatcgtctggaatcgtctggaatagcaaggaatagtctgttgatggccgtatgccgggcatcatgcgcgctaaacgcgactttgctcagtagactgctacgtaatcggcattgccaatcgttgctgatcgtgcgattggtcgtagccggtggtgatgtgtaccggcgccggccgcagcaggtgggcgcccccaagatgagaaggagcacaatatgagcgaaaagatggaagccgtagccacttccgaggcgccggccgcgctgggcgcatacagccaggcggtgaaggccaatggcttcgtgttcgtatccggccagctgggcattgatccggccaccggcgaactggcgggcgagaccgctggagagcaggctgcacaggcgctgaagaatattaagcacattctcgacactgccggtaccggcattgagcatgtgtgccgtgccaccatctacctgaagaacgtcgaggacttcaaggaagtggacgcacgttacgctgaggcgttcatcggctccgtcaagcccgcccgcgtggcctttggcaacaacatgattcccaagggtgcgctcgtggagatcgacgccatcgcggtggagtgattcgaacgtttccccggcggcccgtctgcgcgcatggtgtgtgcagacgggctgccgcgtattgtgcgacgcattccggggaatgtttcgctgggcgggggtgcgaggtgtggttccgcgacgcattcccgggaatgttgcgctggaatcgttgggcggtggtccgtgccacaatagagaccatggcatccaaaggaaaaccgtcgccgcgttcggccgtaagcccgctgagtgatgagcaggtcaagcgtctggccgcccgccacacgcttgtggactcgacacagtattacccgaccggcccccgcacgcctaatcagccggaaatcaacgcccagaatcccaaggccaccaaacgactgctgggaggggtgtccattgtgttccgcgccagctgcaagaccaaggcctggggcttggaacaggtgccggaaaccggaccgttcatcaccgccgccagtcatgtcaccatgtttgatgtgttcgtgccaatgatgagcctgttccacatgggccgccgcccccgttacatggccaaggccgagatggcgaagtggccattgatcggcaagtggttccagttggtcggcatgcagccggtgcagcgtcattcgggcaaggccaagcagatcgaagagacctcgattgatattctgacgtccggccgcccgctgacggtctggccggaaggcaccgtgacccgcgacccgaaaaagtgggtgatgagcattaaggagggcgtgggatatatcgcccttgaatcctcgcgcagactggggcatcaggtgccgctgtacccggcggtgacgtggggtgccgcctccatcaaccactggtggccatggccgcgcaaaaacgtggtgatgtgctatgaccatgcgctcgattactccgatctgcttgccgacatggactcatggggtgaagagccgcctgccgaggccgtgaacgagctgatgtggcgcgtgctcaaacgcatgaacacagtactggaggaaattcgtggcgagcagttccccgctgaaggctactgggactaccgcagtatgagtcgtaagccttggcctgaagccggcggcccgttcccggctgagaagtagccgcaccggttcccgtacggggagcctaggcgagtagcatggcacaagattgtgccgatgaagttgcgcgacaagcgaaggtaggaatttgatatgggtaaaaatataacggttctcggtgcaggagcatggggtactgctttcggccaagtgctggcggacgcaggcaacacggtgaccatgtgggccaaggagcagcagattgtcgagggcattcgcgatcaccaccacaacgccgtgcgcctgccgtccgtcgaaaagttgccggacaacatgaccgccactggggatcgcgccgaagccgtcaagaacgcggacatcgtagtcgtggccatcgccgcgcagttcgcgcgagtggcactcgtcgaattcaagggactgattcccgatcacgccatcgtcgtcagcctgatgaagggcatcgagcgtggcaccaacaagcgtatggacgaagtcgtccgcgaatcccttgacttgccggccgaccggttcgccgccatttccggaccgaacctgtccaaggaaatcgccgatcgtcatcccgccgccaccgtggtggcttgcacgaacctcgataatgccacgaaggtggccgaggcatgcaccacctcctatttcaagccgttcgtgaccaccgacgtcatcggcctggaaatgtgcggcagcctgaagaacgtgaccgcgctggccgtgggcatggcccgtggtgccggctacggtgagaacaccgcagccatgatcgaaactcgtggactggccgaactgaccgcgctgggcgtagccgctggcgccgatcccaagaccttcttcggcttggccggtgtgggcgatctcatcgccacctgtggctcttcgctgtctcgtaactatacgttcggcgcgaatctcggcaagggattgacggtcgaagaggccaccaaggtcagcaacggtgtggccgaaggcgtgcccaccacggatgcggtggtggctcttggcgatcagcttgatgtgccgaccccgttggcgtatcagatgagccgcgtgctgaacgaaggcatttcctgctcggagatgcttgccggactgttcggtcacgaggttaccggcgaataacgagagaagcgacgtatacgtggcgtatacgttgtacgtgcaaagtcgcgtggcgtatacgtcgttgacgtgcacgagtagactggtgtgcgtctcttgtgcgcggcgttccgagcgcggttcggtccggttggcggtgcaaagcataggcttgaaaacggttgtagtttcaacaaaaggatggttatggccaagaagcgtgttgtggtgctctatggtgggcgtgcagacgagcattcgatttcctgcatctccactgccggtgtgctgggggccatggacactgaacggttcgagccgattccggtcggcatcaccaaggacggcaagtggatcatcaatggcgaagatccgcgtggctggaacttggacggcggcgagctgccgaccgtaaagatcaccccggaatcgcgcccggtgatgcttgacccctctcgcggacaggacggtttcttcatcggcgagcccagccacatcaattccgccgattccggcttcggcaccagcttcgtcagcatgtccgacccggaaatgcaccatgtgctgacctcccttggccatgtggacgcggtactgccggtgctgcacggcccctatggcgaggatggtacggttcaaggcctgctggaaatgatgggtgtgccgtacgtggggtgcggagtgtttgcttccgccgcctgcatggataagcattacaccaaggtggtactggatgccgccggcattcccaccgcgcccggtgtgacggtcgatgcgcgcaacttcaccgccgccgatgtgcttgccgagatcgaggacgccggtcttacttatccgctgtttgtcaagccttcgcgcgcaggctccagcttcggtgtgaccaaagtcgagaaagccgatgaccgcgagacccagcaggatcgtctggccgccgccatcgccaccgccggcgagcacgactggaaggtgctcgtcgaacaggggattgatggtcgcgaaatcgaatgtgccgtgctgtgcccgaaggccggtgacgagcccgaggccagctggcccggcgaaatcgtgctcgatcatcagaacgacgaccagttctacgatttcgactccaagtacatggatgcctccgccagccacgtggaagtgcctgccaatctgccggtcagcgtgcttgaggacgtgcgtgacgtggcccgtcgcgcgttcaaggccgtggatggtgccggcttgagccgtgtggacaccttcgtgacgcctgatggcacggtgatggtcaacgaaatcaacaccatgcccggcttcacgccgatttccatgtatcccaaggcttgggatgccaccggagtgagctacaccgaactcatcacgcgattgattgagggcgtgctgaggtaagtgtggtgcggaatcggccgcaggccggttccgctattgacacatcgcccatacctgtcagtaattcatgccaagttttcctaagttcaacaggcgtacagcaaatggcgaacgcaattcacttgcgcgccagtgtcaggacagattaggcgcatagtttcttttcttggattcacgggccgcgcgaatgccgcgcataccaagcccgactccccagactgtcgtctggatgatgttgagaaaaggaacattatgaacaacctgcgtaagatcgcggccggctccctcgccgccgtgctcgcgttctcgatggccgcctgcggctcgagcaacgcctcctccgatggcaccggcgaaagcaccggcaaggccgtcaccgtgaacgaaaagtccgtcaaagccacctccctcgccgacttcggcaccatggaagacctcgagaaggccgccaaggaagagggcgcgctgaacgtcatcgcccttccgcacgactggtccaactacggcgaggtcatcgagagcttcaagaagaagtacccggagatcaaggtcaccgagctcaacccgaacgcctcatccaaggaagagctcgacgccgccaagaccaacaagggcaccgacgccgcccccgacgtcttcgatgtcggccaggccatcgccgccacctccaccgactacttcgccccgtgcaaggtgcaggcctgggacaagatcccggacaccgccaaggacgccgacggcgcctactacgccgactacaccggcatcatgtccgtgggctggaacgccgacaagtacggcgacatcagctccctggacgacctgctcgacccgaagttcgccggcaccgtggccctcaacggcaagcccgccgaggctggcgccgccttcaacggctacctgatggccaaccagctcgccggtggcgacatcaacaacctgcagcccggccttgactacttcaagaagctcaaggaagccggcaacctgaccaccgtcgacgtgaccaacggcaccatcgactccggccagaccggcgtggtcttcgactggacctacaaccaggcctcctacaagaaggagctcaaggacaagggcgtgaactggaagtacaagaccttcccgaaggcccaggtcgtcagctactacaaccaggccatcaacaaggacgcgccgcacccggccgccgcccgcctgtgggaggagtacctgtacaccgccgacgcccagaacctgtggttcaagggcggcgccaacccggtgctgctcgattccatgaaggaagacggcaccgtcgaccaggccactctgaaggacgccatcaccatcgaaggcgagccggtctcctacaccaacgacgactccacccgcatcaccgagtggctccagaacaactgggacaagacgatcggcaactgaggcacagaccgatgaccgccgcaatcgcacccattgcatcgaacggacctgctgccgccaaggctgcgggtccgtccgctactcccgcttctcctctctcctcggcgatggccaagcaccgccaggagctgggcacgctcgccaccacgctcccgttcttcgcctacaccgcctgcttcctgctcgcacccaccgtcatcgtgattgtcggtgcattccaggatcgcagcggcaacttcacgctcgcgaacttcaataagatgttcgaggccaacaccatcgccgcattcggcacctcgattctggtgtctttagcatcctctctgatcggcgcagtggtgggcgcgctcgcttcctacgcactggtcattggtgccaagccgaacggcctgctgcgtcgtatggtctccgccatctcctccgtgcttgctcagttcggcggcgtgatgctcgcgttcgcgttcatcgccaccatcggcatcaacggtatcggcaccatgcttatcaagacactgaccggctacaccgtgaacccgaactggctcagttcgttgccgggcctggtgaccatctactgctacttccagattccgctgatgatcatcatcttcctgcccgcggtcgattcgatccgtccacagtggcgcgaggcatgcgaatccctcggtggcaacacgttccagtactggacgcgcgtggcctgcccgattctggcaccccgcttcatctccgcgttcctgctgctgttcgcctccgcgttctccgcatacgcgaccgccgcggccctgttctcccagcgttcgattctggtgccgcttatgatccaaggtgccatgcgcaacgaactggaccccaaccagcagggctttgcccaggtgctggcattcgcaatgatcatcgtcgtggccatcgtcatgctgttgagccacgccgtggaaaagagggccggacgttggcaatgaccgaaacttccgcaaccaagccgccgcagctgcgcgccgctcgtgcgcgtaaacagagcatcatcaaattcgtgatcctgttcgtcaccctggcgttcctgttcgtgccgctgctggccatgctcatcttcaccctgcgtcacccgctgtccggccgctggtcggccgcgccgtggatcgcgattttcaccggcaacggcgagtcgctgggtgccgacctgaccgtgctgtggcagggcatcggcacctcgctggccctgagcgcggtcaccgtggtgatcatgctggtgctgctggtgcccaccatggtcatcgtgcatattcgctccaaggttttggagcgcgcgatcgaatgggtggccacgctgccgctgaccatcccggccatcgtgctggtggtgggtttgggcccgatctaccgctggctgtccgccgacgtgctgagcaccagcccaatctggctgtgctttgcctacgtgattctcgtgatgccgttcgccttccgcgcgatcgccgtggggcttaactccatcgacgtcaagacgctggtcgaggcatcccgctcgctcggtgcctcctggcccaaggtgttcttcaaggtgatcatcccgaacctatggcagtcgattctctcggcatcctttatctccatcgccgtggtgctgggcgaatacaccgtcgcctcgctgctcggccgtatgaacctgcaggtcgcgctctaccagctcggccagtccaattctcaaatctccaccgccatgtcgctgctggctctgctcttcggtgcggtgctcctcgttgcgctcgacctgatctccgacgcaatgcgcaagtcaagggaaggtaagtaacctgatgaacagcaattcgattttcacccgtcgccatgccggtgccgatgccgcggcttctgtttcggcacccgccaccacgtccgctgccgccgaggacgccttcaagaacgatcccaccgccaccctcgaaggcgtgcgcggcaaggacgtgaccaaggccgccaaggccctgctcaaagacagcgtcaagcgcggcggcggctccatccagatgcgcgacgtcgtcaagatctaccccggctccaccgttcacgcgctcgacgacttcaacctggacatcaagcccggcgaaatggtcgtgctgctcggcggctccggctgcggcaagtccaccgcgctgcgctcgctcgccggcctcgaagacatccagggcggccgcatcatggtcggcggccaagacgtcaccggcgtgccggtcaacaagcgcgagatggccatggtgttccaggcctactcgcttttcccgcacatgaccgccctggagaacgtggaattcggcctcgaagtgcgcggcatgggcaaggcagaacgccgcaagatcgccatggaacagctggagctcgtgggacttgccgatcaggccaagaagtacacgcagcagatgtccggcggccagcaacagcgcgtggccctggcccgcgcgctggccgtcaagccgcgcgtgctactgctcgacgagccgctctccgccctcgacgccaaggtgcgcgtccagctgcgcgaccagattcgccgcatccaactcaccaccggcaccaccaccgtcttcgtgacccacgatcaggaagaggcgctggccgtggccgaccgcatcggtgtgatgaacaagggcaagatcgagcagatcgccgccccgcagaacctgtaccagcgccccgccaccgagtacgtggccacgttcattggactcaccaaccgcctgcccggcgcatccaatggcgacgaggccgtggtcttcggccagcgcgtgccgctgctcgccggctccgccaagggcgattccgtggccgtgctcgtgcgcccggagaacctgacgctggccttggccggcagcagcgattcgcacgtcggcgaacgcgcccgcgtggaggtcattcacttccttggctccttggtgcgcgtggatacggtcatcacctccggcgaataccagcgctggaacaagggcgaacagctcaaggccaccgtgcagctgcccgccagcgagctgccggccggtctggcggtgggcgatgacgtgattgtcaccccgcgtccggtcgccgcgctcgcctgctgaatggcgttgcgatgatcgtgcggttctgttctgtttttgtgactgtacgatcgtcgaatggcttatcggcaatgatgtgtgtgggacggcggcgatttttgggcgattatcgcgtgccgtcccacagcaatcttgcagagtaggggactttctcggcattgggaatgattgacgttgatcattccttgcccattgatgatttcctcccccattcccaatgcaatcgaaacgccgtgccgtattcttgaagagtattgcacgtgtgatcggtccgtttgcggccagtaactatgggggataagtatgagcgaaccaatgccgccggcgcagcagccgcaggcacctcagcaatcgcagcagccgcaacaatctccacgcgattggtggttcacggcccatcgccggttttcgacaatcggctcggcgctcgccattatgatggtgttctggatcggactgaatattctggccactgaagcactacgaacgctgcttggcaccgatgtgcccgcttgggctgtgctgctcgcctcctccggaccgctgtatgtggtggccatgccgctgagtatgttggccttcactcgcgtaccggttattcgcacccggcagtaccccatgaaggcgggggagttcattcagattttcgtcatgtgcattccggtaatgttcttgggcaatatgattggcaatatattgtctgccggagccactgatggtcaggccaccaatcgcatcaacgacgtgattcttggcagcgactggcgggtgaacgcattgttcataggcctgttggcaccggtttgcgaagaatggatttttcgcaaggagattatctcccgcctgcgccggtacggagagaagaccgcaatcatattctccgcattggcattcgcgctattccatatgaacgtgttccagttcttctacgcctttggcctaggactgatgttcggatatgtatacacgcgcacctcccgactgcggtattcggtggctatgcacatgctgatcaacctgaacgggtcagtactcgccccattggtgatacaacagatcgatccccgcatcctcgacggcacggtcagcgaggccgaaatcatgcgtatggctgaagccggcaacatgggcgacatgggcatcatgatgttgtacggcacagtgatgttgggcctctgcattgccggtatcgtgctgcttatcaccaagcgcaagagctgggagttctatcttgcgccagaggagttgcctgcggggcttaaaatacgcaccgcctatgccaatcccggcgttatcgcgtacctactgttgactgtgatgcttaccggttggatgctgttcgcatgactgtcatagccggacccagagaggcgagccgggagatatcacagattgcctgacgagccgccatcttcaacaaggtattcggtgcccgaaccggcgatggctcgcgccgccatatctttgatggtggaaggcagcacaccctcgcgcgcgaacacaagcacttggccggtcatgccgtaaggggagaagccggtgaacttgaccaatggcggctgaccctccagcgccacgtcggcggtggctttggttacgcggtcgagaatatcctgactgatcgcagacgggtcgccggaggccttggccgtgaactcaagcgtggccatgccttcgctgaccggcgtgagcttggtcagggcggccgtattgagtaccgaattggggatgaccatcatgtctccggaacgggtgcgcaccacggtctgacgccaggtgatgtcgtgcacggtgcctgtgacgccttgaatggtcaccagatcgccgggttggattacgcggcccagcatcaggccgaagccgccgatgatgttggcgattgtatccttcagacccagcgagatcgccacacctccaacaccaagggcggtgataagtgtggtcggattgatgccgaatacgggctgcagtaccatcgctgcgccggtgacccagatggtcacgcgcgtgaggttcacgaaaatcgaggcgctgggaatctgagaattgtccagaatcttgcgcaacacgcggctgatgacgcggtcggccacaaatacgatggccaatacaatggtcagccagatgagtttgccggcgttcacctgaaaccagcgtgcgatgtcttctgcatattcagtcatacgcctactgtatcggtcgtttctggtgaagtcgtggagacggggtggcagaaagcggaatcggcctacggtcgattccgctactcctggcgttcgcggcaggtctggccgaggccgcgggccagtcgaatcggatcgagaatctcgtccaactgctcggcgggcaggtcggtgcgttcgccggccacctcgcgcacggtacggccggtatgtacggcttcggcggcgatgtcggccgcgtgctcgtagccgatgtagtggttgagcgcggcggaaatcgacggtgaggactgggcgtatgaacgccccaggtcagcattgatttcgatgccttccacgcagttgacgcggaacgtctccatggcgtgcgtcagcaacgccatgccggtcagcagctcatgcaccatcaccgggtcgaaggcgttcagctgcaactgtccctcggccacagcccagttcacagtcacgtccatgccgaaaatcgtgaagcagcactggttgacgcattcggggatcacagggttcactttggccggcatgatcgacgatccggcctggcgagccggcacgttgagatcgttgaaaccgcagcgcggcccggaattgagcagtcgcaaatcgtcggcggccttcttcaggtgcacggcgaggctcttgatggcagccgacgtggccacgtacgcgcccatatccgtcatggcggccaccggatcgggcgcggcggtgaccggcagcccggtgatttgcgccagatgcttgatagcggacttgcggaatcgcagatccgcgcaaatgccggtaccgatggcggtggcaccgaggttgagctgggccagcagcggcaccacgcgatcgaatgcagccaaatcagacttcaacagcgtggcaaacgcatgaaattcctgaccataggtcattggtacggcgtcctgcagctgcgtgcggccaatcgtcacgtcattgatatgtttgtcggccagatcgtggaaggccttggcgagtttcttggtggactcggcgagcggcccgatcgcgtcgataagcgcgagtttgcaggcggccgggtaggtgtcgttcgtggactgcgacttgttgacgtcgtcgttcggatggatgtatgtgtaatcgccgcgctggcggccggcgatttccaacgcacggttggcgatcacctcgttcatgttcatgttcgacgaggtgccggcaccgccctgcatcacatcgaccgggaactgatcggccagtttgccggcctcaatttctaggcaggcggcgcgaatggcctcggccttggctgggtcgatcaggcctaattcctcattggcgatggcgcaggcgcgcttgaccgtggcataggcgcgaatcagctcgggatgttggctatcggtgatgccggagaccgggaagttgccgatagcgcgctgggtgtgaataccccagtagacgttcgccggcacctccatctggccgatgcagtcatgttccagacgggtcttgttcgatgtttcgctcatgcttccatcttcctgtgcgtgggttggaaacgccagcatgagaggctgattgcgccttgtgagaaacctcacgcgaggttcgtgcggcggaaacaatccagactcgctggttttcggtcaagcggtgtacccggggaatcctgcggggccgttcgacgatgagatggtggatggcgcggcatgcgtggcggcgaccggcatgccgggggcggtcgaatcctgcgcattgtgcacgaagatgcgattccagtaattaagcatgtccttttggctcatggccaggtatatgcccatggccagcacggccacatcttctttaagcaggtctttgatttcgatggtgtcgctcaattcgggccaacgttgcagcacggcgagcatgccgcccacggtgaactcgaccatgagatcggttttcaggtcaaggttcttggggtcgcgttgcaatgtgctgagcatttgcagacggcagaagtcgcgcagcgattcggtcagttcaagcgtgctgtgcgggcctgccaacagggccaggtggtcgaggcgctgacgctgctctggatcggagagcgtggcggtgacgcggtctcgccattgttcctcgggattgccgttcggatcgggggtgcggttgatcggaatcgattcgacctgatgcaggatggctgaatcggccaattcgggcaggctggagaagtgatagtagaacgaattacggttcacgccagcctcacgcaccacgtcggtaacggtgatcttgcgatagtcgcggtcggcgagcaattcccagaaagcgttctcgaggcgttctttggcgggcagcacctcggaatcatggcgtggacgtggcatctcttcctcctgatgcaccagcgtgatatggtcacgctgtctaataacttattgggcagtataactattatttgtggacatgtctatgagctaatcggcgatttcagttgcgtcctccgctgatggcgaagctgtggtgccggcatcggcatcagtatcggctctggccggagctgcgctatctgctcctgctgcagtttctgctgggatctcggctgttgctttggaggtcgcagaacttggtgcggaagccggggcgggcgtcggcttgcgtttggccgtggacgccttgaacagtatcgccagggcctcaaccaaatgacgccggtctgcgggggtcagcccaacgtacgcgccaagcatcgccggaatcgaagcggggaagttgctcatcacctcgctgaagctggtggcgccgttggcgtgcagcacggtgaacagcgcatccaccgcacgctcgcgctgttcgggcgtaagcgtggcgatccaatggttcagctcctcgttaaacaactgcgagctggaactcaaatccggctcggtgatgaactggtcaccatccaatagccaggtgaaggcggaatgctgcatgatgccatccgaatcggaagagaccacgcggcaaggctccggggtctcgaaaatcatgcccacaatcgacgaactcggcacgattttcgtcaccttcggctggatggtgcggtaggcggggctggtcacaatctccggcgggaaaccggggccatccagtgaatagacatgctgaatgcgcttgcgcaccttgggatcggcgttcatggccgcgtaaatcgccagattgcctcccttggaatggccgaccagaataatcggaccctcccacagtcgcgccaccatatccagataggcgctggctgaacgttgcgccggcaccggatactggaaagccatattgaaatcttccttccatccgatgagcgaatcatcggtgccgcggaaggaaataaccaacgtgcctttgtaggtcggctttcggcgcttgtggccgtcgggcagttggaaggtggcggcggcgaattgggtttgctcaccctgattgatgtgctcgaccaccgcgcccaggcgaacgttggcgtagcgggggttttcgcctgcggcctggaacaggtcgtgggtcaggtccgggttgaccactgaaaccatttgggcttcgtgcggcttgtcgtcggcatgtgtttccggcgaacgatgcagctcgcggttggcctcgtcaaggcttaccgattcaagctcgggatgccagatacccttcagccagatcagtggatgcttgggttcgaaagcgcgaatgcgtgcggcgaacgagcctgaccgcgtctcatccagcatcaacgtcggacagacactggccacatcctcatagatgagcgtggagatgatcaaggcgtcgatttcgttgaacggcaagtcggcgaaggagcgcgtttcggtgtgcgcgtaatcgataatgccggtcatgcgcacctcctgcttccgttgatattgcatatccccttgggctgcgtggtcttgcgatcgcgtgcggccgtgcggctgcgcgcagcaattaaccatatgcattccattgtagggattgtacggttttggccggcgcgatcgagcaagactgcaccgacggcgaacaattcgtggaaggattcccgtcggcttgtcgaaaattgtcgggtagcagggttgcgatgccagccagccgaccaccctccggcgctacgcgccatctcccgccggcgggagggttaaccactcaatcctttttgacgaggcggaccgctgggcccgtcaaaggttcggcagatcgaagcgcgccagatccacgccctcgagttcaagcaactcggccttgatgtcgagtcggccgccgtagccgccaaacgcgcggcccgagccgactacgcggtggcagggcacgatgatggtaaccggattgcgcttcactgcgcctccgaccgcctgcgcggccatgcggccgccgccgcgtcgttcggccaattcggcggcgagttcgccgtaacttaccgtcatgccataggggatttcggccaccagattccacacttcatgttggaatggcgtgccggcgggatgcaaaggcggcacctgatccgagccggggcgttcgccggcgaaataggcggtcagccattcgcgggttatgcggaatacgtcgggttcactatcggattcgcgattcgaatcgagaacggcttggtgatcggtggcccaccaccagtcttcaagacagagttcggtaagtccctcgccgtcggaggccatcatcatccggccgatgggcgtttcgactgtggcccgcatcagttgtcgttgcgtcataccgccattatcgcgcgttgagggatgaagcccataccgtgcctgattccatgaaggacggcacgtcggcgtagttcgggaacttcacttcggcgctcgataatcgttggaaaaccggtgggacacgcgggggcttggctttttcctgagattggcgtatctttgtcacctgttgcctgtgaaggtaacacatgcggacatagcttagttggtaaagcgcaaccttgccaaggttgagaccgcgggttcgagtcccgttgtccgctctcggatggttgattcatgctgattgattcgaccggatgatgacccgggcggttggcgcagtggtagcgcacttccctgacacggaaggggtcacaagttcgaatcttgtatcgcccactcgatgaatcgccggcagaatgttgccggttttttcatcacaggctcgggcgattggcgcagcggctagcgcacttcgttcacaccgaaggggtcgtaggttcgattcctacatcgcccacccgagattcacgctcgttggccatgtggccgcgagcgttttttcataatcgatgtattccgattatgccggtccaatcggggtgcgggctagaatgccgcggagccggcagaatggcgggattccgccgatgcaacctgtggttgcgcgcgaatatgcaacctgaagatggtgacgcggaactggtttgccgtggcatagtgagggcatcggccgaatatgtcatgatgagcattacctatgaagggacactccgatgagcttccgcgccaacctgcaatacctgcgcgcacaacgcaacatgccccaggaacagctggccatgttgctcggcgtctcgcgccaggccatctccaaatgggaatccgagaaggcctatcccgagatggacaagctgcttatgatctgcgacctgttcggttgcacgcttgatgacctggtacttggcgatgtgagtgcgagcgtgaacgtgggtgcggccgcgcgcggcgcagcggagggcgaccatggctcggctgccagaaccgtaaccggggagggagccggggaactcgcgtatatgaaggatgctgatgggaacatcggtgaatcagcgcggtccggcggtgacggcatcaatggcccgagctccgcaaatgcattgcccggcgaaatgttgcacggaaccagttcatcacgtcccggcacgctggctaatgtggctgccttaccgcaggatctgaccggctacgatgaacaccgctgccgattcgcgctactgattgccggcggtgtcgcggcgattatcgcgggagccggcatcggcaacctgttcgattccgataattccattctcggcgtgacgccactcaacgattttctgacattcctgggcatctgcgtgggcgtgattatcgggctggcgatgctgattccgggcggcatgtcacataccgacttcaaacggcggcatccctatgtcgaggatttctatgctgcgagatgtcgccctcggcacagagttgccgagggccggcaaatcactcccgcgtcgggtccttttgcaggagcaggaagacgagtgccgcgacgagcaggacggcgatggagagcacgccgagcgaggcgttgccggtcagggacgtggtggtggccaccaggaaggtgccgatgatcgaggcggtcttgccgaagatatcgtagaagccgtagtactcgttggcgtgattcttggggatgatcttgccgtagtacgagcgggagagcgcctggatgccgccctggaacatgccgaccagaatcgccagaatccagaactccacggccgacttcaggaagaacgcggcgaagaacacgatgcacatgtatgccacgaccgccgccgtgatcatcactttgcagccgaaccggccggccaaacgaccgtagagaatcgcgcaggggaaggccacgaactgcgtgacgagcagtgccaccaccagctgggtggagtcgatgccaagctcggcaccgtaggaggtactcatcgaaatcaccgtgttcacggcatcgatgtagaagaagaacgcgatcatgaacatccacaacggcttgttcttcacgattttgccgaacgtgcccgccagttcgctgaacgtgccgcgcacggccgagcccagctggtcacgggtggcgcgatagtgcacttggcggtagctggtaagcagcgggatggtgaatgccacccaccagatggcggtgatgatgaacgaggcgcgcgtgcaagccaccgtggaccagtcgaagagcgacgggccgccgaagatcagcgcgatgcagaagatgaacggcacggtggagccgatgtagccccagccgtagccatgcgaggagaccttgtccatgcgctcgttcgaggtggcgtcgatgagcatcgaatcgtagaacgttagcgagccgttgaggccgatggtcgccagaatgtagacgactaggaacggtagccaggtcaggggcagggccattgcgcagcaggtgaccacgccagtgccgaagaagccaaggaagaacttgattttcatgccttgcacgtcggcgatggagccgagcaacggcatgagcagcgcgatgaccaaggaagcaatggtttgcgcgtagccccaggcggacacgatgttgccgtccgccggcatcagcgatttggcgtaaatggggatgacggcggtggacagcagcacgaatgccgagttgccgacgtcgtagatgatccacttcttctcgcgggcggtcagtttggcgctttgcggcaccggttcgtggacattcgtgggatcagtcatatacactcctcgacagtattcaactcaatctatcgtagaagcgcggactagggtaggggagccattccggttgaacggcggatgaataatgccgggcctctttctaaggggagccagagcaaaaatagctcccctcgctgaggggagctggccgcgaagcggactggggggagctacctatagtcgactattcgccgatcagcgcgatggcctcgtcgtaatcggggcattgcggcacgccgttgaggctgtgctggatggcgatggatgccgccgcgttggcgatctttaccgattcggccagactatggccctttgccagcatcgcgcacatcacgccggtgtggcaaccgcccgccgaacgggtgtgtacggccttggtcgggtatccctcgatatgaatcgtctcgccacctggctcacgaatccaagcgccgcgggcgccgacacgcaccaccagcggcgcgcgcagtgtagcgcccaagccgtcgcacaactggtgcatgaagtcgtcaagtccgccgccaatggtgactttgctgtcgtcgattggcgcaccaagtcgctcggccagcgtcatggcctcctgacggttgcaggaccagaccgggcgtgcgagcaccaggtcctcaagcatatggtcgttgaccaaacgcaacgtattggtggggttgatcaccagcgtgtagtcgcgtgcagccgggtcggtaccggccttgagcaggaatccgtccacgccggtggccgtgtggtccatcagtgtgttgccgctgatgtgcaccacgtctttgggctgcggctccagcgtgtcgaacgtgtccgagtcgccatgagcctcggcgccataggaagcgatgaatgtcttcttcggcgcgccggagctcagcaccacgcggaagccggaatcctcatcaagacgatcctggccgatatgcgtaatgccgttgtcttggaatgactggcggatgaaatgcgcccacaggccgttgcccagaatgccggcgtgctcggtcggcacgcccatgcggctggccgcctgcagcacgcgatagctgccgccaatggagggcttcggatgatcggccacggcgaatccgccctgtgccggcaccttgtccacattgagcataatgtccacccagacttgccccagtgaaatcacgctgggctcgtgagtgccgatacctcgcttgagattcaacatgacagcctccttcgtcgtaagttgcacgaggaccccttcgtcccttgccgtctcttataccgagattatatgagagtttgctggatgcggaaaaggaaggccggcgtgttttatcgggtaaacgctatgatttgcagcgtaattcgccgctggcgaactgctgacgaactacttgcggaccgctggcgaaccaatgccgagccgctcgtgaaccgctgatggcccactcgcaagttacgctcgaaccgcgcgtgaaccgccgaggttcgcccatgatacacgcaagagttgcggttgtcggtattgggctatatatttgtgaagttgtgtgttcggcatgtcgggtgaaaccggcggtcgaatgcgtgaaagacttgacacatcaaggttaagggagtccatcatggcagctcgttgcgcagtgtgcggcaagggaccgcagaccggtttcaccgtttcccattcgcaccgtcgtaccaagcgtagcttccgcccgaacctgcagtctgtgcgcaccacgattgatggcgagaacactcgcctgcgcgtgtgcgtcaagtgcctcaaggctggcaaggttcagcgcgtggccgcgtgaatcgcgtactaacgtggagcaaaacccgtttgagcttcggcttggcgggttttgttgtttctgcggcctaaagaggccgtgcgaatagaataggccaatatgagcatcactatgggcaccactctcgcttcgctggtcaccaacaagcgtcgcgtgtccgcgctcaaatcgctgggaatcgtcactgtcggcgacgccctgacctactatcctttccgcgtcaccgaaccggtgccgcttcgcgccatccgcgaggccgcacccggccagcagatggcatttgccgccgtgatacgagatatgcgcgtggtgccgatgaacgctcgccgcggctaccgactcgaagcgacggtcgatgacgccgacttcgcccggtctcgtcgcgtacccggcagtacggcccggctcacgttcttctcgtatcgtaaatcgtatgtggattgggtcagcgtgcgactgcgcgccggcacgtctgtggtggtctccggtatgcccggcgaatacatgggtcagctgcagttcacccatcccgaaatcctcactgtcgcgcccgtgccggccggagcaggagcggggcttgagggttacgctcggggcgcggcatccggcaatggtgcgtttgcgggaagtgccgatccgtatgccagtgcgcagtccgcgtatccgccggccgcgactgccccttccggggccgcgttgaaatacgacgccgataccgtgcaagaggcgcttacccgcgtctgccggccccgcccggtatatcacgccagttcgcgtatctcgtccgaacatattcatgagacgattctgggattgctgtggatgatgggggcccgcacgtcatccacgcctgacgggcaactcgctggcgctggggcagccggcattgtggctcccgcgactgacaccatcgccgtccaaaacggggaagagaagtccggcacgaccgccgaatccggtgctgaggcgctctcccaatccatcccagatgtgctgcccgaatcggtgcgcaaggccaagaacctcatgcatcgggctgaggcgttcctggccattcatgatccggcctccacggcccggttcaaggaggccatcgaaaccctgcgctatgaggaggctttcgtttcgcagacctcgctgctgaagtctcgacagcacgcgcacaagtcatcggcgcatccttgcccgctgaacgaggcgctggaaacagctcgagcgtcggtgggcgaagcggttgcggagccaagtacgcaaccagaagcatcggagcgcggttctgcgaccgatctgcctgatctgcccaatttgcccaatttgcgcgaccgcttcatcgcatcgttgccgttcacactgacagccgggcagagtcaggtggtggacgacatcgcgtccgatcttgaacgtgactggcccatgcagcgtctgttgcagggcgaagtcggctccggcaaaaccgtagtggcgctcgcggccatgctgcaggcggtcggcgccggctatcaggcggtgctggtggctcccactcaggtgcttgccgaacagcattacgagaccatcagcaagatggtgtcggggttgacccttgcacagccgggtgccaaggagaccgatgccgcggccgacgttgagggcgcgatgggcgcgtccggtgcttcgacggtctcttcttccaaggtgactgcggaaattcccgtcaccctgctgaccggtggtatgaagcttgccgcccggcgtaaggcgctcgctgcggccgccagtggtgagccgggcattatcgtggccacgcacgcggcgttttccaagaccttccaagccccgcacttggccttggtggtgatcgacgagcaacaccggttcggtgtggaacagcgcgaaagcctcaacgccaaaaccgatgacggcaccacgccgcatctactggtgatgaccgccacgcccatcccgcgcaccgccgccatgacttggtttggcgatctcgatatttcctggctcaccgaattgcctggcggccgcaaaccgattcgtaccgtggtggtcaatgaggccgacgccgccaccatggggcgtatgttcgcgcacattcgcgcgcgagtcgacgcgggggagcgggcctatatcgtgtgcccgcgcattgatgcggatgatgaggagaacgaaggcggttccggcgtttcggcagcagccggttctgcccgcggacgcgccgcagcatctggttccagtgcccgcacagctgcgggcggccgtgcgacgcgcgcggcggccgatgccatcggcatcgacgacccctacgaaaccttcgacgaaaatggcgaaaccgtggctcgcccgccattgcatgcggtggccgaaatcgccgaccggttgcagaaacttccacagttccaaggcattcggtttgcgactctgaccggccgcgacaaggatgacgtcaaaacccaggtcatggccgattttgccggcggcgagactccgatcctggtgtccaccacggtgatcgaagtcggcgtggacgtcaagcaggccagctgcatcgtcatctttgatgccgaccgatacggcctctctcagctgcatcagctgcgcggccgcgtggggcgtggcggcaccaactcgtgggcgttccttatttcccgtgcggaacccggctccccggccgagcaacggctcgaagtgattcaccactcgctcgacggtgccgaaatcgcccaagccgacttggaattccgcggtgccggcgatgtgctcggcgacgcccaatccggcggcaagtccagcctgaagctcctgcgcgtggtcaaggacgccgacatgatcgccgacgcccgcacccgtgccgggcagcttctggccgccgactccgaactggcaggtgaggtccaactcgccggtgccgtcctcgacttcacccgaggcaacgaaaccttcctgacctccagctgaggcacctccagctgaggctagggctgcgcccccgtaatcgcacgatatagtttttccgtatgccgatcgtgaggaaatcacggtcgggaagccctcgaatgtgcttcagtggaggcaagaccattcgtacatgaggtactcgaagtgcatatatcattggtgcgcttcgagcaccccattgttgttcatgattggtatgcgcagatgaacctgtacagtgaaagctatgcgtgtaatttctggacgattcaagggtgtggcgcttgctacgccgaaaacgggtacccggcctaccacggatcgcaccaaagaggcgattttctcgcacctcgactcatggggagtgctggatgatgcccgtgtactggacctgttcgccggtactggtgcgttgggcatcgaagcgctgagccgtggcgcgcgagaactcgtggccgtggaaagttcccggcctgcggcggcgctgattaccaagaccttggcgcagctacagaagaatcgttcgtgggatgcttcgctcaaggcccgtgtgctggtcaaaaaagccgagcaagtggctggcggcttcggcgaaccattcgacgtgatattcatcgacccgccctatgcctatgagaccgctgaatgcaatcagctactgtccgatctggcggcgggcagcgccaccaacgagaacacggtgatcatgctcgaacgctcggtacgctcggatgatcccactgcccccggaggctggcaaatcaccgaaagccgcaactacggcgaaaccgccgtcttctacatcgaatccgcggatgacgactcggatatagagcgttccgacgattccgccgcgtagtgaatctcccaccgtgtggtgaattaatcggcgagccggcgcggatgggcggcggagacctcccagcccaaggccatcagggtcttgcgatcggccttatccagcgccttgcaatccagtgccgcgataaggtctggccgaatctcggcggtgcgggccagcgcttcgtcgcggcgaaaacggtccaccttgccgtggtcgccggacaacagcacatccggcaccgcaataccgcgccacacggccggcttggtgtactggcgatgttcaagcagtgcgccctcgccggtgtaggattcctcaacaatcgaatctgggttgcccatgaatccgggcatcaggcgggtgatggcctcaagcatcaccgataccgctacttcgccgccgttcagcacatagtcgccgatcgaatattcgcgtacgtcgacgccttgggcgcggtagtagtccgggatgcgcgcatcgtagccctcataccggccgcagccgaacagcagatggtcggcatggctgagctcggtggcgtcgcgctgggtgaacaacggggccgatgggttcgggaagatgagcaccggtgcgccggatggggcgggggagccggacggctgcgagaatcccagcagttcgtccagacattcgctccacacttcgggcttcatcaccatgccggccccgccgccgactggcgtatcatccaccgaatgatgcacatcgtgggtccagtcgcgcaggttgtgcgccttgatctccaacaatcccttggcctgggctttgcccatcaggctgaggttcatcacctcaaagtattcggggaacacgctcacgatatcgatcttcatgtcatccagcctaacggtagcccctcccgcattacacggccaccactacactattacggtgatgaatacgacgatgaacctccccacccgcaaaaagcccgaagtgttgtccccggccggcaacctgaggggcctgaaaaccgcggtcgattatggtgccgacgccgtctactgcggcggcaaagccttcggcatgcgatcggcccccaaaaaccttagccttgaggatttcgaggaaggatcgcgctacgcccatgaacgcggcgctcgcgtgtacgtgacctgcaacgtgctgccgcgcaacaacgagatcgaagccatgcgcgagtacgtcggccagctcaaagacaccggcgtggacgcgctgatcgtctccgatattggcgtgatgatgatggcccgtcaggtggctccgaatctggaactgcacgtctccacccaggccggcgtgactaattatcaggctgcgaacgccttctacgagcttggtgctcgccgtgtggtgttggcccgcgagatggacttgcaggccgtgcgtgatattcgcgccaacattcccgatgacctcgacatcgaatgcttcgtccacggtgctatgtgcatggccttctccggccgctgcctgttctccaactatctgaccggccgcgatggcaatcacggcgaatgcgcccagccatgccgctggaagtattcgatcgtggaagagaagcgccccggccagtacttcccgatcgagcagaccgagaacggcgcctatctgttcaattcgcaggacatgaatatgctggggcacttggatgatttgattgactccggtgccaccagcctcaaaatcgaaggccgcgcgaaaagcgcctactatatcgccgccatgaccaacgcctacaaaaccgcggttaatgaatacatgattcaacgcggttttgaagacgctgatggcaatgttttgaagcctttccatgaccgtgtgattcgcccgggcgaccccgattttggccaaggaaccgaagatcaagtgatgcgcaatgctgatgccgcgttcgccggtgtggccgatgagggatatgaccgtggctctgatactgcggttgccgattcggtcaccggctcggttgccgcagaacgtgaccgcgtgacggttgctgatgccgtcgactcaactgcctctggtacgccggccggcaccgccgtcgaacccgacggcatgagctctcacgcccgttccacgcgccgcaagtccaacaccgcggtcgaacagattgagaccgattggaaacatgcggccgttcgcccggccccacacgtcgaactgcccgaatggctgctcgaggaaaccgacaaggtggcccaccgcgactactccaccggcttctattacccggagcacaaggtcacacagaacaccgaccgctccgcctacttccgctcatggctggtagtgggcgaagtgctgagctggagcgcggacgaagacggacgtgtcacgctgatgagccgtaacaagattgagcccggtcaacaggtcgaattcctgctgcctggcgagagaccattggtctttaccgtgccggaaaccggcctgcgcgatgccgatggcgcgccagtacccgccatcaataatccggcgcacgtgttctcgatgccctgcccgcaccaggtgcccatcaacgccgccatccgctcgcgcaccaaaaagcccaccctcaaagccgaataacctaccactccgcccccgctgactgggggtggtcatgaaaatcatgaacaccgcccgcacccaagaaagaatgccttatgcctgaatacagcgaagaaatcctcgattccaacagcatcagctctaccgataaagccggtcgccctattccggtgaccatccccatcgcactggcccccggcatcaaggtggtgtacaccacgcgactgggcggcctgagcaccggcgattacggcaacctgaacctcggcggcaagtccggcgacgaacctgaggccgtgctgtcgaaccgcatcgcactcgccgaagcggtgcaagcccgcctatcgctggtctcccaagtacattccggcgtggctgtggacgtggacgactcgttcgtcatcaacacccccttcggcttcgacgtgtccggcacacatggtgagactgacactccgcacgtcatcgaggcggacggccaggtcaccgcacaatccggcatcgccctaggcatgttcgcggccgactgtctgccggtgctgctgggcgacccggtcaccggtatcatcggtgcggcccactgcggccgtcgtggtctggagcgcggcgtgatcggcaccacggtggacctgatgaagagcaagggtgccgacccggcgaacatcgtggccacactcggcccgcgcatctgcggcgactgctatgaagtgggcgacgagatcgccgaccagttcatcaagcgcttcccgctgaccaagacgaagacccgtttcggcggtgccggcatcgacatcgccgaagccgcgatgatcgacctcgctttcgccggtgtacatcaggtggtcgattcgatgccgcgcgtgcacgccgccacccagtaccttgaggaagacccggaactcgccgaactgtgccgtacggatggcgaaggcccggccgagctcgcggagcgcatcgacaacatcagccacagcatgtgcacgctcgaaaacccactgtggtactcgcaccgccgcgccgcgctcgccaacaaaacacacgaaggccgcctcctcgccctcatcgtgcgtgactaaacggagaatgcgagcacattccgtggagaagatgtgatgcagttcacggacggccagccctcaccctacggtggtgcctatgactgagagagatttcgatacccccgtcgagacgcctaccgtccagccggcccccgctcagggcgccaaaccggcgcaaaccgtgccggtggtggccgtggtgctggccgccggcttcggtacgcgcttcgaccccgataatcccaagcagcttgtctccgtgggcggcaagcccatcgtgtgctggagcattgatgcctttgaacattgcgaccgcgtcagcgacatcgtggtggtggtcaatcccaaggtgcgcggtgaagtggaaacgttggttggcgagatgggctacaccaaggtccgcgtcatcattgacggcggtgacgagcgtgtggacagtaccgccaccgcgctcgacatgctggctacggctggcattccggacgatgccaagattctgatccatgacgccgtccgtccgttcgtggaacagtccgccatcgacggttcgattgatgcgctcgaccagttcacggccgcgaccgtggcctacgcctcaaccgacaccgtgctgttgaccgaggatctgggcgatttgaaagtggtcaagtcggtgccggaccgcccgaacaccttccgcgcgcagaccccgcaatccttccgcttcgcgacgattcgtcacgcttacgatttggctgccgccgacccggacttccatcccaccgacgacacgcgcgtagtggtcgattatctgcctgatgaacccgtcgccattgtctccggtgcggaaaccaacctgaagatcaccacgctggaagatattcccacagctgagcgtatcgccgaggagattctcggtcgtgatcccaaggaagaggcccgcgcccgcatgcacgccctgctggcccaagcggccggccagatgcatcgctagactggcattatgcgtgaactcaatgttgtgatctccggcttcgaccactatgacggcgtggaggtcaatcccgccgtcgaagtgcccaaggccatcgccgagcagggactgggcgtctcctctgctccggacgatccgttggagcaggtcgccgtcaccgttcatgctgtcagcatcccggtgagcttcgccaaagcctggcccacgctgaaagagacgattgaggccaccaagcccaatatcgtcatcgccaccgggctcaagcacgcagcccgaggcgtgatgcttgaacgatgcgccaccaacctgatggacgcgatcaagccagacgcggacaacgtgatcccacgccgcgaacccatcgatcccaatggcccggccgcctattggacccgcctgccgttgcgctcgatcctgaatgatttcacggacgattcgattccggccaccttgagttcggacgcaggtacgttcgtatgtaattcgctgttctacaacttgctcaactggaccgccacccaggagcaggtgctgggcggattcgtcagcttccctccggtcgttccggcgcattccagccagcatggtctaccactcgaccagcagatcgccgctggccgtgatgtggtgcgcgaagccgtgcgctactatctcaagccctccagctccgacatcctcatcgcctagcacgctgtgcgccacgccggaatagaacatggttcgcacgcattgtaacgattgcgcgtcgctcaacgctcagcgctagtgcgatgcgctacagtgcttcaaggatgtgccaagagctttatgcgtgtgcgaaaggaataaacagcgatggtggatcgtttcccggtggtgctgcgaggatatgacaaggagaaggttgatgctgccttcgacgctactcaggagagtatgaagcgtgcgcagcagacgttggccagcatgcgtgagcagattgcggcggatgacgaccgtattctgcaactgcaggcccaacttcaggaagagaagaacaagaagccggaaggcaacagcttcgcttccttgggagcgaacgcccagcagatgcttgcctccgccgaacagacgagtaccgaactgctggaacgcgccaagcaggacgcgtcctccatccgtaccacggctcaggctcaggccgaaacactgatcaacaacgccaagctggatgcccagcatattgttgacgacgccaatgccaaggccgcctcgattctgacgaacgccagcaatcaagccgaatcagtgaccacctccgccaacgaggatgccgcacaactgcgctccgaaactgccaagaccatcaccgaacagcgtcagaccgtcgagcttgagctcagcaacgcgcgcgaagagcacactaagaagatggcttccgaacgctccactcaagagcgcgaaatcgccgacatgaaggcggaggcgacccagcaggttgccgcaatgcgcaaaagcgccaatgaggagatcaccaagcttaagtctgattccaacgatcagattgaggcggcgctcgccgaggccaacaagaagctcgccgacgtgcgcgagcaagtgtccaagatgatgaccgaagcccagcgcaaggccagcgaaatcattgatgcggccaaaaccaagggtcaggaaatcactgatgaggccgaggtcaagcgcaccagcacgatgagccaggtcaacgccgaggtcgagcagatccgtcacgacatcgccgctcagcaggatgaggccacgaagaaggtcaacgaactgctgcagcacctcgaagagcgtcgtgtggcggccaagcgggaagccgatgagttggtcggtcaggccaagaacactcgcgaccaagccgattcgtatgccgcgtccaagcgcgaggaggcggacatccaggccgccgcaatcgtacataaggcgggcgaggaagccgatgcgcagatcgaggagcgtcgcgccgccgcccaaagcgagcttgacggtctgtccaagcgcatcgccgatctgcaggaacgcgagtccgtcatcacccagcgtgtttcggaactgcgttctatgttctcgcaggcgttctccggattcgctttcggcggtaatgcggcggcctctggtcaggatcaggaagccgctgccgcggcggcattgccggtggttgcgcccgtcccggaagtcaagcctgtacacaacgaggccgatgaccagccgggtgagttgagcggaaacgagtcggctgccgacgatcacaatgagacagatgcggcaccggctgattcggctgattcggctgattcggctgcgcagaatgagcagtccgaatcgtctgagccgtccgagcaccagacacagggcgaaccggaggccccgactcaggagaatccggccgtatctgagcagaacggcgaatgacaggccttcgattagactactagcggtaagaattacggcacctgcgctttcgagccaggtgccgtattcgtttgaatctgcgccacaagcgcaccatcacagaaggagtatgacatgagtgaattgacgcctctgaccgacgaagcgttgaataccctgcgcggcgatttcgcacagagcggcaccaaccgtctggccatgaacgcggtgaccgccgccggcatcgacaaggtggctcgcaattatgaccgcgctcgtctgatgcagcgtcgtttctccaccatcgttgacaatggcgaagccacccatcaggatcgctccggccgctgctggctgttcagctccctgaacgtggcccgtttcgtggccaagaagaacatgaacttgaaggagttcgagttctcccagaactacgcgatgtactacgacaagctggagcgcgtcaactacttccttaaggatgtggccgctctggtggctgccggagagccttccgactcccgcctgatgcagcacctgctcgccgacgtgatgggcgatggcggccagtggaccatggccatgaacgtgtacaagaagtacggcgctgtgcccaaggacctgttcccggagaccgaatcctccaagaacaccggtgaaatgaacatccagctgcgccacatgctgcacaccgccgtggcgcacatgtacgccgctgacggcgatgcctccaaggtcgaggcgattattgccgacgccactgctgccggccaccgtattctgaccatccacctgggcgagccgccggtttccttcgactgggaatggaccgacaaggatggcgaattccaccgcgacggcgagattacgccggttgagttctggaagaagtacgtgggtccggctgatcttgaggactacgtgtgcctggtggacgatccgcgcaccgagcacgccaagggcaagaagatcggcatcgagcacctcggcaatgtggctggcggcgacgccaccgagtacctcaacgtgccaaaccagttcatgaaggactgcgtcaagcagattctcgttgagcagggcattccggtatggttcggtgccgactgccacccgttcatggaccgtgagaacggcgcttgggccaccgacctgttcgagtacggccgcgtgtacgacgtggacttcgatttggacaaggaagcccgcgtgcgcttcggcgactccgccatgaaccacgccatggctttcgccggcgttgacgtggccgacgacggcaccacccgccgctggcgcgtggagaactcttggggcgccaagatcgccgacaagggctacttcaccatgtccgacgactggttcaccgaatacgtctacgaggtagccgtcccgaaggccctgttgcccgaggaataccagaaggccctcgaagagccagccaccatgctccccgcatgggatccgatgggcgctttggcctgacttcgtcagcctcccggaatcggcctgacggccaatgctgtgttttctcgcagcctgtcggctgctagggtctctccctctgtcagcgcgaagccgctgacagagggagagaccgcggtcgcaggccgcacaacaacacagcatcgccgcaggcgagtccacacaggcgagtccacccaaagtccataactgccggcccaacaagcagtccccgtaacaaactgctatagttgggcttttgcgtctatggcgacataccgacagtacgtatacaaggaaaggagtcgagcaatggcagcactacgtggtccggatagttccgaggatgaacgtcgtttgggggagcaggccgtctttcctgagaccgtcgatgtcaacattcgtcagcttgaccccattcccgcgccgcgtgctttcctcagggagcagccgctcaccgatgagatgagcgagctcgtgctccactcgcggcaggaaatccgcgatgtgctcaacggccgcgacgaccgactgctcgtcatcgtgggcccctgctcaatccacgacccgaaggccgcgcacgagtacgcagaaaagctggctgccgtcaagcgcgagttggaagaccgactcgtgatcgtgatgcgcgtgtacttcgagaagccgcgcaccaccatcggctggaaaggcctcatcaacgaccccgatctggacggtcgcttcaatattcgtaagggcatgtggctggcccgcaaggtgctcaccgacgtgctgagcctcggcctgcccgccgccaccgaatggcttgaccccatcaccccgcagtacatctgcgacgcgatcagctggggtgccatcggcgcgcgtaacaccgaatcccaagtccaccgcgaactggccagtggcctgtccatgccggtgggcttcaagaactccaccgacggctccatcaaggccgccgccgattcctgtttcgcggccggcttcgagcatcacttcctgtccattaacttggacggtcgcgtgatttccgccgaaaccaaaggcaacccggattgccatctggttctgcgcggctccagccacggcccgaactacgatgccgaatccgtgcgtcaagctctggaagacctcaaggtttccaaagcgtccggcccgagccagcatggcctcgtcatcgatgccgcccacggcaactgcggcaaagacgaaaaccgcgaagccgaagtcatcgaagagatcgctgagcgcctggcgcacggcgaacaaggcatcaccggcgtaatgatggaaagcttcttggtcggcggtcaccaaaagccggccccgctcgaccagttggtctacggtcagtccgtcaccgactcttgcgtgccgtgggaacgcaccaacgaactgctgcacaccctagccgacgccgtcaccgctcgccgctcggctaaatagctttgtctttgtaaaaatgctcactgagacccactcagtgagcattttttgccaataacggtggtcatgtcagtttgttcccgtgacaccttatccttgggaaggatactgacccaaggagagatgttatgcagcagcaggaggaagcagcacattcgctgcatccgttgcaagtcggtccgcagccgttgaacaccccagaagagcttcgcgccattcgtcaggcgatgggggaggggaagaacccgctcgttgccactgatgtgccgcgttgggaagatcaggtgggtgtcagtcgcatcatcaaccgccgcgtattggagttggagccgctgcccacgcccgcgcaagtgctcgctgaactcccgctgactgatcaggctcaggaaatcgtcgcctactcgcgtgatgagattcgcgcgtgcctgtacggccaagacgacaggctgttggtcatcgtcggcccctgttcggttcatgacccgaaggccgcgctggactacgcgcgccgattggccaagctgaaagatgagctcggtgaacagctgctcatcgtcatgcgcgtgtacttcgagaagccgcgcactaccattggctggaagggcctgatcaacgacccggatattgatggcagccacaatattcgcaagggcctgttgcttgctcgcaaaaccttgcttggtgtgctgaaggaaggattggcggccgccacggaatttctggagcccaccagcccgcagttcatctcggacgcggtgagttggggcgccattggtgcgcgcaacacggaaagccagatccaccgccaattggccagcgggctttccatgccggtcggctttaagaatgccactgacggctcggtgaaggcagcggtcaacggttgcttcgccgctgctcagcagcacacgttcttcggcattgaccatctggggcgtgcctgcgcagtcgagacccttggcaacccggactgccatgtggtgttgcgcggctcgattcacggcccgaactacgatgccgaatccgtggccaaagccatggaagacgtacgcgccgaaatgcccgccgaatccgcagcctcgcatggtctgattgttgattgctcgcacggtaactccggcaaggacgaacatcgtcaggccgaagtcgtgcgcaatattgccagcagaattgcagctggcgaacagggtattaccggcatcatgatggaaagctttattgaaggaggcaatcagaaggccgcgccgcttgatcagctggtctatggcaagtcgattactgacaagtgcatcagctgggaagaaaccgaggccttgctgcgcgagcttgcggaagccatagccacacggcgttggcactgagttgcgtcatcggctctctcgcgggagcaatgcaacgaaacgtctctacccctcagcctgccattcggcggccacctcccctgacaaggggagccgaaagtgttgtgaaaggaacttacgtatgggtatgaaaactgtagctattattggcgcattggatgaggaagtggcgctgatcgccaaatcgctcacgcatgtgacgcacaccgccaagggcagccttgacatcgtgtccggcacggtcgactccttcggttctgacgtcatcaaggttgccgcaacggtaggcggcatgggactggtcaatgcggccgccaccacgcagctgctgattgacgagattgccccggacgccgtgattttcagcggcatcgccggcaacctcaacacccacctgcacatcaacgacgtggtgctcggcggcaccctgcgctacctcgacactgacatgcggctcgtaggccagtggaagcccggcactgcggacgctccggtggaggaattccactctgatgaccgtctgctggaagtcgccgacgaggcgcttgccaatgcgggcattacccacatcaccggcatcatcgcctccggcaactacttcgtggacacgccccaaaaggtcgaggaggtcatccgactcaccggggctgacgccgtggagatggaaggcgccgccgtggcacaggtcgccgcccgcaataacgtgccggcactggtgattcgtgccctttccgacaacgccgacaccgattacgaggtattcaaggagttcgacatctccgaatacgccgataccgccgcccgtctggctgtcgacatcgtcaagcgcctgtaactggtcacctccaagttcggcgttgccggtgtgggctggtacatggccatcatgactgccctcgctctgctcgctctgttcctgatcaaggaaagcaaggacaaggactacgagctgtaaatagagctccccatattatgctcccgccagcgggagcattttgttatgtcgtcccgccaaaaatgaacaatagacgaacttacgtagtttaggcatctcactacgcctcgcacgttttactctggaaatcatggatatctggcagatcgtcgtgattgtggtgctcgccgcgctgatactggtgtgggttgccgtcatcgcctacaacaaaggccgcgtttcaggccggctcgccgccgaacaggacctgtccggcgacgaggatacgcattctctattcggtgatgatgcgcccgtgcgccccaccgagcgtcgcctgattgaagtcctgcccgaagccctgatcgtcaccgaccgcaacggtctggtccaatattcaagccccggctcagtgccattcggcctagtctccggcgaccgactcaactcgcgtgaagtcgaggacatcctcactcaggccgccgccgacggtggcatgcgtgagcgtgaggttcagctgccggtcaatcgcaattcctatccgtcctctaatggccgaggactggaggccggccagtcacgcccgtccaacacgctgtatttgcgtgtgcgcattggcgatatcggcgatgacctgtacgccatcttcatcaacgacatgtccgagcagcgccgtttcgaggccgtccgccgtgactttgtgaccaacgtttcgcacgaactcaagactccggccggtgccatcgcgctactggccgaaaccgtgaccgacgccgccgatgatccggacgccgtacggtatttttccggccgtatctccaaggaatccgcgcgcctgaccgaactggtgcatcatcttatcgacttgcagaaagcccaaagcccgcaaagcgtgatcgatgcgcggcgcatttccgcgctggatgtggcacgcgccgccatcgccgccaatcagacccaagccgactcccgccatgtggatatccgactgagtgtcaacggacagtcagtacccacgaaggtcgaggagccggccgatggcgaaggttccttggaagaatcaggcagcccagccacgaacggtccgatgatcaaggccgacaaagaggccatgcaaaccgccgtcaagaacctcgtagagaacgccatccattactcgcccgaacacaccactgtggcggtcggcgtgggggagcgcgatggcaaagtcaccattcgcgtggtcgatcagggcatcggcatccccgccaaatcgctggaccgcattttcgagcgattctaccgggtcgacccggcccgttcgcgcgagaccggcggttcgggactcggcttggccatcaccaagcactgcgtgcaggagaacggcggtcggatttcggtctggtcgcgtacgggggaggggtcgacgttcaccatcgagctgccggccgccccggatgaggatgacgacgaggcccggtcggacgagtcgacacaagcgtagggccttggttggtgcccgacatggtgccattccattgccacacaatcacacagtgggcgaggtgcgcacaccgcgcgtagcccaattacgcaattacgtactttcgggaaacagcaggctaacggagaacaaatggttacgataatgtcggaaaactttgcgcctatgcgcacgggaacatacccaagaaaggctactatgacacgcattcttatcgtcgaagacgaggaatcctatcgcgagccgctggtataccagctcacacgcgaggggtacgacgtgtccgccgccgccactggcgaggaaggtctggaactgttcaccaagggcggcatcgatttggtgctgcttgatttgatgctgccgggcattgacggcactgcactgtgccgccgcattcgtgagcagagccgtgtgccgattattatgctcaccgccaagagcgccgaaatcgataaggtcgttggccttgagattggtgcggacgattatgtgaccaagccgtactctttccgtgagctgctggcacgtattcgtgccgtgatgcgtcgcaatcaggccactgcccaggcttccggcactgtggatgacgatattccgctggtgtgtggcgatatcgccatgcaggttggccagcatcaggtcaccgtacgcggcgaaaccgtgttcttcccgctcaaggaattcgaactgctcgaatacctcatgcagaacaagggccgtgtgatgacgcgtcaccagctgatcgaccgcatctggggttcggattatgtgggcgacaccaagacgctcgacgtgcatgtcaagcgcgtgcgctccaagatcgaggaagatccggcgcaccccaagtatctgactaccgtgcgcggtctcggatacaagatcgatactcccgcggagtaaatggaaggcggccttcgggtcgcctttttttgttgtggattgtgggctcgctgtggactcgccgcaggcgagcccgctccaaaaactacgtagcctcaacgtagcccacaaacatccaagtgttcatcttctgtttactgatttcggttttgggcccttgaaaccaccaatacgcttgtagttgtcatgaattgaccgggcagcgctgagccgcccgcgaatagttgatagagggattaagtaataatcatgcagaagaacatcctcgttcgctccattgccgctctgtccggcattgtgatgctcgcttccgtggccgcctgcggcgataacaccgccaccacgaccgacaacagctcctcctccgattccacttccaagtccaccccgatctccggcaacttctcgggcgccggcgcctcctctcagcaggccgctgttgaagcttggatcgccggcttccagggcaccaaccctgaggccaagatcgcctacaacccgtccggttccggcgctggcgtgcagaccttcctgaccggtgccaccgcttgggccggctccgacaaggcccttgccgatgacgaagttgagcagtccaagtccgtgtgcactgaaggcaccgccttcgatgtcccggtctacatctccccgatcgccgtggttttcaacctcaagggcgtttccgatgccggcaagcacatcaacatggacgctgccaccatcgccaagatcttcgacggcaagatcaccaagtggaacgatccggccatcgccgatcagaacaaggacctgaagctgcccgacaccgccatcaccgtggtgcaccgctccgataagtccggcaccacccagaacttcgtctcctacttcaaggacgtcacccctgacaactggacctacgacctctccgagaactggccgaacgaggttggccagggtgccaagggcacttctggcgtgatctccaccgtcaagcaggccgacggcaccatcggctacgctgacttctctcaggtcggcgacctgggcaccgtggccgtcaaggtcggcgacaagtacaacgagatttccgccgaggccggctccaaggtcattggggattccaagcaggacgacaccgttaagggtgacaaccgcatcgtcatcaagatcaaccacgccaccgaggccgagggcgcttacccgattgtcctggtctcctacgacatcgtctgcccggcctacaaggacaccaagcaggctgagttcgccaaggcttggctgacctacgtgacctccgacgagggccagaaggccgctcaggatgccgccggcaccgctccgctgccctcctccctgaagtccgagatcaccaagtccatcgaggccatcaagaccaagtgatgacgtcggcccgcaagggtcgtgtggactggacctgacaactgaacgatagactgtagtagtaagagcagtcgccgccaactttaagccgcagtcgtaaaccatacggctgcggcttaaagcgggtcaggacccgaacggtttggcaacgtcacagacgaaaaccgcaccacttgaatacttgataaccaccctatataaggagaatccgtgagttcgcaagacaaaacggctgtgcagccagttggtggcaagaccgccgacaaggtgtttcgcggtgtggcatacgcctgcggcatcctgatcctggttgtacttgccgctgtgttcctgttcctgttcttccgcgcctggccactcatcggtggcgatcaggccgccaacagccagaccgtgtccagctttaccggcggcaaggccagcagcttctggggctacgtgctcccgctgttgttcggtactgtgctcgtgtctttgctggcactgctgattgccttcttcgtgtccatcggcattgcgctgttcatttcgcattatgcgcctaagaagctcgccaccgcgctgagctatgtggtcgatttgctggctgccatcccgtccgttatctacggtttgtggggcggcctgattctggtgccggccatctacccgttctggaactgggttgccaaccacctgggcttcattccactgttcgagggcccggccgccaacccgccgcgcaccgtcgccaccgtggctgtggtgctcgccgttatgattttgccgattatcacctccatgtcccgcgatatcttcatgcagaccccacgcctgcacgaagaggccgcgctggcgctcggcgccaccaagtgggagatgattcgtctggccgtgctgcccttcggcaagtccggtatcgtgtccgcctccatgctggctctcggccgcgcgcttggcgagacgatggccgtgttaatgatcctgtccccgggcctcaactactccatcaagctgctgcaggcctcgcagaaccagaccatcgccgcgaatattgccgcacagtaccctgaagccaacgatctgggcgtctccacgctgatcggaactggtctgattctgttcctgatcacgttcgtggtcaacttcatcgcccgtaagcttaccgagaaagcgactgcgtgatgactgctgctgagaacactgaaaagactccgatggacggcgcgcccgaaatcgacttcgatcgtttccgcccgacccgttccgccatccagcgccgtaatatcatggaccacttcatgtgggtcctgatcgcggtggcgtttgtgatcgcctgcatcccgctgatctccctgctgtggaccactatcgtcaacggcatcaagcgcctgaacctgaacttcctgagctacaacatgaccggtgtggtcggtggtaaccagaccccgtccggtggttacggcggtgtgctgcacgccatcatcggtactctcgaaatcaccgctggcgctatggttatctccattccgatcggtttgatgtgcgccgtgtacctggtcgaatactcgaaccgcggcaagctcgccaccacggtctccctgctcgtcgacgtgatgagcggcatcccgtccatcgtggccggcctgttcgccttctcgatgttcacgattctgctgggccccggtaccatcaacggtttcgaaggctccgtggctctctccctgctgatgctgcccaccgtggtcaagtccagcgaggaaatgctcaagatcgtgccgaacgatttgcgtgaggcttccttggctctgggcgttaccaagcagcgcacgattaccaagatcgtgctgcgcaccgctctgccgggcatcgtctccggtgccattctggccatcgcccgcgtgattggtgagaccgcaccgttgctgatgaccgccggctacatctccagcaccaacgtgaacctgttctccggccagatgaccaccctgccggtgttcgtctaccaggagtactcgaagctcagcgcgaactgcccgcccaacgccgacgccacctgcgtgaccacgattccgatggaacgtgcgtgggctgcggctctcgtgctgatcgtcatcgtgctgctgctgaacctcattggccgaatcgtggcgaaggtcttcgccgtcaagaccgagcgctaagccagtcgctaagcctaagccttaagaacacaaggaaatataaggaaacatcatgggacaacgtattgacgtcaaccacgagaacatctattacggcgactttctggccgtggaagatgtgaacatcaacatcgagccgaacaaggtcaccgccttcatcggcccgtccggctgcggcaagtccaccgtgctgcgcaccttggaccgtatgcacgagatcatccccggcgctcacgtcgagggcgaggtgctgctcgaaggcaagaacctgtacgacaaggacgtggatccggtggccgtgcgccgcgacgtcggcatggtcttccagcgcccgaacccgttcccgaccatgtccatccgtgagaacgtgctggccggtgtgcgcctgaacaaccaccacctggccaagtccgacgccgacgatctggtcgagtgggctctgcgcggtgccaacctctgggaagaggtcaaggaccgtcttgacaaccctggcatcggcttgtccggtggccagcagcagcgtctgtgcatcgcccgcgccgtggccgtccacccgcaggtgctgctcatggatgagccctgctccgccttggatccgatttcgaccttggctgtcgaggatctgatcaacgagctcaagagcgactacaccatcgtgatcgtgacccacaacatgcagcaggccgcccgtatcgccgactacaccgccttcttcaacctgaaggcagtgggccagcccggtcacctcgagtacttcgcggacaccatcacgatgttcaacaacccgcaaaacgaagaagccgagcgctacatctctggaaggttcggctgatcgtttcctgcgcgcagcgtaatgatttgtgcgtaggagaaacggcaaagcccgccgcaaggcgggctttcgcatattcaacgcgagtattgccgagtattatcgttctcgcaacggagcgagctggaatacttcgtcagactgggcggcgatttcccgcttcggtcgatcgacgggagaacggcggtaaagcggtacaagacaagtccgcacgatgaacactctgtgataaattttctgtttacgtgcgagtgtggaagaatggtcgcagcaaggtccagcaaaggagcataggtgagtactggtctgatcgtcagcatcgttgttgtcgttattatcgttgtcttgattggttggggcgtcagcgcctataacaacctggtgacgctgaagaaccgtgtgaagaacggttgggcgcaaatcgatgtgcagttgaagcagcgcgccgacctcatcccgaacctggtgaataccgtcaaggggtacgcatcccacgagtctgaagtcttcactcaggtgaccgccgcccgcgccggcgtagtggctgcggccagcaacccgagcacgaccactgctcagcgcgccgccgctgaaaaccagctgtcccgcgccctgttcaacctgcaagccacggctgaggcatatccgcagctgcaagccaaccagaacttcatggatctgcagaaccagctcaaggaactggagaacaagatcgcctacgcccgtcagttctacaacgacgtggtcctgaagctcaacaccgccatcgaaaccgtgccgacgaacatcatcgccggtctgttccactttgagcaggcgcaatacttcgaggccgatgacgcttcccgtcaggtgccacaggtccagttctgacccgcttcaggcccgtccggtaagccgccggccgggcccgtattgtcttaagagagggaagacatgcggatacgattcattcgcgccggaatcatcagcattgttgccacggtggtgttggcagttatcaccttggcgataatcgggacttccgcgttcggcgattcggccgacctcagctaccgcacgctggactatgacgtgaccgccaccgcgaacggtgatttgaaggtcacgcagcatatcgacgtcaagatgcgtgagcgtaccgacagtgacgacaacaccaagccgtggaagcagctgttccagcaatacacgctgaactccggcaccttgactgatatcagcgatatcagcgtgcgcaacgtcaccgacggcatcgactacgcacaacagagcgagcccaagctgcccagtgacgtctcttccgacaaggaatggaacagcgactacgccaaccattggtatgtcgccgatgtgagcgatggcagcgaccatccaaaggcatacacgcccggtaccgatggcctcaagcccagcgcctccgccaccgaagatgacacaaccgtggagatcggctggaatattccggtcaccaccgaggccgacagcatgaagttcgatgtaagcttcaccatgcacgatgtggccaccaaatggaaagacgtggcctccttccaatgggagccgttcggcaagaagaaccaagtgcctatcggcacggtcaccggcaccgtccacttccccaacggcatcaccggcaaaacctcatgggcatggctgcacaccgagcgcacttcggaaaccaagcgcaacagcgacggcagctacacgttcacggcctacaacatccacaatggcgactacctcgatgtggtcgcggcgttcgatgccgccaaagccaagggcatcgcccgcaagggaaccggcaatcatctcaaggacctgaaacaggacgaatataagcaacagcagcgctggctcgacaagcaacgattcgctgccagagctcgtctcgtgtcctggattgtcagcatcgtgctcggcatcgcgttgtgcgcgtggggtatctgggctgtgatctccagcaaccggcgtgcgcaataccgtggcagcgtcgaatactggcgcgaccagcccggcatcagtccggcttccgcagcccgtctgattcgcgtggtcgatccgtcgacgcgccaatccgatgaagaccgccagctgaccgccaccatgctgtcgctcgccgtcaagaaggccattgccgtctatccggggccgtcggacatgtatcgcggcatcgacatgagccaggccacgccggtaggcttgagccaaatgattgccgccgaccaaggcaagcagtatgcggcaggcatcaccagcaccatcgtgattctgccgctcgccattgatgaggcacccaacgcgcaacagttgggattgagtgaatcggaagatgcgctgctgaacctgctcatcgtcatttcgcagcgcgtgggcagcccggtattcgacctgaaccagatgaaggcgacctgccagaattggcaagacggctatattgagctcggcaaattcaccggtgcatgcagcatggaataccagcggctgggtgccacgcgctctgtgggctggcaatggatcctacccggcgtattggccgccgtgctgggatttggttcgctgctggccaacagctttatcggatacccggtggctggtcttatcgagctgccgatattcctggtcggcctgttctgctcgatggccggcgcgatgaccgtgctcaccgaccaaggccaggatattgccggccggactctgggccttaagcgttatatggaagacttctccaacttcaccgaccgtggtgccgccgatttggccttgtgggattggtatatggtctacgccgccgcgtttggcatttccgatcgcgtgatgcgtgagctggccaaggcctatcctcaggtcaacgatccggcttggctggatgccaacgcctccaactcgttgttctactggaactaccgcccgtatggctggtacagccaccgccacaatgacgatgctgccgggcagatggacccgggcattagcggcccagctccggcttacggaggcacgtcgtttgccggcggattctccgacctcggctcgcagctgaactccggactcgctgacatcagctcgaccatcagcgcggcagcaccatccgctgattccggtggcgatttctccagcttcggctcgggcggcggctccggtttcggtggctcgttcggtggctcgggtggcggctcgttcggcgggcggtaaatccagcgttctgcttacgctggaatcggacacagaccgtctcattactgttgaagggaatcaccatggcattgttccgtaacctcggaccgttctccaccaccgccatcggccacggcgaaatgccgctgaccatcgaaaacaatcgtggccacgaggtcggcatcgaaaccctgcatgcctcgctggacgccggctgccgtcacatcgacaccgcttgggcctactactgctccggcggcgaagaacagaccggtgaaaagctggtgcgcgaggcccttgagacctggaaggggccgaaggacgaggtgctggtggccaccaaggtgggccacttccgcaacttcaccgacggccgccccacgtgggatgtggacggtcgcccggagaacctgattcgtcgcggcaaggagagcgcactggcgctcggcgtggacaccattgacctgctgtacttccaccgccctgatccgaaggtgccgtacaacgagtccgtcgaagccatcaagcagctggtggacgagggcgtggcgcaggaggccggtatctccaacgcctccatcgagcaaatcgacattgcgcgcggtattctgggcgacaagctcgtggccgtgcaaaaccagtactcgccgattcacctggagacccaggacacgctcgactactgcgccaaggttggcttggccttcgtgtgctggagtccgctcggcggctaccgtcacccctatgatgagaccaagttcgacccgttccgcgaggtcgcggcggcccacggcgtgagctaccagcaggtcgtgctggcatgggagctcgccaagggcgaccacatgttcgtgattcccggcgcgcaccgtcccgaaaccatcctcgactccctgaaggccgaccagctcgaactcacccccgaagaactcgccaagctcggctgaactttctcagctccccttgtcaggggagctgtctcgcgtagcgagactgaggggtagtcgccggagtagtcccgggtagttccacaaggagataattgtgcgcaaaaaactcatcctcgacctcgataccggcatcgatgacgcgctcgccatcgcatatgccctaggcagtgccgacgagatcgatttgatcggtatcacggccacctacggcaatgtcgcggtgccgctggccgcgcgcaacgcgctggcggtactgcacttgttcggccgtgacgacgttccggtctatcccggagtcgaccatcccatcgccccggcaacattgccgaaaatgcgtggcaccacaccagacgagcgggcccaggcctacgcgcgctggcagaacggcggcgcggacggctggcaaacggacgcttcgtggtcaccaactcccggctcggtggcggtccaccatcccaacggcatcggcggcgcaatcatccccgactccccgcgcgctccggaagcaccaggctcggcggttgatttcatcatcaccgccgcgcgcgaatacggcccggacctgaccatcgtgcctacgggcgcgatgaccaccatggccaccgtattccgcaacgctccggacctgaaggattccggtgtgaacgtgacgttgatgggcggtgcccttacattgcccggcaatgtaagcccggccgccgaagcgaacatctcccaagacccagaggcagcagactatctgttcaagtgtggcgcacgcaccaccatgatcggcctcgacgtgacccaccagaccgcgctcactcgtgagaaagcccatgaatgggcgtctctggggacgccagccggcgactttctcgtcaccatgaccgactactacatcgacttctacctgaagaaccagccggagattcgcggatgtggactgcacgacccgctggccgtggccgccgcgctcgacccatcgctggtcacgaccttcgggttcaacttgcaagtcgatctcgagggcccgttccgaggccgtaccatcggcgatcgttcacggcttcaggaccccgacaaacacacgcaggtcgccttgggcgtcgatgtgccggaattcctggatcgtttcatggggcgcgtcaccgcggcggcccggtgacgcggacggcggccgtccggtccgctccacgccgtggatggatatgacccatggcgtggagcgcccttttgggaaccgacagaacatagggggggcggtgcatgcgcaccccccctatgtgtcagatcacgccgcagcccggaatcaggccgccgggcggatcgagcgtgagatattgctcctccagatcgatgtcggggaccaaggcctccacgaacgggaccaacgcggtcttttcgaccacatcctcgcccttggaattctggccggttaccaccggctcggtcaaacgaatcttgagcagggattgggcgggggagtcgatcacatccaccactttgccgaccacttggccggcgggcagtcccagaccgttgccctcgactagacgggcctcaaggccaataagatccttgggataccattcgtcggcctcgagcatgtcctccgcatcgtcgacctcgccgtagagttcgacaccgtttagggcctcggcggcattgcggtcgtcgacgccctcaagcttgagaatccaacgatccttgaacgtgcgcgagccctcgacgatgtactcggtctcgccatcctggctgtagagcacggagtccggctcgaagcgccactcgggatcatcggtgtacaggcgcacggtgacttcgcccttcaggccctgtgcgcggccaatacgagcgaccctcagcaactcgagctgctgagggtcgtcgtgcatgtcttgctgtgccatgctgtgaatcgttccttatcggttatcgacggacgtccatgatgtcaacgcggaccttgtggtcagacagtgcctgaatcacggtgcgaatcgcgttggcggtgcggccgccacggccgatcacacggccgatgtcttccgggttcacgcgtacgcgaagcagttcgccgcgcgcgttctcatgagacttgacggaaacatcgtcgggaaaatcaacgatgttcttgatgaggtgttccacagcttgtgcaagcatagctagcctttcgtttccgctcaggcctcagccggagcttcttcggcggcctcttcagccggggcttcctcagcggcggcagcggcttcggcttcagccttggccttggcagcagcttcggacttggcggccttcagcttctgagcctggtcctcaacggccgcgatgcgggcctcggcgtccgggccagcctcaacggtcttcagggtgccttcggcaccttcaaggcccttgtacttctgccagtcgccggtgatgttcagcagcttgaagacgggctcggacggctgagcgccgacgccgagccagtactgagcgcgatcagacttgatctggatggtcgagggctgggtgttggggttgtaggtaccgatctcctcgatgaccttgccgtcacgcttcttgcgggaatcgacgaccaccacacggtagaaggcgtagaacttcttgccctgtcgcttcagacgaatcttggttgccaaaatggctctccttgtaatgctaggtgtgcgggttctcggtttgccatgtggggcatggccgtccggaatccacgtgtcctcgcggctcggggtgtagagggcgccacgcgcgcgcgaataactggcctattatagcgcacagggccggactgggcgtggcgcactgtggttgcggtgtggtgcgcgttccccgttgcgcaacattccggggaatgtatcgcgaaaatgccggctatcgcagtgcaagcgttgcggtcagggccagatgatcagtgccctcgacctcaaacgacttcacgccggacggtttgagcccgggagtgaacagcacgtgatccagctcgatgcgcggccacttgagccagctcgggaaggtgagattcgggccggcggcttgaatcagacttgcgtccttgaatccggacttgagcaacgcgcggaagctcggatggtcggtgctcgagttgagatcgcccataacgacgacgatattgcgattgctgacggattttgcacgggcgagttctcgcagacccagaatgccggccgaccaatccgcgcagccgcgcatcggcgatttcgggtgagccgaacaaagcgtcaccgtgcgattaccggaggttttgagggtgatggcgggaacgtcggcggcggggatggagaccacgttgggcaccgctgcgctcggctcgtagcgggaatagatcacgttgaatccgccattatcggtctctttggcgtctccgaactgatggtaggggagaagttcgttgatgtcggcttcggtaagacgtgtgatgaggtcgtcggtgacttcctgcaaggccaatacgctgatattgcgttcgcgaatattgcgaatgatttcagcggcgtcggcgcgtccgtatcgacaattcatcgtcataaccgagaactggggcgagagtgtttcacgcgttgtttcacagtgtccatcggagatggtttcgggcccttccttcggagtgcttgaggtacccgatgtattgctgttatggctttttgacagcgtcggcgaagttgtttcacgggctgtttcacggtgggattctttgcgtttcccggccgggtcgattgacgtaccccagtagttgatgcgctgtgagctggcaatcagcgcgaccacaataagcaacgacatcgcagtccattcatgttgccatgcggcgaccgcggccagaatcatcaaaggaacccacaacagcggcgtcagggcaatcatgtacggaagcggcatacgggcctcgagaccggcgggcagcgcgcttaaggtcgtccataacagtgcgatgattgccaccgcgctgaggattgtcgtcatggaagttcctttcgaaatataaattgaaccgagatataatttggctcccctctgcgaggggagccaagttgtgagatcagcgaccgaacagtccgccaaggcctccgccgaggttcggcggcagttcagtgccaccgtcgacgttgcccatcatctgctcaaggccagcgggcagggccgggttctgtggcttcttggcgaaggcggaaccgccggtcgaaccggaggacttgccggccagcttatcgcgcaatgccttctcctcggcctcgcgcttcatcggattgccggacttgccgcccttcttcttgttcttgcccttcttcttgccgccgcccatagccgggccgccgaagccggggatgccgccgcccatgccgccacgattggacatgcgcttcatcatctttgcggcctgctcgaaacgctgcagcaaagcgttcacctgagaaaccgtcacgccggaaccataggcgatacgggcgcggcgggaaccattgataatcgacggatcgcggcgctcggccggggtcatcgagcgaataatcgcctcggtgcggtcgatttccctctcatcgaactgctcgagttccttgcggtgctgggccatgcccggaatcatgccgagcagcgacttcattgagcccagcttgcgcacctgctgcagctgatcgaggaagtcgtccaggccgaaggaaccttcggagattttctcggcggccttgcgggcctcttcctcatcgaactgcttctgcgcctgctcgatgagcgtcatgatgtcgcccatgtcgaggatacgcgaggccatgcggtccgggtggaagacctcgaagtccttcaggccctcaccgttggaggcgaacaggatcggcttgccggtcacggacgccacggacagcgcggcaccaccgcgggcgtcgccatcgagcttggagagcaccacgccggtgaagtccacgccttcgtcaaaggccttggcggtcttgacggcgtcctggccgatcatcgcgtcgatgacgaacaggatttcgttgggacgcacggcatcgcgaatgtcgcgagcctgcttcatcagctcctcgtccacgcccagacgaccggcggtatcgatgatcaccgtgtcgtagagcttctgcttggcgagttcgatggaatcgcgggccaccttcaccgggtcgccggaggtctggcccggagctgcgacggcctcgccgccatcggattggacgcccttttcgggagcatagacgggcacgccggcgcgttcgccgaccacctgcagctgcgtcaccgcgttcggacgctgcaaatcggccgccaccagcagcggcgtgtggccggaatccttgagccagtagccgagcttgccggccagcgtggttttaccggcaccctgaaggccggcgagcatgatgatcgtcggcgggttcttcgcgaagttcagcggacggtcgacgccttggccgagcacgtcggtgagctcctcgttgacgattttcaccacctgctgggcggggttgagtgcgtcggacacctcggtgcccagtgcacgctcacgcaccttgccggtgaaggaacgcaccacgtcgagcgccacgtcggcgtcgagcagcgcgcggcggatttcacggatcgtgccgtcgatatccgcctcggaaagcttgcccttgctcttcagatgcttgaacgcattcgagagtctgtctgtcaaagatgaaaaagctgccataatgggcaacagtctagccgccacgcgggaaattgcggtgttggggacgacgcttttcggggaatgtgccgcgtagtagtcagggatgttgggcattcagacggcaaatgccgtgccgtccgctcgtggcgaagccaatcgagtgcttccgataccatggaaaccgtaaagaatcctgtgttttttggaatacttacgctgttttgaaaatcgctggacaccgcttatacgcagactgccgtgcgctccgaaccatgacgttcgggccaacgcagacatgccgtgcaataaggaaggcccactgatgcccacccaaaaactactcgaacgcaaagccctgatcgttggtatcgtcatcaacgtgctgcaggtcttagccggcatggccgtgttcttcatgaccggtctcaaggccatgttcctcgacttctccttcaccgcgatttccgtcctgtccggaatggtggcggtgtacctctcgtcgcgcacggtgcgaaccaccgagcgcttccccaatggcatgttcgcactggaacctatctacgcgatctgcaaggccattttcaccatgtcgttgttggtgtattcgctgattgacgtgtgccgagtagcgtacgactacttcgtgttcgggtccggcgaacgcattgaaaccggcccggtggtcatctacgagatcctgaccgtaatcgtgtgcttcagcctatacacgtattaccggcgctccaaccgatccatcggcgattccagcaccatgctcaccgccgagtgcaagagcacgttggtcgacggatcgatgtcgttcggcatcggcgtagttgccatcttcctgatgctgctaccggccggcggtccgcttgacttcctgcactacaccggcgatttcttcatcaccgtggctttggtggcattgaccatcaaggagccgttcagcgtgctcaaagaggcgttcgtggaattggtcggcggcgtgcatgacgacgatgaaaccaacgcctacgtggaggccgaggcacagcgccatctgcctgccaacaccgactacgagcagacgctgatcttcaagaccggtatgaactacaccgttgacgtgtatctgagcggcatcggcgaaaccattgatgtagctgacctcatcgaatgcaagcgctcgctggaaaaggagctcagcaagcgcctgcacatcgtggacgtggacttcgtgtttgactgattgatgggtttgaagcgactacttcagactccaagtggaaccctgcgggccgtcttcgatggcgatgccggcctcggtcagggcgtcgcgaatctgatcggccttggcgaaatccttggccttgcgagcttcggcacgggcgttgagctgttcggcgatcagtgcctccagcgctgcatgctcgggcgactcggccgtgccatcagcggcaccgccggcagcgccggcggacacccacggttcggccagcgggtccaggcccaaggtgtcgagcatggcacgcacggcgagcagcgcctcacgcacctcggccttggcggtttcggaatcggcgcggtcagccagctgtgaaagcaacgtattgccggaacggatggcggtgaagatcgcggcggttgcaccagacacattgacatcgtcattcatggcggccacgaaatcggcgggcaaatcgtcggcggagacggcagtgacttcctcgcgagaaggctgtccacccagcgccacaccggcacgctcgatgaagttcgagacgcggtcgtatgcggcctgcgcctcgaccagcgcctgatcggaccattcgagcatcgaccggtactgcacggagcccagggcgtaacgcaccacccaagcggaatgctcagccaacacgctcggcacggacaggccggtgcccagcgacttcgacatcttctcgcccttggcggtcacccatgccgaatgcatccagcgcgcagcggaggggtagccggccgcacgggtctgagccatttcgttttcgtggtgggggaagcgcagatccaagccgccgccgtgaatgtcgaagccatcgcccaggtaacggtgggacatggcggagcattcgatgtgccagccagggcggcccacgccaaacggcgtcgaccaacgggcgtcctcgggatcggtgtccttcggagccttccacagggcgaaatcacgcggatcatgcttgtcgggggaggcatcggccgggtcgaccggattgtacttgtcggcaccggtggcgtccacggacgggcccatgcggtcggccacggcggcggcctcatcgacttcggaggtctgcttctggtgagtgagttcgccgtaatgcggccaggatgccacatcgaagtacacgttgccggtgggcttgccgtccgcatccgtgaccacatagccgtgaccgttgtcgagaatgcgctgaatcaggtcgatcatgtccgacatgtggccggtggcgcgaggttccacagtgggcggcagtacgccgagcgtgttgtatgcctcggtgaattcgcgctcgtagtaataggcgcgggcccaccaacgctggcctgcggccgcggccttaacgagaatcttgtcgtcgatatcggtcacattacgcacaaaagtgactttgtagccgagcttcaaaaaccagcggcgcacgatgtcgaacgccacggcggcacggatatggccaatatgcggtgacgattgcacagtcgcgccacacacataaatgccgacttcgcccggcttgagcggcacgaaatggctgacctggtgcgaggcggtgtcatacagattcaggccttctgcggccttggcaacatgcaccggcgtcaggcttgaaggcatgacggaaatgttgaaatcctgcggttcttggctgtttcccataacactcaagcgtagggtccgaaccagacatgctgaatcgttactcgaagagtttgatgaacgcttcacaggtggggcccgaacgaggtgacagacggatgagaagcgggacaacagtctcgcgagaacacgtctttgaccgctgcggaaactgcgagattcatggatttgccctgctcgttacgcaaacggggaacgctcgtgccacaatagaagtcatggccacaccacaagtgctcattttgcaacatgtcccatgggaacgcccgggacgcatattgtcgaacctcgaggacatcggtcttgagacggtgacgatgaatatcgtcgacaaaaagaaaccggacttgcctgatttcggcgaactggctggcgtggtaatcatgggtgggcctatgggcgcgcttgattacgacaagtatccggggctgaaggcagaagccaagttggcgcgtgccgccgtggcttcaggcaagccgattctcggtgtatgcctggggcatcagattatcgccactgcgcttggtgcgcagctgcgcaagggcgatgcgccggagattgggttcgcgccgatcaagcgtgtggacaagcatgacttcttctccatgtgggataagcagctgacagtgctgcactggcataacgacgtggtgggcctgcccgcggaaggccagctgctgtcgcgttcgtcttccaccaaggtgcaggcattccgactgggatccgcgctgggcatgcagttccacctggaagtgtgcggctcgctgctggacgaatggctggatgagccgagcatggtcaaggatctcaaggccgcgggtggttccaagtcccaattgcgcgagcagttcgcccaatacgaccagctactgcaaccgctcgccgagcaagtgttctccggttttgcggcccgctgcaactcctacgctcagacgctgaacaaataacgtttgcgggccgccgctgggcaagcgtggcgctacattggtgagtcatgccgacttatgacattggactggaacacgtttcgctcgctttcgctaccaaaaccatcttcactgatgtaacgcagggtgtttttgaaggcgaccgcatcggcatcgtcggcaagaacggcgacggcaaatccacgttgctgcacctgttccgcggtgctcaggagccggattccggccgcgtgacaaagcgtggcggactcacgttcggcatgcttgaccagcgtgatccccttgatgacaacgccaccattcgcgaagccgcacttgaggggcgcgccgactacgaatgggcgtccgataacacttcccgtgaaatcgtcgaggcattgctcggcggcatgagcctggatgccaaggtcggctccttgtccggcggccagcgtcgccgcgccgatttggcccgactgctgctcaaggattgggatattcttgcacttgacgagcccaccaaccatctcgacgtggtcactatccactggcttgccgaacatttgaagaaccgctggtccaaaggccagggcgctctgttgctcgtgacccacgatcgctggttcttggacgaggtctgcgaatcgatgtgggaagtccacgatggcgtgatcgagccgttcgagggcggctattccgcatatatgctgcagcgcgtggaacgcgatcgccaagccgatgtgcgcgaaaccaagcgccgcaatctggctcgcaaggagctcgcatggctttcccgcggtgctcgtgcccgctccaccaagcagaagttccacgtcaaggccgcacgcgaattgattgccgatgtgccgccgatgcgtaacacacttgaactgaagcaaatggccacctcccgtctcggcaaacaggtggtcgatttggtcgacgtgacgcagattttcgaaaaaccgcagggcatggccgatatcgacccggatgtggcggcgctctccgcgtccgcttcccgcgtggatgtggtcaacgccatgtacgccgagccgcagctgcatggttccgttgaggtggcggtcaccgacatgactgacccgcgcctggtggacgccggcgtgccggaagccgtcgagtccgctgaggaagcgcgtaagaaggccgaggctgagagcggcaatccgcagcttgctgacgatcgcgaggttcgtcgcatgaacacgggtggtgaaaccatcggcggtggcactgctgcaacggattcggatgatgacactgctgcagccggtgtcacctcggctgcacgcaaggtgacggtttccggccgcgagattcttgacgatgtgacttggctgattggcccgggcgaccgcttcggcatcgtcggtgcgaatggtgccggcaagtccacgctgcttaagttgattgatggcacactcaccccgaccgcaggccatgtgaacattggcaagacggtgaagttcgcggtgctctcgcagcgcctcgatgagctggagaagctcggcaagtacaagatcaaggaagtgctttcccgctataagccgagctacattgtggatggcaaggaagtgacgccgggacagttgatggagcgtctcggcttcgaatccgcccagctgatgacgccgatccgcgatctctccggtggtcagaagcgccgcatgcaactgctgctgattctgcttgacgagccgaacgtgctcatcatggacgagcccggcaacgatctggacaccgatatgctcgccgtgatggaagacctgctcgatacttggccgggcacgttgattgtggtctcccacgaccggtacctgctggagcgcgtcaccgatcagcagttcgcgctgattggcggcaaagtacgtcacttgcccggcggcgtgcaggactacctcgatatggttgaggctattaagaacggcaagggattgccggctgacacgcctggcttcgcgggcaccggtagcagctcggcgaagtctggtaagggtaaggcggccgccgtcaacgctgccgcatctctccctcagtccgcttcgcggatagctccctcgtcagagggagccaataacggtgaggactccacctcgaagctcaccggcaaggccttccacgaggcatccaagcgcgtgaatgccatcgaacgtaagctcgctaagcttgaagagcagaaggccgatctcgaggcgcagatggccgcccatgacccgagcgactacgagggtctcaacaagctcaatgaacaactcaccgccgtcaatactgaaagcgatgatctcgaagccgaatggctcgaactctccgaacaattggagtagcgggagaaaccgtaacgttcacaaggcctcggcagtttgccggggcctcccgctatgcaaactcccacggattaatcaattccacgtcggtaccttcgaagtccttgatattgcgcgtggctatggccgcatcccaggaacaggcaattgccgcaatcatggcgtcttgaatactggtaggtgtgcccctgtgttcgcgttcgacaaggatatgggcataatccgcagctgcctgagtgtcaaatgcgaacgttctgtcctctaatgtcataagcgccagcttgacggtcgtatctgtgtactttcgtcgtttgccttcaggcatgcgacatattccggccaacaactcggcgacggtgatggcggtggttgccaaattgcttgtatcttggttcctcagccaattggcaacgtgttcgtctggctgtttcttgatgatttcgctgatgacgttggtgtccagaataatcatggccgattcctattcaaaagatactggcggtcgggaatcggcggaatttcgctcggatagtgggagttcccccttgtcgagtccctcaaaatccatgttcttcatgaattcgcggatctcgtcatagaaattggtctttcgcgtgatttcatgcgccaccgtgccagccagccattcttcaagaatggatcgcacctgagattccatggagcggttgtttttctcagccacttctttgagctgctgaatctgctcatcgggtatttttcggatggtcaatgttgccatgatgcacctccttgttgctgtcataatgctagcatgaggtgctgtcgttttgcttgcagtacgggtgacgaggtatgcacgcatgaaaaaaggcggatatgcatcatgcgcatccgccttttgagcttggactgggtcttcccgcagtcgccgaatcagcgcccggtaacctcggaaccgacgaccttttcgctcagggcgcgcgggccgcgggtcacggctacggcaccggagcgcaccagctcaatcacaccgtaatgctccaaaagccccagcagggcgtcgatcttgccttcggcaccggtggcctcaatggtcagcgattccggattcacgtccaccacgcgcacgcggaacagacgcacgatctccagcacgtcggaacggttggattcgttggcggccaccttgatgagcaccagttcgcgttccacggtggagttcgggtcgagttccacgattttgagcacatgcagcagcttgttgagctgcttgatgatctgctccagcggcacggcctccacgtcggcggtcaccgtgacgcgagagatgtccggacgctcggtgggggagacggacagcgagttgatgttgaacgcacggcgggcgaacaggccggcgatacgcgccagcacgcctgggcggttctccaccagcacggacagcgtatgacgctgggaaccaggctgggatgcaggatagttagccatgagtgttctcctctcctcagtgctcgctcgcagtggcagcggcggtctcgtgctcgaacacgccggtcgcatgctcgtccggaccggttcccggagccggggtgccgccagccagcggcttgatgccgggcttgtacgtcacctcgtcgttgggggcgccggcggctaccatcggccacaccatcgcatccttccacacgcggaagtcgatcagcaccgggcggtcgttgatctggttcgccttttcgatggcggcaatcgcctcttcctcggtgaacgcgcggatacccacgcagccgtatgcctcggccaacttgatgaaatcaggcacttcgagcggcgcatcgccgtcggccagtgccgccgcaccatcggcaccgtgcgcttcaccatcgagcaggttggtctgcgagtagtggtgctcgtagaacagcgtctgccactgacggaccatgccgtatacggagttgttcagaatcgcgatcttcaccggagcgtggtccaggaacgcggcggccagctcctcagaggtcatctggaaggaaccgtcaccatcgatcagccacaccggcttcttgccctcgaattcacgggccgagcccacggatgcgccgatggcagccggcagaccgtagcccatcgtgccgaggcctccggaggagatccaagcgtgctggttctcaaaatcgatgaactgcgaagcccacatctggtgctggcccacaccggtcacccagatggtggacggatcggccatctcagagagcttcttgatgacccactgcggggccagcgatccgtcggtcggctcatcccacgtcatcgggtattcctcgcgccagccgtcgatcgccttccaccagggggccagattcggcttgccctgaatggcctgcgtacgctgaatctcgggaatcaagtcgtcgagcacggtagccacatcgcccacgatcggcacgtcgggctgacggttcttgccgatttcagccgggtcgatgtcaatgtgaatcacgcgggcggtcggtgcgaaggcgtcgagcttgccggtcacgcggtcgtcgaaacgtgcaccgatggccacaagcaggtcagcgcgctgcacggcgccggttgcggcaatcgtaccgtgcatgcctagcatgccgaggttcttcgggtcggagtcgggaatgatgccgcgtgcgggcagggtcgtgaccacgggagcgccggtcaggtcggccagagccttgacctgtgcgccggcgttggagcgggcggcgccgccacccacatacagcaccgggcggtacgactgagagaacagcttcgccgcgtcggacagcacacggccgtgcgccttggtggtggggttgtagccgggcagaatcatgcgctgcggccatgagtagtacatgtcgccggtctgtgcggtcttggtcagatccacgaccaccgggccggggcggccggtgttggcgatgtagtacgcctcggaaagcacgcgaggaatgtcctgcgcgcgggtcacgaggaaggagtgcttggacaccgggtaggtgatgcccacgatatccgcctcctggaaggcatcagtgccgatggcttgcacgcccacctgaccggtaatcacgaccatgggcacggagtccatgttcgcgtccgcaatggccgtgaccacgtttgtggcacccgggccggaagtcacgatgcacacgcccaccttgccagtggccagtgcgtagccttcggcggcgtggccggcggcctgctcgtggcgcataagcacgaagcggaacttcgtgttgtctttgatctcgtggtagacgggcagaatcgcgccgccaggaatgccgaagacgtcctcgacgccgaggtcctccagcgaacgaatcagcgcctgggcgccagtcatcttctcgccatcgacgatggtctgcttatcgggggccgtgttgattttcggtacaccgctgaatgcctgcaaaggcgtgggtaaagccatgattcctctcacctcataggttttgtcgcgaacctgcccgaccttgggatggggccgggtgcccgcgtgtctgattccagtcgcttccccgagacttgtggccccggcgcgactcgtcgctcatgttggtattagtctattcgcaaatccgacagcgggcttacttagtccgcgtcttgaacgagtccagtgacttccagcccgcttcggcggccgccagctgcgccttacgcttgctggagcccttaccgatgccgatgatgtcgccgttctcgcccaatgagacgcgcgcggtgaagatctgcgcgtattccgggccggagacctccatatggtagacaggctcctccttgccgaggccgtgcgccttgacggtcagcgaggtcttccagtcaagtgccgggccctcggtggccacttcggcgagcgtgtcgtcaataagccggtgaatcaccttgcgtgcctcgtcgatgccgtgttccaggaaggtcgcgccgatgagcgattccacgatgtcgcataggatggagttcttctccgcgccgccctgctcggcttctccgtgacccagcagaatgtaggggcccaccttgagcttggttttggcgatggcgctcagcgcgtcttcggagacggccttggcgcgcatcttggccagttgcccctcggtcatatccgggtgaatggtgaacagcgtttcagtggagaccagttcgagcaccgcgtctcccaggaattcgaggcgttcgtaattggccacgccggggtgctcatgcgagaaggaacggtgggtgagtgcctgcacgagcagatccgggctgagagtggtgcccaacgcttcaagaagctcgttggccggcgtcggctgctgtggggtttcattactcatgattgttgtatggtccttcacgcgatggtgatgtgttgtgttgtgttgtgttgtgttgtttgcgatgcgatggtgtacgcaatggtgcacttatgcgaagaccccgccacccgtcgatggcagggccttcattcaagccgttatcgcaggactcacttggtgtgagccggctggatggcggagcggtaggtgcggccgcggtagttaccgcagctcgggcaagccatgtgcggcagggccggagcgccacagttcgggcagttcacggtcgcagcagcggtggccttccagttcgcgcgacgcgaatgcgtgttggcgcgcgaggtcttgtacttaggcagtgccatttgagtatcctctatttcgttcgaacaattgagcttaagcgtccgttatcttaacgcacggctcgtacaaacttcgttcaggcgcgcgtcacttggcctgctcgccgttctgctcggcctcgagctgggctttgagccccgccaatccggcaaaacggatatccgtcacatcgtgatgatggtcgggatcctcgttcagatcggcaccgcactgcgagcacagacccctgcaatccggtcggcacagtggttgcaacggcagcgattcgaccagcgtgtcgcggatcatcgcctcgatgtccgcgaatgcgccgttctccagcagcggatacgtgtcttccgactcgtcctcgccggcgatgatgtcgatttcgtcgtccttcttgctcttgccgcccttgccgttggccttgtcctgacccgactcgtacgggaagaacaccgtcacatcaaccggccagtcctcgtcaatcggcttcaggcagcgcgtgcactcgctgacgaatggcgcgaccaggcggccggtgaagatcaggccgtccacaatcgaatcgaactgcccgctcacgtgtacgggctcaccttccttgatgccgacaatgctgtcgccaatgccggaaggtgccgggaaatcggcgtcaatcggcttggattgaccggcgcgcgaagcaatctgcgctaccggaatggcccacggggaatcttcaactcgtgccatggtatgttcttggtgcctttcgtatgttggctggagttattcgttactggcgttatttcgcgttactgatgttgccggcgttgctggcgttactgggcttcgggatagtcgttcagcgtcaggtgcggcatctgttcgcgggccgcgcgctggcgctcttccagcacgttaagaccggcctgcacatcctgactgagtttgccgagctgctgggacagcccttccatcaccgtagtgcagtactggtccgcgccttgggtcagatggtcggctttggtctgtgcctggtcaagaatcgcgcgcgctttctgccgtgcaagctcggtgacgttctcttggccggccaggaactgtgcctgttcgttggcgtccctgatcatgttggctgcgcggctttgtgcggaggcgacgatggcgttggactgggtctgtgccgattccagacggcgctcggcctcgcgcatgagggcggaggcgcgctccaactgcaccggcagcattttcttcaactcggaaagctggtcggtgaattcgtcgcggtcaaccttcaccatgccggggacgaatatgctggacttcgcttcgcccagtgccgcctcgagctggtcgatgatgtcatacaccgtggtgaattcctcgtggctcttgaccgtggccgggtcgtcgtccgtggtttctcgcaggtcgggcatttcgttcatgaacgaggggcgaatgccggcggcctgagcggtctgagcctgtgcccgggtctgctgagctgcttgggcctgcgctttggcctgcatttgtgccggagtaggggtaggcgcggcgggcggcgatccggcgagaacatcggcctcttcggtgggtgccggcgcggcttgcgtagacgcgggcggttccggggcggacggctccggagtggacgatgcggcgtccgcattcggtttggtcagatcgacgtatccagtagggtggtcatcgctcatagtcattagtgcatcagtccttccgctgacgttcctcggccagggcatcggccagcatcggcacgacgcaatcgggcaccatgccggtcacgtcgcctccatggcgggccacgtccttgacgatggaactggagatgtgttcaagaatcggatcggccggcaaaaacagggtttcgatgccagcgagcttgcgattgaccagcgccatgccgagctcggcttcatagtcgccgttctggcgcagacccttgatgataacggtggcgccgaccttcttgcagtagtcggtgatcaggccgtcggtggaagaaacggtgacgttcttgcaaccggctttgtcaagggcgcggcggatcacgtcgactctggtggcttcggaaaacatcggtgttttcgcggcgttgacggccaccaccacatgcacctcgtcgaaaaaccgcgccgagcgctcgattacatccaagtgtccggcggtaacggggtcatacgagccggggcatactgcgatagtcatgctttatagcctaccgctagtggtgtgcttcgtgctgccgagcgtgcattgttgtcgcgtcggcgtatgaggcagtgtgtgcggtgccgtatgtggcgtcggtgtggcgtcgtgtgcggcattgtatgtggcattgtatgtggcggggtggcgtgatgcgcgacatgggtgtgtggaggtgtgcggattacgcgccaatgggtttcgcgggtaacgacgggaatctatgatggagtgcagtcgaatcgttgaatacgaggaaagaagtgcaccatgacttttgccgagatgttcgttgatgatgccgaaccgctgcgcaacccggaccaaggtgccggcacgtcggtgctggagcgtccggagaccaaggagtcgccggttcgtgacgatggtggcgacgccgatcgttttgcgcactacgtatccaaggaccgtatcgctgaatcgcgtgcgaccggccgcccggtggtggccctgtgcggtaaggtttgggtgcccaagcacgatccgtccaagtacccggtttgccccgactgcaagcggatttacgaggaaatgacgcgctaaaggtggtacttggctcccctcagcgaggggagccaaaatggtcaccgagccgaaatctcgtcgatcagcttgagctcctcgtcgctgaagtgggtgttcttcagtgcgccgatgttgtcgagaatctgctgcggcttggaggctccggtcagcacggaggtcaccttgccgtcgtgcagcagccatgccaggctcatctcggccagcgtctggccgcgttcggcggccagattgttcaggtccacaacctgcttgtgcagtttctcggtcagggcggaatcgttgaggaatcgcggatcgtgagccatgcggctgtcggccggaatgccgttgagatagcggttggtcagcaggccctgagccagcgggcagaaggtgataaggcctttgcccagcttgaaggcggtctctttcaggccgttcttttcaacggtgcggtcgaggatgttgtacttgttctggttgatgatgaacggcacgtgcagttctgccagaattgcggcggccttttccatcgtcggaccatcgtagttggacagacccacgtacagggccttgccggagttcacggcctgagccagcgcgcccatcgtctcctcaagcggggtttccgggtccgggtggtgatggtagaagatgtccacataatccaagcccaagcgttcgagcgactggtcgaggctggcgagcaggtacttgcggctgccgaggtcgccatacgggcctgcccacatttcatagccggccttggtggagatgacgagttcgtcgcggtggtgcttgaagtacttggcgagcagcaggccgcagttcttctcggcctggccgggctcgggaccgtagttgttggccagatcgaagtgggtgatgccgttgtcgaaggcggtgaagaccagggacttcatctggtcgaatggcgtgatgtcgccgaagttgtgccagaagccgagtgagacggccggcaacttgaggccggaggtgccggcacggttgtaggtcatcgtgtcgtaacggtgcgggttgggagcgtaggtggtggttggctcgaacattgagtctccttacaatgtcatttttgttcttacgaatgctggtctgcgatgggcaaaccgacgccgatcgagtggtattcgtaagtgttcttagatactaaggttccagttcaagtgaacttgaatgcaaacggctgcgacgcttcggcgtgtcgccgcagtaaggagtcatgatgtcctacaccattcgtcaggtggccacgcagttccatatgcagccctctacgctgcgctattacgaggatcagggattgctgaccaacgtggagcgcaccgaaaccggccagcgtatatacgaagactgccatatcgaccgtctgcgcgcgatctgctgcttcaagaacgccggcatgaccattgacgatcttaaaaagttcttcgtgtatgagtccaatgagcccgagcatatcgacgaaatccttgatctgctggaatctcgccgcgaatccttggacgagcagcgccgaaccctcaacgaggcggccatgcacgtgcagcgcaagctccattactatggcgacatcaagcgtgccatcgacgccggtgaagactggccggattggcgcgagtacaaaaaccgcgcctattccattgaatgttgagaccatcgaatgttgagaccatcgaatgttgaggccatcgagtgctgagctggatgccggctgggcactaagaccaatgcgcgtcgatcgtgggcgcgtctatccgagtaaggccttgctcggcagtgcgcggtcgagcagccagacaacgagcgatatcacgaagaacgctatggccagcttgccgcagctaatgccgaacccttgccagccgagtgcgtcgaggttgatgaagtcgtacggatacggactgccgccggccgccggtccggaccccggccaaatcgccgcacgggccagcacgaagaccaagtatgcagggaagtacgccagccacgagaacatgtaatgccagcggaaacgccggtgcgggtcgaatagcacgaaatcgataaccgccataatcggggcgattttgtgcagcatcgtattggtcatgatgccaataacctgtggcacgtatgccgggtcgtccggaggcgtcaggaagaacgccaccagtgcggtgactatggcgtacacagtcaggcaccccttaagccatgcaggcggctgaatacctttgagcagtgtggccgcgccggaccacagcatcacgatgcccagcacgaaaccggtctggaacgtgaaatacacccagaactgcggtttggaccatgcctcatatgtgcccacgaagcagaaaccggcgatcgcaaagcgccacaacgccacgatgaatctcatgcatcgagtctaccgcttcgccagtgggccgtatggtgcggctggcgtattggctggtcgtgatgattatggtcggtgtgaccgaccgccatagtgccgatgaatatgacgatactgaacccggcaatatcgaatctggcgatacgagaataagacgagcccttcccgcacggctttgcccggactacacttaggtgcaacttcaccacttatgtaggaaaggccttgcaatggtcgattattcgccggctctgatgaccgacatgtatgaatacacgatgctcgacgccgctctgaaagacggtaccgccgaccgcaagtgcgtgttcgaggtgttcacgcgtcacttgcccgaaggccgtcgctatggcgtggtggccggcaccggccgcattctggatgcgctggaacatttccacttggatgaagcggatctgaagttcctggccgaccgtcacgtggtaagccccgagaccattaagtggctggagaacttccacttttccggtacgattcgcggttaccgcgaaggtgagatgttcttcccgaactccccaattttgcaggtcgaaggcacgttcggcgaatgcacgctactggagacgttgattctatccgtgctgaactacgattccgcagtggcctccgccgcctcacgtatggcgtcggcagccaaggatcgtccttgcatggatatgggcggacgccgcactaacgagtgggccgccgtggccgccgctcgagctgccgtagtgggcggattcaagggtaccgccaatctgctggccgcccagctgtatggtctgaaggccattggcaccgccgcgcattgcttcacgttggtgcatgattccgagcgtgacgcctttgaatcgcagatcgaggcattgggcaagaacaccacgctgctggtggacacctacaacatcgaggaagccgtgaaaaccgccgtcgaagtggccggtcccgaactgggtggcgtgcgcatcgactccggcgacttggccgccatggcccagcgtgtgcgcaaccagctggacgccctgggtgccacgaacaccaccattaccgtgaccaacgatttggatgagtacgcgctcgccgcattgcagaccgcgccggtcgactcctatggcgtgggcaccatgctggtcaccggctccggcgctcccacttgtgcgatggtgtacaagctcaccgagcgtgaaggcgctgacggcacgatggttccggtcatgaagaagtccaaggataaggccacagtgcccggtcgcaagttggcattccgctcctacgaatacgcgctagccgaagccgaacacgtgatttccggctcggaagagaagctggccggtttcacgcccgaaccgacgtggaagaacctgctggtcgatttcgtggaccacggccatatcgatgcgcagtggcagggccatgacgctatcatggccgcccacgactaccacgccaaggcgttgtccgaactgcccatcaccgcgcagagcctcatgaagggcgagccagtgattcctacggagactcaggttctctgacgagaactttcgtctccataggaatccgtcgcagcatagctgctccctttacctacggacagcccactgggctgtccgcttaacggttcgaccacagagaccaaagtcctctggccgtatctcactggccgcatccctctggttacattggctactcttccctctggatgagtgaaactctcaatggtgataacgcggcgggcaacgatgacgtatcagagcggcgcgatgtagttcgatgatggttgacgagttgctatccaggcatagaacggatggcgtatgctggggcgcatggttgaaatcaaagacatgcttggcaatcaccaaataattcgtgccgacggccgcaaggtcgacgaactgcgccctgtgcgcatcacccgccacttcaccgacgcccccgaaggctccgtgctcatcgaatgcggtaacacgcgcgtgatgtgcaccgccacttttactcccggtgtgccgcgttggcgcaaggactccggcctcggctgggtcaccgccgaatactcgatgctgccgcgtgccaccgccgaacgcaccgaccgtgaatccgtacgtggcaaaatcggtggccgtacccacgaaatcagccgactgattggccgctgcctgcgtggcgtcatcgatatgaaggcgctcggcgagaatcagattcagcttgactgcgatgtgcttcaggccgatggtggtactcgcacggcttccgtaaccggtgcgtacgtggctttggtcgacgcagttaattgggcggagaagcaccgccatatcaagtccgccagccgcgtgcttaaggactatgtgtccgccgtatcggtgggcgtgatcaacggcactccgatgcttgacctgccatacattgaagacagtcaggccatgaccgacatgaacgtggccatgaccggttccggcaccttcatcgagattcagggcaccgcagaacaccgtccgttcaaccgtgccgaactcggcaccctgcttgacttggccgaaaagggcaacaaggaactgcaagccgcccagcgtgccgctctgtccctagactaagccagctcccctgacaaggggagccttcttaaaggagaacctcatgcaaatcgtcgtcgcaacccataacgaaggcaagcttgtggaaatccgccgcattctcgaagaggatcttggcgcggatgccgaaaacatcgaactggtgtccgctggcagccttcacctgccggatccggtggaaactggcgtcaccttccaggagaacgcgctactcaaggcccgcgctgtggccatccgtaccggtctgcccgctgtcgcggatgattcaggtctcatcgtcgatgtgatgggtaacgctccgggcattctgtctgctcgctgggcgggtgctcacggccacgacaaggccaataatgcgctgctgctcgcccaaatcgaagatattccggatgacaagcgtaccgcgcgcttccgttgcgccgccgcgctggtggtcccggacaccgagaccggtgccgacgtgaccggtggagtggctgccgacggcatcaccgttcacaccacggctgccgatgggagccctgccccggtgcatgctcgatacgccatcaagtcggagacagtggagctcggcgacatgccgggtcgcatcatccgcgaggctcgtggcgtacacggtttcggttacgatccgctgtttgtcccggacgatcagcctgccggtcgcgtcagcactgagcctgaccatgaaggcgagccgctgaccagcgccgagatgactccggccgagaagaatgcgatttcccaccgaggcaaggcgctgaaagccttggtccccgccatcgaggccctgctgcactaagtcgtctaggctgtctagctgcactgagccgcgactaagccacagttgagtcgcggctcagcactcagcccccgaatcgggcgagtgtctagcaagcgcctatgacctagcaagggcgatacgaaagaaggccggcgcttagtgcgtcggccttcttgatgaacaagagccacccgatagaatcgaactaccgaccttcccacgaacgagggggatgctctaccactgagctaaggtggcgtggcttcaagagccaagtagagaatatagcactgcgtttgattcactgcaagccggacattcatcatctttgggccattgttctttggaccatcgtggcggcaatagtgcgaacgatgtgcacacctcatctgctcggccgccattcgtcgtgtgcgcgctatgctagcatggtgagcctgattgactcggaggcaaagggaagcatgcgtgattttgtgctggtgaagttgacagacgaggagttcgatgatttctccgccagacatccacaaggcaatttccaacaaacctcggcgatgggacgccttcgcaccgcgcaggggatcgacgtcgaatatttggccctcaaggagggcgagaagatcgtcgcggcggcactgttcgaaactcaccgctctcgattctctacatttgcggtcatccatgatggcccgatgtgcgactatcacgacaccgaagcattgaccttcttcatggatgtgctgaaacgccatgccaaggcaaagggtgcttcacagctggaaatcacccctgaatccccgtatcggcttcgcgacaccaatggagcttctttgccggatgaccagaatggcgctcccgacaataagctgatagaacagctcgaggcgatcggcttcactcatggcggtttcaccgtgggctacacggcggttccgcgttggcgctacctcaaggatctgaccggcattaccgatgagaaaagtctgctgaagtcctatgacaagcgcacccagtggagcgtgaagcgtgcccaatcgatgggtgtgcacgtgcgtgagctgtcggacgacgagctgggggtattcgcacgaatcgagcagcaaaccgctgaacgccgtagcttcgaataccgtggcgaagcatatttccaccgtttcaaggaagcgttcggcagcaaagcgcattttatggttgccgagatccacatcgacgaatacgtagcggacatgacgtccaagcgtgaagcgctttcggccaaggtggcggcattgaccgccaaaaacgccgaacaccccaccaccaaaaccgaacgtcagctgggggaggagacccgcaatctggcggcagccgaaaagcgcctgaacgaggcggccgagttcgccaaagacggggatgtactgccggctgcggcatcactattcgtggagcatccgcgcgaggtcatctacctgttctccggtagcgtcgagcagtacaagcccttctacgcctccgcgctgattcagcatgacgcgatgctgcatttctgcgtggaacacgggctgtctcgctacaacttctacggcatcgacggcgtctttgatgatcccgatgacgaggggcgtggtgtactggagttcaagcagggcttcaacggatatgtcgaggaacttccgggcgagttcgtgctgccggtcaaaccggtcgcctatgccatgaagcaatttgcgcacaagctgctgtcgcggtaaacggacgcagcacacaggccattccagagcccagagtaacgatcagagtaacgacaagtaagaaggttcgattatgacgcaatccgatgcaggcgtcgcctcgctcacccctaccaagatcactcctgccgagctggatgcgttctccgcagctcaagtgcaaggtagtttccagcagacctcgcagatggccgccatgggtgcgttcaacggtccggtggactatgtgggtgtcaagcgcggtgacaagctgattgccgcctgctacgtggtgtacacgcggtcccgtttcggtttggaaggctcggtctggtgcggaccgctgtgcgattatgacaatccacaggtggttgaggcgatgaccgaagccctgcgtcgttcagccaaggcccatcacgccatcagcgtatcctgctggccggccgcagtctaccgtctgcatgatctggacggcaagccgaccagcgacccggacaccacgatgatggacaacatggcccgcttcggttggaaacatggcggcttcaccgtgggctacgaatccgtggtgaaccgctggaacttcgtcaaggggcttgactgcattcatgacgagaaggaactgctggcctcgttctccaagtaccgccgtaagaacatccgcatcgcccaggattccggtctgcgcgtgcgccgactggaacgcggcgaactgagcactttcgtcaagctgtgcgatatgagcgccgcacgtcaaggcttcaagagccgcgatctggcctactatgagcgtctgttcgataccttcggcgacctgatcgagttcaaggtggtcgaaacccatttcgacgaatatctggacaccctgcaatccaagctgaatgcggcctccaaagacaagcgcaacctcgaacgcctgctccagcgcgcgcaacagcagccggaaggcacggccaagaagggtgcctccgacccggcaacgctggaaaagcgcatcgccaccgcagacaagaagatcacggcgctggaaaagaccatcggcgaagtcaatggcatcatcgcctcggacggcccggtcattccggtggaagccggtgtctacttctggcatccgaacgaggtcgtctgcctgtccagcggcgaggacgatcgtttcatggattactacccgtcttccctaatccacttcgaggcgatgcttgactgcatcgcccgtggcgtggagcgcttcaacttctacggcatttccggcattttcgacgccaacgatccttcctacggcgtctggcagttcaagactcgcttcggcggattcgtggaagagcttccgggcaagttcacgctgccggtggacggactgcgcttcggtgtatccgaagccgcacacaagctgctgcatcgctgacaaacagtggcgagcacggacacagaaataaggcacaggtgacgacgagatgagcgcgactgcgaatcgaacagatacgacgtatacgtttggcgtgattacgcccgaagagttcgaccggctttccgaagccacaagccagggcagctttcagcaatggtccgggcaggtccgtcttgccaagattcgtgggcatgaagccgaatgcgttggcgtgtgcgacgcatccggcaatctggtagccggctgcgtgattctgtacctcaatggtcgtttcggtgcagatggctccgtatatttcggccccatcggcattagcgatgatccggctctgctgcgggccataaccgaggcgattcgtgaatcggcccgtcgccaccatgctgtttccgtggcatgctggcctaacgtcgcctaccgtctgtattcctcggacgggcagcccgacggcgagccgaacgatgcactgctgaccggattcaccgatgccggctggacgcatggcggattccataccggttatgacgtggtctgccagtggatgtacgtcaaggatctcaccggcatcaccaacggcaaggaactgctggcatcattcggcaaacgcgctcaatggagcgtcaagcgggcgcagtcgatgggcgtgcacgttcgcgaaatcggccccgacgagttcgacgtgttcgccgatatcgaacggcggaccggtgaacgccgcgggttcgcgacgcgcggcgcggactatttccgccagttcaagcaggcgtatggcgcggatgcgcatttcatgctcgcggaaatccacatcgccgaatatgtggcggatatgaccgccaagcgcgaggccttgcagaccaaggtcgcacagctgcagacgaaatacgatgaacgtccgaccacgcgcatcgaacgtcagctgggggaggaatcgcgcaatctcgcggccgccgacaagcgtctggctgaggtggagggatatgccaagaagggcgatgtgctgccggcagcggcttcaatgttcgtcagtcaccccaatgaggtggtctatcagtattccggttcgttggaggagtacaagccgttctacgcctcggcgctgattcagtacgaagcgatgctgcacctgtgtgtggaacagggtgtgagccgttacaacttctacggcatttccggcgtgttcgacgatccgaacgacgagggccgcggcgtgctggaattcaagcagggcttcaacggctacgtcgagcagatggtaggcaaattcacgttgccggtggacaagttccgcttcggcgtgagcaatctggcgcacaagctgctgcaccggtagcagctggcggccgggggacgaacctatgtgggctgcgtctcgcctgaccgtgcgcccgccgtgcgcctacttgcgcatttgctcacacgcccatcagcgcgtgagccacagccatcatcaccagtgaaatcatcgcggtgattgccagcgagaagccggccagtttggcgttgccgagtactttgtcggtgaacagcgtggagaaaatggcgatcggagccaacgcgcagatcaccatcacggcgcgaatcgaagccgagaacggcagcaggagccacgcgatcaacgcgaaggcgacgctgaacggtatacgccaagcgatgacggccatgacttccttcacgtcatgcttggattggggcaggtccatgagcatgcccaccatcagcatcgacaccagcgcgttggcgccgctcaatggctgggttatagaggcgatccaatcgggaatcttcacgttggcgacggtcaacacgatcatgagcagatacgtgtcgaacggcaccgagccgaagaagctcttgccgatggtgcgcagcaatgcgcggcgggcaagccgtttggcgtcgcgatccttgggcttttcgtacggtagggtgggagccgaaccggcgtgttgttcggcaagtgttttgccgggctgaatatgcagcagttgctgggtgagcacattggtgccggcggccaccatcacgcagttgccgatatcgaacatcgcagccggcaccaccgcgcccgcaccccagaatgactggacgaccgggaaagaaaaacagccgagattgaagccggcaccgttgagcatcaggaaggcgcggtcggtcacattgcgcttgcgggtggccagaaagatgaacacgaccgggataaaagcaaacaggaatgcgaataccgaaataagcagcagcgagatgtcatgcggattggtggcgaacgagtatacgatggcaccgggcagcacgatgttgaattccgcggtttgcagcacgcgataatccttctgcccgaacaggccgaaccgcttgaacagatagccggcgaggatgatcagcaacagaccaaccggcgtaagaatggcggacatacacttctctccttgactcacacaggctcatggcgcacaggctcagacccgcaatgctgtggcccattatatttgccgccttggcattgccatatgtagaggtgtccgcaagggcttgcagctgccgcgcgcatatacgaaaagcctcccggaagcgttggcaatccaatgcttccaagaggctcaagccggtgcgcgagatgggacttgaacccacacgtcaaagacacaggaacctaaatcctgcgcgtctaccaattccgccactcgcgcgtgcatatccgcgtttccacaggtgtggaagatatgtaaaaccctaggccggacagccattacagaccagccagcctagggcatccgagccacttgtcagaatcgaactgacgacctgctcattacgagtgagccgctctaccgactgagctaaagtggcttggttcgcggaaggcatttcgccagccgcgcacaagaagttaagtataagacatccccacgaaaagtccaatcggcggattggcggttgtgtcgcgaccgctcagtcgaagatgacggttgcgccgcgccgtgaactgttcgataatgcaaacgatggcaatccgacatcgctgactcattttgttctgttcatgtccgaatttgtgagtattctgtttggtgatacggagcgcatccgagccgtgtgcaagggcgctccagtcactgatgaaaggaatggaatcctatggccatcaatccgcccgttgacgccacccagacccctgagtgggctgccctgcagaagcactatgacgagcttcaggtcgaaggcgtgagcctcaagaagtggttcgccgaggacgccgagcgcgtcgagaagctgtccttcgacgccggcgacctgcacttcgatctgtccaagaacctgatcaagccggaaaccctccagctgttcgccaaccttgccaaggccgtcaagctcgatgagcgcaccaaggctatgtacacaggcgtgcacatcaacaacaccgaagaccgcgccgtgctgcacaccgcgctgcgccgcccggtcgaagacgagggcaagtacatcgttgacggtcaggacaccgtcaaggacgtgcgcgagacactcgacaagatctacgctttcgctgacgacgtgcgttccggcaagtggaccggtgtgaccggccgcaagatcgagaccgtggtcaacatcggcatcggcggctccgacctgggccccgtcatggtgtacgaagctctgaagccgtacgctgacgctggcatctccgcccgctacatctccaacatcgacccgaacgacctggccgagaagaccaagggcctcgacccggagaccaccctgttcatcatcgtctccaagaccttcaccaccctggagaccctgaccaacgctcgcgaagcccgcacctggctgctcgaagagctcaccgccaacggcgccatcgccgagggcgacgaggctcagaaggccgaggccatcaagaagcacttcgtcgccgtctccaccaacctggagaaggtcgaggagttcggcatcgacccgaacaacgcgttcggcttctggaactgggtcggcggccgttactccgtcgattccgccgtcggcacctccctgaccgtgatcttcggcccggcccgtttcgaggagttcctgcacggcttccacgagatcgacgagtacttcgccaacaccccgttcgagaagaacgtcgtggtgctgctcggcatgctgaacgtctggtaccgcaacttcttcaaggttgcttcccacgccgtgctgccgtacgaccagtacctgcaccgcttcccggcttacctgcagcagctgaccatggagtccaacggcaagtccgtgcgttgggacggcacccccgtcacctccgagaccggcgagatcttctggggcgagcctggcaccaacggccagcacgccttctaccagctgattcaccagggcacccagctcattccggccgacttcatcgcgttcgtcaacaccccgaacccgaccaaggacggcgaccaggacgtgcacgagctgttcctgggcaactacttcgctcagaccaaggctctggcattcggcaagaccgctgacgaggttcgcgccgagggtactccggaagagatcgttccggcccgcgtgttctccggcaaccgtccgaccacctccatcttcggtgtggctctgaccccgttcgcactcggcgagctcatcgccctgtacgagcacatcaccttcgtggaaggcaccgtctggggcctcgactcctacgaccagtggggcgtcgagctcggcaagcagcttgccaagcagatcaccccggccatctcccaggacgacgacgccctcgccgcccaggacgcctccacccagagcctgatcaagttctaccgcgcaaatcgcgaattctgattcgctttgctcggtcagaattcgtgattcgcgcgaccgcggctgtgctgtctggtgggcagtctggcgactgcccacgttgcgaattctgattcgcttttctagctcccctcaatactgaggggagctgtcagcgaagctgactgagagggagttatggaacgctccgtatgctccccccctcaactatgactgttgccggcggcgaaactactggaataatcaccgtccatcggactctcaccttcttcaagccgtgcgctgaaacgccaaatcaataccatcgtcggtatccatgcgaccagcaggagggacggaaagtattcgaatccgccatccgtgctgcctcggccaaactgatgcgttaataacggagagagacgacgacacgccgatactgtccgcaagaatccgtacaataatcgattgctgtgtcgagaagtgggccgccgcataagcccgcgtctccgtgggtccagtccgaacggccgcaaggcctggcttttggcggatcggcaggcttcccaagggcaaactcgagggataacgagaacaggtcaacgcgcgcgatgcgcaatcgcgtggatggccccagatctgtggctgatatgcggcagcactgaaggaaaacaatggttaacgctgttgaggcttttgacgccaagcacatgaagccggccgaggaaatcccggccttccgtcccggcgacaccgtcgacgtgaacgtgaagatccaggaaggcaacaactcccgtatccagaccttcaccggcgtggtgatcgctcgtaagggcgctggcgtgcgtgagaccttcgtggtccgcaagatcagcttcggcactggtgtggagcgtcgcttcccggtgcactccccgtccatcgactccatcaagctcgtgcgtaagggccgtgtgcgccgcgccaagctgtactacctgcgcgctctgcgcggtaaggccgctcgtattgccgagcgccgcgacaactccgctaagtgagtcgattcgcgggtgcaatcgtgagcctgatgatgcaggcacgcgaataaaccgtgaaattcagcccggaaccgtttcggtttcgggctgttttcgtattttccacgtatgatggacgggcgccggcacccctcatatccggcagcatgaatcgcgaggagatggtatgcaggacgatcaggataacggcgaattcccggtttccgacaatccggagagcaaccagacctcgtatgatgacgaggccgatgcccgcgattcccgcacgttccaagtcgctgaccatggcatcgccctgtccccggttcccccggcaccggcgcgcccggcgcacgccgcttcttccgctggcgcgggtgcagccgctggcgcgaatgccgcggcagcatcatcgtcagatgatgaccacttcaccctacgcgactttttcctgtggtgcggcgttcccgtgcttatcgtgctgctgattcgcattttcgccgtcggcttttacgagattccttcgcgctcgatgatggacaccacggtgcccggcgatcgcgtggtgaccagcaagctcacccccaagatcttcgatctgcagcgcggcgacgtcgtggtattcaaagatcccaacaactggttgaacgaggagcagagcagtgctcccggtggcgggtatctcatcaagcgactgatcggcctgcccggtgacgtggtcgaatgcaagggcgcgggccagccggtgaccatcaacggcgtggccatcaatgagacctcctacattcgccccggcgtggacccgagcgccttcccgttctcggtaaccgtgaccgagggccgcgtgttcgtcatgggcgacaatcgcgccaattccgccgactcccgctatcatcaggatgacggcgatcgcggcttggttcccatctccgatgtggtcggagtcggaatcgcgaaatactggccgcttgaccggcttggtgcgattgatgaccaccacgaagtcttcaaggacgtgcctgacgcttccggctcgaattcctgagtctttttttgaaccgtgtgagtctttgaactgattgagttccgggccgtctgaatcctgaaccatatgaatcctgaaccgtctgaatcctaaccattgtgagacgatgggagccgcgcatgattaccccgacacttgacttggaacgcatccttgcggcccagggctatgaccttatcgctggattcgatgaagtcggccgcggcgcgctcgccggtccggtgatggtcgggtgcgccgccatttgggcccgtgatttggagccgttggatggcgatgatgccgtcgaactgtccgggcggacctacctcggcgtgccggacggcgtggccgactccaaaatgctcaccgaacataggcgcgaggcgattttcgacgaactgcgcgactggtgcgcggcctacgccgtaggccaggccagcaacaccgagatcgacgaatggggcatcacctacgcgcttggcgtggccgccctgcgcgcgctcagccaagtcgaacgcgaacttggcttacgacttggaggggaatcgacgataaaaaaggcttcgggggagtctgcggggaagattgtggaaggtcgtccgggaggctccgtaggggaatccattggaaattgcgagggaagcgttcgcgctctgcccaaagtcgccggaattctcgacgggccgagcgattacatcaccaaggcgctcaacacgttcgacgcgccggacgtgccgattccagccgacataacgaccaaagtcaaaggcgaccagcattgcgccaccgtcgccaccgcggcggtcatcgccaaagtgacccgagaccggctgatggtcgacctcgcgcaaagcaacccacgttacgccgcctacgaatgggctcataacaagggctatggttccgccgcacaccgtgccgccatcgccgagcacgggccgactccgctccatcgtgtctcatggcacctgacctgagccgcgtgcgacacgacagtgtgagcgctaacgcaaaactgttgtggacgcgctaaagtcagtattgattaaggtacaagactggccgtgcatggatgccggccgccagcggggaggttaggcaatatggtgaccagccgcaagccaagcaaacgtccgtccatgttcgaagtggccaagctcgccggagtcagccaccaaaccgtctcccgtgtgatcaatgactcgccggacgtttccgacgccacccgtgcgcgagtccagaccgccattgaccaactcggctaccgcccctccaactccgcgcgcgcactggcttcccgccgttcgcgcaccatagggctgatcgccggaggcctcaaattcttcggcccgatttcctccatctcctccatcgaatccatggcccgcgagcacggtctgttcatgagcgtgatgatggtccacgaggccttgtgcgcgcaggccgacttcgacaacctgtgcgacaccttcaacgagcagaacgtcgacgccttcatcttcctgaccccgaccgacgtgatgttcgccgccgcctgccgtgcacgagtcactcagccgcgcgtcatcgtcaccgccacccacggccaaatgaccgtgcgtgagggattgggccttatctccaccgaaaacaagcgtcgcactgcgctggtcggtatcgaccagtggggtgcaatggccaaagtggtggccttgctgggcgaatacgggcacaaatcggctctgtattttgccggtcccaacgaatggcgcgacgcccacacccgactggatgcgtggcgcaagctcgccgcctcccgatccatcgattcacagatcgtgcgctgccatacgtgggatgcctctgaggcatatgcgcacatgaatcatctcattgatgagtatgggcgtcgaggcgcggcgttgcccaccgcggtcgtcgccgcgaacgacaatcaggccgtcggcatcatgcgcgcgttgcatgagcatgggcttcggattccgcaagacatcagcgtggtcggattcgacgacatgtctggcgtggataacatgtacccaccgctgaccaccgtgcatcccgatttcgaggggctcggcgtggccgccatgcgagagacgctgcgcttgctgggggagggcggcgagccgaccttcctgaccacccagcacggcatggggctgattcccgccgaggtgcgtgctcggcggtccttggggccggctcctcggcggtaaattggccctgttatcaaaccgttatgatgcgtgacacggtataagttgtgtcgaatgcaggttatcggtacaatgttttttgggaaattgtgagcgctaacaccctccccaaggaaggggataacaacgccggcgctccaaggcaaaggaaagatatggcagcaaccgacaacgcggccgagcaggtcgcccacatcgccgagaagattcgcgctggcaagaccacgctgggcatcgaattcggctccacccgcatcaaggccgtcctcatcgacgacaacttccagaccatcgcctccggcgactacagctgggcctctcacttggaggatggtctgtggagctacaccaccgaggagatctggggcggtttgcagtccgcttacgcctccatggccaacgacgtcgagaccgcctatggcgagaagctcacgcacgtcggccacatcggcttctccgccatgatgcacggttacctcgcattcgacgaggccggcgaactgctggtgccgttccgcacctggcagaacaccaacacctccgaagctcacaagaagctctccgagctgttccagtacaacatccccgagcgttggtccatcgctcacctgtaccaggccgtgctcaacaaggaagagcacgtctccaaggtggcttacttcaccacactcgccggttacgtgcactggaagctcaccggtaagaaggtcctcggcgtgggcgatgcctccggcatgttcccgattgacccgaccactcacacttacgaaaccgcattcattgagaagttcgacgctctacctgaggtcgcagcccagccgtggaagctggagaacctgcttcctgagccgcttgtggccggcactccggctggcgagctgaccgaggaaggcgccaagctgctcgatccgtccggcgccctgaagcccggcatcgtgctcgccccgcctgagggcgacgccggtactggcatggtagccaccaactccgtgcgcgtacgcactggtaacgtctccgccggcacctccatcttcgccatggtggttctggagcacaagctcaaggccctccaccctgaggttgacttggtcaccaccccggccggcgatctggccggtatgagccacgccaacaacttcacctccgacctcaacgcttgggtcggcctgttcggccagttcgccaaggctatcggccagccggttgacgcaggtatgctgtacggcaccctgttccgcgcggccatcgccgacgacgtggacgccaactgcggcggcctgctgaactacccgttccgttccggcgaattcctggccggtctgcctgaaggtcgcccgctgttcgcccgcagccccgaagccaacatgaccctcggcaacttcatgcgcgcccagctgttctccgcgttctccccggtcaagatcggcatggacgtgatgaccaagcaggagcgcgtgcaggtcgactctctcgtgggccacggcggcatcttcgccactccgaaggtggctcagaagattctcgccgctgccttcaacaccccgatcaaggtcatgtccaccgccgccgaaggtggtgcctggggtatggccgtgctcgccaactacctgtggaacaccaacgaggatcacagcaacctcgctgacttccttgatggtttcgtgttcaaggacgcccagtccaccactgagaagccggtggcttccgatgtggttggtttcgaggacttcttcgcccgcttcaccaagggcctgcccatcgagcacgctgccatcgaaaccatcaacctcgaagataagtaagcctttctgacctccctctattgagagaggtccttgagattttgaaaaaacgtccatccagcacagtggaaaggaaaaccaataatggcaactttggctgattacggccccgaggttcgcgccgaggtcaagcaggttcgtgaggtcgtctccaacctgcaccagcagctgatcaagtggaacctggtcgtgtggaccgcgggcaacgtttcccagcgtctgcacaccgccgacctgttcgtcatcaagccctccggcctgcgctacgagtacctgaccccgtcctccatggtcgtgtgcgaccttgacggcaacgtggtcgacggtgccgaagccccgtcctcggacaccgcttcccacgcctacatctaccgcaacatgcccgacgtctacggtgtcgtgcacacccattccacctacgccaccgcttgggctgccactggtcagaacatcccgtgcggcctgacgatgatgggcgacgagttcggcggcccggtgccggtcggcccgttccgtctgatcggctcggaggcgatcggcaagggtgtcgtcgagaccctcaagaagtacccgaagtccccggccgtcctcatgcagaaccatggccccttcaccatcggcaaggatgctgaaggcgccgtcaaggccgctgccatgaccgaggaagtcgctcacaccatgtgggccgcccgtcagctcggtgacatcatcgagatcgaccaggccgacatcgataagctcaacgaccgctaccagaacgtctacggtcagcactgatttgatggagtgtccgccgcgttacggaaggcccgacgtaccttcgtacgccttcgccttccgcgccttgcggacacacacatcaaatcagcgctgactccgccagcacggtggtgtcttggctcccctctctgaggggagctgtcagcgatagctgactgaggggagcctcggtcggcgaatgaaacttaaacaaacccccataaacaaagaagtaaaggaagtaaccctatggttatggaaaaccccttcgagggcaaggaaatctggttcggcgttggttcgcaggacctgtacggcgaagaagccctgcgccaggtcgccattcactccgctgaaatggtcgactacctgaacaacaccggcaagattccggccaagatcgtcctcaaacccaccctgaagtcctccgacggtgtcaaggagttcatggtcgaggcttccgccaacccgaacgtcatcggcgtcatcacctggtgccacaccttctccccggccaagatgtggattcgcggcctcgaagtgctgaccaagccgctgctgcagctggccacccagcaccacaaggaaatcccgtgggagaccatcgacatggacttcatgaacctgaaccaggccgcccacggcgaccgtgagttcggttacatcgtctcccgcctcggcatcaagcgcaaggttgtcgtcggtcactacaccgatcccgaggtcgccgagaagctcggcacctgggcccgcgcctgcgccggctgggatgcctccaacaacatgaaggtcatgcgctggggcgacaacatgcgtaacgtcgccgtcaccgagggcgacaagaccgaggctgagcgcgtgttcggcgcctccatcaacacttgggccgtcaacgagctcgtcgctgcgtacgacgccgtcaaggacgaccaggtcaaggagatcatcgaggactacaaggccaagtacgacgtcgacccggctctgctggacgccaagtacgactccctgttcatcgccgccaaggaagaggccgcgatggtcaacatgatgcgcgccaacggctgcaccgccggcgtcgacaacttcgaggacctcggcgctctgccgcagctgccgggcgttggcccgcagcgcttcccgtccgagtacggctggggcttctccgctgaaggcgactggaagaccgccgtcctcgtgcgcatcggtgccgtcatgggctacggccttgagggtggcgcctccctcatggaggactactcctacaacttcaccgagggtgacgagctcgacatgggctcccacatgctcgaggtttccccgtccatcggcaccatcgccaagccgaagctggagatccacccgctgggcatcggcggcaaggccgacccggtccgcctggtcttctccggcaagcccgccaaggacgccgtcgtggtctccatgtccgacgttcgcgaacgcttccgcctgctcatggacgtcgtcgacgtcgttgagccgcagggctccctcaaggagcttccgtgcgcccgcgccgtctgggagccgaagccgagcctgaagaccgctgttgagtgctggatcaccgccggtggttctcaccacacctgcatgaccacctccgttggtcgtgaggcttgggaagacttcgcccgcatcgccggtgttgagctcgccgtcatcgacgagaacaccaccgctcgccagttcgagaaggaactggagctgtccgagatgtaccaccgtctcaacaaccagcactgattggcggagcgtataccgcctttcctcaggttcgacgtaccttcgtgcgccttcgccttcggacggcggtctccgcacgcgccaatcagcgctggcaagccagcaccgatgactaaatcagtctgctgactgctaccgctgaaaaggggctgttccgggaaaccggagcagccccttttgctgttatcggcaactccccacaaacgcatcaaaaatcgcctgcgagcgtggatctaccttgtagagaaactcgggatgccactgcacggcccacaggaagtggcttgccggccggtacagggcctcgatcacgccgtcgggcgcgacggccatgacctcgagtccagcagcaggctcacgaaccgcctgatggtgatagctattcaccgcaatctcagtctgccctgcgaacaatgaagccaggggagtgccgggcaccaaggaaacgttatgtccgaacgcatcgtacggcggattcatatggtgttcgatatcgctcggatgctggcttggcagatcctgccacaacgtgccgcgcagcgctgcgttgatgaactgaatgccacggcagatgcccagaatcggcttgtcccaagccattacagctggcagcagaatcgattccattcggtcgcgctcaggagagagcacctcgctacggccggtggcggaggccgctgcaccaaccatcggtcccacatccggcccgcccgtaaacagaaacgcgtcaaaccgttcggcgcattgcgcaagaatgtcggtgtcatcggtcagcggcaacatgacgggcgtaccgccggcccgcattatcgcctccatatatccgggcagcatccacagactatcgcgcccgtaatccatcagcggagtcaccgcaatgagcggtcgattcgtagtcatgcctgcctcttttcgcccaggtgttgttttcgtcgttctgccgcgaatcgcttgattcagtggccgataatgccgccactgtaccgaaccaatgtaaccggtcggccaacattatttcgtcagccagccgcgacgagatcgcacaatgtgccaatgatgggggcattcggtgtgaccttgtcaatgttcgggccattgcactttcagcggggaaagcatgccccgtccgcgcatcatgatgaacgagtaaggttgacggggagggagaatcacatgaaccaggcatgcgtacgcaacgacaccatcgacgcgggcaaccatcatggccgaccgcaataccggtcgttcctgcgatttctgacatcgcaggaacgcaacgtcatttggctgttgctggccattgcttttcttccggtggacggcaccacgcttggcctgtacgcgccgttctggtcgccaatcagtccggcgctgttcgccgtgtactgcctatgcaattggcggcaactgcgcatcgcagccaaccggtacctgccaatgttcctcctaccggtggcctgcataatcctgtccatcccgggatggctgaagttcggcatccacctcaacgccgcgttcatgagcatcaccggattgctgggcgtgctcgccactttgggggcgatcgcccttgcgttcgacatcaaacgcattccgtggcgtacgccattgcggattctcatcgcatcatactgggtttccttcggagtgggcgtcgtgcaatggctgtccatccgtctgcacgccaaaccgttgaccgactatttctcgcacctcatgtaccggcaatacatcagcgacaactcggtgtggggcggcggccgtccgcagttcctgttcgccgagcctagctatatcggcatgcacctgttcggcatactgcttccgctcatgtggctcatgcgcgggcgcgaccgcatctacgccaaacggctgcgtgacctcatcgtcacgtatgccgtcggcgcggtgctcatgcaagccggcaccagaatcgtcatcgattccgtcgtggcgttgctgatcgcccttgtggcgcgcaccgattggcatgacggcgcacgccgcgtccggggcatgctgcagattctcggcgcatgcgcactgggcctgctgggtgtgctggcggattccagactctccgccatcgcggaaaacggggccgagggagacggctcgttcttcgcgcggatctaccaaagcctcgatccgatatgcggattgctcacccatccgtggacgctgctcaccggttatggcgcgggcaacatcatcaatgcggtgtgggccggcgcggccaaagccggacggctgctggacggtcttggcatgaacggcggcgcggccacgggattcgcggccggcgtgaacgcggacacggtgtggacgatgtgcgcgtataccagcgtcatcgccgaatacgggctgatcgggctgggcatgctggtcggagcctcgatggtctgcatgacgcgcgggaggacggtatgccgtggcggtgcggatggcgcatcgtccgacgagctggcgcacggtgtttgtgtcgccgacgttgccgacgttgctgatgttgccgggggtaatagtggtggtggcgttgccggcgcgggttcgggcgaatccggcgtctggcacaagaccgtcatctgctggctcgtcctggtcgcatacctgtacatccaatgcgagaactatgcgttcgccgctctgccgcttcttgtgttcgccgcctcgaaggtgaggcgcgagcctgatttctcgcgggccgacgcatcgacgcggcccgagatggaccaaaatccagaataaccgacattcgccgctgttccgtttttcgctcaaggcgtatatctcccgtatcttgaggtgcatcatgtatcgtcgcggctaactaatcggcgaaacgcggcatgtttcgcattttgggcgaaaagcccaagtcccacaggaggtattgatgacgttcgttgcacggtcggtgcgctatgtgctcagaaaacgagtgcgaaccatagtgctccttataatactgaccatcataacggcgagcatgctatccacgatcgcggtttctcgggcagctcaacaggccgccggacgaatcgagaaggaagcggtcggtggattcgtgctgtccagcaacatgcagggcagcatgctcacgcctcgcggaggcggcatggtgcgccccgccgacgtgcgcaggatcgcccaactgcccggggtcgattcgtatatggtccgtcagaacgccaccgccgatctcgtgggggcgaatgtggcgaaggtccccggcggcgatgattacgatgcgacccaggagcagcagtttggcaacgccgccaacgtcatgggcacgaatgattcgtcgaaactcaacgtgttcacgtcgcgcacgctcggcatggccgaaggacgacatctgaaggcctccgacaagtacacgtcgatgatccatgaggatctcgccaaagccaacgggctcaaagtcggagacacgctcacgctcaaggccaacgcctacgacgccgacaacgaatcacattcgacggcgaccgtcaagaccaccatcgtgggcatattcaagggcgacagcgccagaaaggtatccagccgagcggaactcaccgccaacaccatctacaccgatctggataccacacgcgatctgtaccagtacaagggcggcaaggaaatataccaggacgccaccttcgtgctgtccaagggcgttgacgtggagaagaccatggacgccgcaaagaaactcccggtggattggaacaactatcagatcacgcgcaacgaccagtattcgtcgagcatgctgcatgccgcccgcggcgtgcgctccatgatgcgcggcgccctgatcggcgtgaccgtctcggccgtgctcgtgctcagtctcatgctgctgctgtggatgaacgaccgccgtcaggagatgggcatactggtgtcccttggcgtcggcaagccctcactggtcgcccaatacctcgccgagatgatgctgatcggtctgccgtcccttgccctcggctggctgtgcgcgcagggaatggcccaatggctcggcaccacggcgctccattccgtgaacgcctccgcggcgaaggagctgagcagcatggggcaggtcggcggcgatcttgaatccagcatgtcggtgcgcaccctggattcgctcacggtgtcggtcgatgggaccgccatgctgtacgtggcgctcggcctgttggcggtgatgctggtgtgcgtcgcggtggcgtgcatgccgatgctgcgtaaatcgccgcgagacctgtcggagattcgatgatgagcatgaatgtgtggaagcgtgccacgttggcgatcgtacgcaagccggtacgcagcggtatcatcggtctgctgatgctgatggtcttcacgagcctggtggcgcaggtcggagtctcgacggccctgcgtaccatgtccgacagcatcggcgcgggcatgggcatagggtttaccgtcagcgccggcgagaatcccatcagcgccgaggaggcgagccggttctcgcgtatccccggtgtgacgaagaccgcctatgcgacgaagaccttggcgcaggtggatggcgcgcgcccggtcatgccccggcagggcccccggctggactccgatctggccatgcaggtcagcgtgctgggcaccaccgattcctcattgtcagaggaattccagagcggcctgtaccgcctggagcagggccgccatatctcgggcgacggcgacgatgtgctggtccaccgcgacttcgcgctgcagaacggcctatcgatcggctcgacattccgtctccggcaggaggggcgcaacgccacggtgcgtgtggccgggatcttctccggcaacgtgcaggcccaaagccccctgccctcggacacttccgagaacctcatctattcgggcaggcgagtgacctccgctctgaccggaaacgaccagatcggcatgatccgatgcctgtcggataatccgcaggacctgtccgcggcggtcagtcaggccaagaccatgaccggtggcaagtacgacgtcaccgacgattcggcccggctctccggcgtcctgcaatccgtgcagacggtgcgtgatctggtgcgcatggtgctgctgtccgtctgcctcgcggacgtactggtgctggcgatggcgctggtcttctggattcgctcacgcatccatgagataggcacgcttctggccctcggcatcgacaagatgcggataatcgcacaactcgccatcgaaaccggactcatggcggcggtcgccgccctgtgttcgctgggcaccggcgccatgctgtcgggatacgtgtcttcccgactgttgcgcgattcgggcgtcgcgccattggaatcgttgcacgtggaggccttgccgcctgagcagacggtgctcatcctgctgctcggatgcgcggtcatcgccgtggcccttgccgtgtcatgcgccgccgtgctgtccaaatccccgaaatccattctttcctctatgcgttaggagtcaccaatcatgtctaactgtctgcaactggaccatgtcgattacgcctacggcgcggcgaagatccttgttctctcggatgtcagcgcggatttcgaatccgggaagatgtatgcgatcaccggcccgtccggcgccggcaagagcacgctgctgtctctgctggccggcctggacgccccctcccggggagtggtccgcttcgagggggaggacatcgccgcttcgggctatgcgaagcaccgtcgggagcacgtgtccctggtgttccaggaccataacctgatcgactacctcacccccgaagagaacctgcggctggtcagcaccaaggccgatatgaagatcctcgaggaactgggtttgagccgtgaggaatccaagcgcaacatcatgcacctgtcgggcggccagcgtcaacgggtggcggtcggccgcgcgctggtcgccccgggccgcgcgatcctcgcggacgagccgacgggcagcctcgacccggagatgaccgacgaggtgattcatctgctgcagcatgccgcccatcagctcggcaaatgcgtaatcgtggtgacgcattccaagcgtgtcgccgactccgccgatgtcgtgctgcgtctcaggagcaagaaactgacccgggcgtgacctacctgggccgggcggcacccatacaccgcttcggcatttcggcaccccggcgaccgggcactccggtatcccggcccttcggcattctggcacccccgcgctccggcaccccggcgacccactcgcattgccggggtgccgtattcgctctgcgccataatgtgcgtgataatggaaccatgccagtgatgaatgatgaagtgcccggcgaggttgaaccgcaccccgattgttggactggagtaatccagattcgatgatcggaggtgcggttcaaaaggcccttttttgtgtcggattacgaaccgcgcgtttcaccgcttgccgttgtagatctcgttgtcgatcacatcggcgaacacgcggttgacggccgggcgcactaccttcagcgacggcgtcaggcacttgttctcctgcgtgaactgcgtatccagcacggcgaacttgcgcacggactcggcgcgcgaaaccgtcgcgttcgctttatccacgtactgctggatctcttcgcgcactgcggcgttcgtggcgagccggtcaaccggcgtctccgtggacagtccgtgtgcgggcagccagatggccagcgactccgggtcgagcgtcaccagcgcgccgatgaacgggcgctgatcgcccaccaccacgcaatgctccacaatcgggcacttggcaatctcctcctccagtggaatgggggagacgttcttgccgccggcggtaataataatgtccttgattcgaccggtgatgatgatgcggccggcgtcatcgatctcggccaagtcgccggtcctgagccagccgtcggcggtgaatgcctcggccgtcttctccggcagattgtggtagccgcggaacacgttcgggcccttgacctgcagttcgccttcgtcggaaatgcgaatcgaggagccgggcgcgggctggcctacggtgccgatcacattgtcggtcacgcgcgtggcggcgaacggggcggcggtttcggtcatgccgtaaccctgaatcatcggcagaccgatgccgttgtagaaatgcgccaaatcaagcgacagcggtgcgccgccgcaggccacgtacttgatcttcgggcccagagcgccgcgcaccgtgcggtagacgagcgtttcgtacttggcgcgctcggcgatttcggcaaatgtgtgctgctcgccggcctgctccttgcggctccagatgcgcgcggcctcggcggctttgacaaacaggcggcccttccagccggcaccggccttatgcgaggcggcgttgtacaccttctcgaacacgcgtggcacgccaagcaggtaggtcggttcaaacgaacgcaggtccggcagcagggttttggtgtccggcagataaccgaccacgccgtcatcggaggcgatggaggcgtactggataaatcgtgcgaagcagtgggccagcggcaggaagagcagcaggcgtggatggtcgtcaagcaccacttcatgaagcgcctgcgaagcggtgatggtgatggacacgaagttcttatgggtcagttcggcacccttcgggttgccggtggagcccgaggtgtagacgatggtggccagatcgtcggcgcgcacggtggccacgcgctcgttcagttcctcgtccgaaacagccacgcccagaccttcgagcgcgcccagtgcattgccctcgagcatgagaatctgcttcaaggcagggcagtggtccttgaccgagtcgagccggtcgaagcgctcgcgattgtcggcaaaggccagcttgaccaccgaatcgttcatgatgcgctgggcctgcggggcggagtcggtgtcatagatcggcacgcttaccgcgcccaccgcggccagtgcgaaatcgagaatgccccattccagacgggtggaggaaaagatggtcaccgcgtcgcccttggcgatgccgagcgcgatcaggcccttggcggccgagaccacgcgctcgtggaattcgccggtggtgacgttctgccagcggccggggccgattttcttggcggcgattaccgtgtccgcgccggtgcgggcaaggcgatcggtaagtagggagtagatggtctggttgtcgcggatttcgatggattcgccaggcgtggtgtagtggtcaagcataagcgggccgtgtccttacgtgcgttgcgtgatggctgttgacaaaatcgagccattctgacaagttaggttacgctggcgtaaggttgcgcgcgttgtgggcaatggagaagttgtctgtctggttttgtggattgtatacaacgccgtgtctaaccggtttgctctacggttatgacaccgtgtccatttcgggagccatcgacttcctgcaggacaagtacgcgctgaacccggccctgcagggtctggtcatcagctccatcatgatcggcggcgtgatcggcgccggcttctccggcttcctgtccgataagtacggccgccgccgaagcactggtcgccgcgcaaaaagcagcactaggccgcgtttgctgcgtctattggcgaattgatcatatgggtcgtctgcgtgcagacgacccttttgcgttccgtcggcttctgacaccgtagaaacgtgctttctcggcttcgaggggctgattttgccttatctggaagtctacttccacttcgaggggctgatgcccaagtagacacggccctaaaacggcggaatgacgttgacgtgtagccgtttatacttccgattacatggatgaggagcccctcgaagcggagatagacttccggcaaatgcgaaatcagccccttgaaacggaagtaggcctccggcaaacgcaaaaattagcctcctcgaaacggataaatgcacgtattgggtgtagtggatgcttcagcccctgatatcgaagcatattttttctggttggcgcgtctagcatgcgcactccgcaatcgataattctgtggcctctctcactttaaaagtctggcgtgtgcgagggcgttcgcttaaggtgaatgggattgcgcggaatgtggagcgcagggtcatgaccatgcgcgtgctgcagatccagctgcgctcgctgaccgccatggatatcgtggcctacggcggtgcggcggccggcattggtgtggctctatggcagtatgcgcataccaccgcagccgccgcaggagccagcaccgccggctggtcgccgatcatgctcgccgcccacctgcccggcgcattcgcctacctggcctacggcctgcaatacctgatgccgttcggtgcgggcttcccgctcaccctcgccggactgctgctgattgtgctgctgtccgccgaattctttattcccatgcgtcagcttggctcgttcttccacgtggcgatgaacggcatgacctccaccaagcgcatcttcgctctgctggacaccccggagcccgagcatggcacggcgaccctgccggccaacgattccgattccgctgacgacggtctgacggtccgcttcgaccacgtcggctattcctatgatgatgccgggcacggcgactccaagtccgcatccgcaaagaccgataagcaaggtgaaaccagccccaattccgccgtcgctcctgcgctcaccaacatcaccttcgccgcacggcccggtcagttcaccgccattgttggcatctccggttccggcaagtccacggccacctcgctgctcgccggtacactggccggttaccgaggttcgctcacgctgaacggcgtcgaggtatccgatttgtcaggcgaaacactggccggagccgtcactgtgattggtgccagcagccatctgtttgcgggcgcattgcgcgagaatcttctgatggccttgcccgatgacgagattcctgattcgccggattccgtggactcccgtctgtggtccgcgctcgagcaggcgcgcattgccgacttcgtgcacgcacagccgaacggactgggcatgccgattgagtccgatgccgccaacctgtccggcggccaacgccagcgcatcgccatcgcccgcgcgctcctgcatgattcgccggtatttgtgttcgatgaggcgaccagcagcgttgacatggaatccgaagagctgatcctggatacaattcgcgaattggcgcaatcccgcggcaagacggttattatgatcacccatcgcatggccaacgccgaacacgctgatcaagtggtggtgctcgaacacggcaagtcggttgagaggggcacccataccgagctgatgacggcggacggcgtctacgccaagctgtttaccacgcaggcagatattgagaacttcggagaaggccatgctcggcgtgtgctgcaggttggttcccgcaagcaggagctgtccgacgacagtcggactgagggtggcgcagcgcgcgtaagcgcagaggcgggtatgacggttgaccgcctgcagtcagctttgccgacggcttccgttggcgggagtgagcaggcctcggctgagactccggctggtgttgcaaatagcgattcgtcttccaaaatgagcacattccaagtgatcaggcgactgcttaaggaagcccgacctctggcaggactgatggcagcggcctccaccgccggcaccatcggccatctttcggccactttcctgcccgtgttcggcattatcgcggcatttgcacttaccggtaatctggtgtggggcatgggtgttgcgcccgccgtcatcatgatgattatctgtgctcttctgcgtggcatcacccgatacattgaacaatatctgaaccacaatgtggcattccatctgctcgcactcttccgttccaaggcgttcgccgcgttgcgcagactggcgccggccaagctcgcgggcaaaggtaagggcaaccttatcgccatgctgaccaccgatgtggaactgcttgagatcttctttgcccacaccatcagtcaggtggccatcgcggtaacctccaccatcatctacacgattgtggccgccaccctaagcccatggatggcgctggcgttgattgccgcccacctggttatcggcatccttgtgccgcgattctttgccaccggcgtacgtaaccttggccctgccatccgtggcgctgccggagaactcgacgatgtgatactcgatgacatgcgcggcctggacgaaatcatccgatttggccgcggcgaggaacgtgcgcaggccatcgaggaccgtacccatgcgttgtggaaggatcacgccaaactcagcaaggtcaacggccgtttcaccggaatcagcggactcttggtggctgtgctcacagcggcttcggtcgccgtggctattgcctgtgccggcgcgaacccgcagagcattccggctctgattgccgctttcgtgctgttcgccggctcgttcgaaccgactttggcgctcgccgccttgcccgctaacctgactcagaccttcgcgtccgctagccgactgttcggactgatggacgaggtgcccgctgtgaccgagaacggcactgttgcgccgcaggagtatatgggcatgcgtcttgatgacgtcacctttgcatatgcgggggagcatgaagtcctgtccgacttctcgcttgacgtgccgcagcatggcgtgctgggtatccaggggccgtccggccgaggcaagtccaccatgctcaagctgctgctgcgctactgggatccgcagcgcggtcaggtgacgttgtccggcacgccgttgcccgaggtcgatgtgcatgctcgccgacgtattcaggccatgatgagccaggaaacccacccgtttgatggctctatccgagacaatctgctgattgctttgcctgagtccgaggttgaagctgcaaatgttgcaggcaatggggaagtgggtgccaagaccgttgattcccgacagcagcggttggcggcgcaatcggcagagggcgatgccgttcaggtggcagcatctgacggtctcgacgctcgtttgcgtcaggctctcgccaaggcctccgtgcttgatctcattgattccctgcccgatggccttgatactcaggtaggcgagctgggcgaccgtctatccgaaggtgaacgccagcgtatcggtttggctcgtgtgttcctgcgcaatgctgatctggtgcttttcgacgagccgaccagccgtttggatgctttgaacgaggctattattctacgttccattcacgctatggccgtgggtgagcagcatgcagacaaggagcgcggcgcggctgtggtgctggtctcccaccgcgaatccgccatgcgcattgctgatgcggtactcaatctgtaactgcctgtaactacgcgggaatcacatcgcattgcgttacgttaccgcgttgcactgcggttcctcgcgggtggcggcgatgccatctccggtcgtcattgcgttgctgcgtttgtgttgcgatatgtgatgcggcaacgcagcaatgcggcaatgcaatgtgatgtggcaacgtggcaacgtagcgatgcaataacgcggtaacgtgacaacgtagcgatgcaataacgcggtaacatggcaacatggcaatgcagtaacgcaacgcagcattcacgccttgatcaaagcgccgatgatgagcgccttctgcagccctgggcggaacaggtcgtgaaattcatgcgacatttcggtttcgagtttgaccgatgcatggatgtcgtcagtgcgaaggcgtgcctgttcggtgccgatgatgtgctcgagcaccgcgaatccctcttcggttttgccggcttgaatgaggaatcgtgggctttccggtgctcgcaccatggagagcaggaacgcggcggccggaatcgcacccagcctcagcatccaacgccaaccggcgttgacatcccagcttctggaaccgtaggaggcgatgatgtagttgatgacattggtcaggaagatgccgcataccgcgaggagctgataggaaaaggcaagcagaccgcggatattgaccggcgcttaaggccagaccgaacgtatatttgcccgatccgtgagtacgtatggttggtcccaagggattgcgctgcttggaagtagcttgaaacaggcccgccatgtgctttttcctctcaatacagctatggggggctgttcatactagtcagattcttgtcatatggcgttgaatatctacaaatgtgggcactggtgaggcggctgagtggtggaatcgcgccgtggtgtgtgggtgttggggactcacgagcatgctgcgcgttatttggtggtgtgctgagagtcgggacctactcacgttgggggaggggatgaagagcctctgagacaagtcgctgttcgactggagatttgctcacgtggaaagcatggaaaaggcgaaaaaaatcaggcgtgtcgggtgatttgacaaattggtacacaggtgtatcatcttaggtattggtacacgggtgtaccaaagaaaacaccccaaggaaaggtggccagaggagacttcgcaagcggccaaacgaattgaaatccaacgcagcagtcgattcgtttttggcaatcggaaggcagtcgtcaacaatcggaaggcagccaaagacagccggaagataaccgagaagtaaccggacgaaaaccggaagccagtcggaagaaagccaaccacccgcaagtcaactccaatggtccagaaggagataacatgcgcaacaccaagaaggtcatcgcggcaacggcagccgtggccacgctcgtcggtctcgccgcctgcggcagcagcaacgacaacggcgccaacaagggtgacgctgacaaggccgaactcgtgttctggggctgggattccggcaactcgatgaaggaaatcctcgctgacttcgagaaggccaaccccggcatcaccgtcaagttcaacaacaccggcaccgccgagaagacctccaccgcgctctccaacgccatcgccgcaggcaacggcgcccctgacgtcgtgatgctcgaagatccgaccgtcacccagttcgccgtcaccgatggcctcgtggacctgagcgaattcggcgccgacaaactcgccgacgacttcgccgccggcccgtggaacaagctccagtacaacaacaagccgtacgctctgccgattgattccggccccgaaatgttcttctacaacaaggcagtgttcgacaaggccggcgtggacggcgagtccatcaagacctggaacgactactacgaggccgccaagaagatccgtgccaccggctcctacatcaccaatctggccggtacctccaacgactatcagccgttcaccgcccagatctggcaggccggtgcccagccgtggaaggtcgatggcgagaacatcaccatcaacatgaccaaggacgagggcatgcagcgctatatccaattcgtccagaagctcatcgacgaagacctcgtggacgccaagaccccgaactggtccgacgattggaaccgcgagctcaacgatggcaccctcgcctccctgaccatcggcgcttggatgccgatcaacctcatgaccggcgcccccgatcaggccggcaactggcgcgtcgcccagctgccgcagtgggaggaaggcaaggaagtctccgccgaagacggtggctctgcacttgccgtcacctcgcagtccaagaaccaggccgctgcctacaagctcgttgagtacatgactcatggcgagggcgctcagaccatggccgacaccggtaccttcccgtccctgaagaagatcctccggtccgactccttcaccgacccgaccaccgagtccaacaagaagaccaacgactacttcggcggtcagaacgtcaacgaagtcctttccgccgcggctcagcgcccgaccgagaagttccagtacctgccgtacaacccgtacgcccagaccgcttacggcgacgaagtctccaaggcctactccggcgacatcaccctggagaaggcgcttgaaaactatgccaacaagctcgccgagcaaggcaagcagcagggctacaacgtcaccgtcaagtgacgcaaccgatctattgccggtacatccggcactgaccaacaatcaaaacctgcggctaggccactctccttccgcctagccgcccgatctcccaaagcggggatgctccccagtgtccccgctttcccgtgccctcgcctgacgtgaccgctccaatcgagcgaccccctggtagcgggcgcagcacagcaatccgtattccaagaaagcaatcgattatgtccgatcaaacaatggccgcagccccgcagccaacggtgggaatcctgcctgaggaggcggatctgcacacggccgaggcccgcgtcaacaagcacaaggccgactggcgcggctggaagttcatgtggccgttcgccgtggtgttcgtcttcgtgttcatcatcccaattgtgtacgccatttacatctccttcttcaagaagcagatggtcggcggcaccaagttcgtcggcttcgagaactacgcccgactgattcaggatccgcagttctggagctcggtgggccgcgtcactatcttcaccgtattccaggtgccgatcatgctgtttctggctgcagccatggccctcgctttggattcgatgaagctgcatggcaccaagttcttccgcatctccacattcctgccctatgcggtgcccgcagtggtctccaccatgatttggggtttcgtgtatggcgccaaatacggtctggtcggctccctcaacgacttcctcggcaccaacatcgatgtgctcaaccccgacgtgctgcttgcatccatcgcgaacatcaacacgtgggaatatgccggctacaacatgctgattttttacagctccctaagcaccattccacacagcttgtatgaggccgcctccatcgacggcgcttcggagtggcagattgttaagaagatcaagctgccggagctgaagggctcgctggccatcacggtgatcttctcgatcatcggcagcttccagctgttcaacgagccgagcattttgcagaacatggttccgggcaacgcgatcaccacgtactacacgccgaacatgtacgcctacaacctgagcttcaccggcaatcagagcaactatgccgcagctctggccatcgtgatggccatcatcaccatggccattgcgtatgtcgtccagcttaagagtatgaaggagcagatgaagtaattatgagcactgcaaccatgacttcaacaacaaccatgaccctggccgatctcaaggctcaggaaaaggccgccaagaaggccgagaaggagcgtcagaagcgcatcgacgccgacgagaaggccgagcgcaagcgcgccgccaaaaccggtttctccaacccggcgaacccgacccgctcgatggccctgaccatcgtgtgcgcgattttcgcggtctactgcctcttcccgtttgtctacctgatgattaacgccaccaagacccagtccgacttcacttcgacgttcggcctcggtttcggcaaaacgttcgccctgttcgacaacatcgccacggtgttcacctatcaggacggtatcttcggccgctggttcgtcaacacgattctgtatgtggtggtcggcgccggcggtgccaccttgctggccatcatgggcggctatgcgctggccaagttccgcttccccggccgtaagctgtgcttcgtgatcatcatcggcgccatttcggtgccgggtatcgcgctggccgtgccgcagttcctgctgttcgccaagatgggcctcacgaacaccccgtggtcgatgattatcccgagtttggtatccacgtttggtctgtatctgatgtggatcttctccgatcaggccgtgccggatgagctgcttgaagccgcgcgcgtggatggtgccggcgagttccgcaccttcttccagatttccctgccgctgttggcacccggcatcgtgaccactgcattgttcgccattgtagcgacgtggaacaactacttcctgccgttgatcatgttgaaggattccaactggtacccgttgacgatcggtctgaaccagtggaaggaccaggcttcaaccgcaggcggtcaagctatccaaaacctcgtgattaccggttcgctgatcacgatcatccctctggtgattgcgttcctgtgcctgcagaagtactggcagtcaggcctcgccgcaggcgccgtcaaggagtaacctctggctccctctgacgggagctggccgcggagcggactgagggtggtcatatggggattcgactggcgaccacccccagtcagcttcgctgacagccccgccagcgggggcggcctctctggtgttcacaacctgcaagcacagcacttcccgcaaaccgatacaataaaggatttgattaatatgactactcatagagcatttaggtggccgtccctgctgacggaatccggccgcggcatcgcgttcggcggcgactacaacccggaccagtggcccgaggagacgctggacgaggatatccgtctcatgggtgaggccggcgtgaacgtcgtatcgctggcaattttcagctgggacaagatcgagccggtcgagggcgcgttcacgttcgagtggctcgaccatgtgatcgacaggctcggcagagccggcatcgccgtggacttggcctccgccacagccgccgcgccgctgtggctgtacgaatcccatccagaggtgctgccggtagaccggtatggtcataccgtcaacgcgggctcacgccagtcgtggcagcccacaagcccggtgttcaaggaatacgcgctgcgcctgtgccgcagacttgccgaacactacaaggacaacccgtatgtgaccgcctggcacatgggcaacgaatacggctggaacaaccgctacgactactccgacaacgccttggccgcgttccgcacgtggtgcgaggccaagtacggtaccatcgacgcgttgaacgaggcgtggggcacggccttctggtcgcagcacgtgaacagtttcgacgaggtgctgctgccacgtcacatgggcggcgacgccatggtcaacccgtcgcagcagttggattacgagcggttcggcaacgacatgctgctcgacttctacaaagccgaacgcgacgccatcgagcagatctgccccgacaagccgttcaccacgaacttcatggtctccaccgaccagtgcgtcatgaactacgccaaatgggcggatgaggtggacttcgtgtccaacgatcactacttccatgagggcgaatcccacctggacgaactcgcctgctcggacgcgctcatggactccctcgcgctgggcaagccgtggtacgtgatggagcactccacctcagccgtgcagtggaagccgctgaacacacgcaaacgggccggcgaactcatgcgcgactccctggcccacgtggccatgggcgccgacgccatctgctttttccaatggcggcaatccaagtcgggcgccgaggcgttccactccgccatgctgccccacgcgggtgccgattccaaggtcttccgcggcgtatgcgagctcggtaaggcgctgaagaccctctccgacgccgggctgcagggcactgagctcgagcgtgccggcacggcgatcctgttcagcgcggaatccgaatgggccacacgctccgaaaccctgcccagcatgaaactcaaccactggcacgacgtgcgcgactggtaccgcggcttcctggatgccgggctgcgcgcggacgtggtgccgctcgcctacgactggaccggctacaaaaccatcgtgctgcccaccgtgctcagcctgtccgacgaagacgttctccgtatcgccgacttcgcgaaggccggcggaaccgtcatcgtcggctatgccgccggcctgatcgacgagcacttccacatcggcctcggcggctaccccggcgccggcaacgggctcctacgcgacatgctcggcatccgctccgaagaattcaacatcctcggtgaagaagccgaaggcgagcccagcgaaatcagcctgtccaatggtctgacgacccgcctgtggcagaacgacgtgacttccgtagccgcggacaccacagtgcttgcctcttacgcaggtgagtccgccgccgactgggagctggagcgcacccccgccatcaccagccgcccctatggcaacggtaccgccatctacgtgggctgcgacctcaaccgtcacgacattgcccagttgctcaaagcacttggctcccgatggcaggagttgtcggcgcagccgactgagagtggtcaaactccaacctatcccaccacagatccccgcatcctgcacaccatccgccgatccgcagacggctccacccgcttcgatttctacctcaaccgctcaaaccagcccgtcgccatcaacggtgtggaaggtgatcccatcatcgcccaccgttgcgagactgacgccgttggatatacgctgaaccgcaacgccattcttatcgctaaaacgtcctgctaaaccgcgctagaatggcaatgttgtccggatagaggagtgcggcatgagcgacgagaaaacagccaagcgtcgagtgacgctacgcgatgtcgctcaggccgccggtgtatcgctcaaaactgcgtcgaacgtgatcaatggctccgggcgtatgacagatgagacccgtgccaaggtcgagtcggtcattaaggacctcgactaccgagtcaacgtggccgcccgcaacctcaaccgcgatcacaccggcttcatcaccctcgccgtgccttcgctgattccgccatatctggccgagctcgccaaccgcaccatcgaggccgcccgtcagcgcgactattccgtatacgtcaccacgtatgcggaaggctccgcgaaaggcgcgcgcgatctgctgaagaagttcaactccacggtgtccgatggcatgatcctttccatgagcgaggtggaaaacatttcgcccgatgatctgaaggttgattttccgctggtcatcgttggcgcgcgtaccacgtggggcattgtggatcacgtgaccccagacgatgtatccgcagccgccatggccgcaggctacctgtatgaccgcggttccaccagacttgcagtgatcggtgcccgtgacgtttacgacgaagatgcattgctgaatgccgtagaaggcaacgcgcagctgcgtctgcgcggcatcatcgaagagacccgtaggcgtgggctctccttggatccgcagctgattggcaacaccgatcaggattggaccatcggagccggtgcccgtgtgacccagcggctcattgattccggcgtgccattcgacggtgtgattgccttgaacgatcagttggccatcggcgcattgaccgctctgcgcaccgctggttatgaggtgcccgtgcaggtgcaggtcatcggcttcgataacaacgaggaagccccctacctgcagattccgctgaccaccatggattcccgccttgactggacggctcccacggcagtggatcgcatcctcggacgcatcgacggcagcatcaccaagtccgaactgctcaccaccgaatcccaggtcatcgcccgcgcctccacacgctgaacgacattgctgtaatgctggtgttgctgtactgggccgtacgaggcgttgatacaccggttgaccaacacggcataaagtgctaaggtgacgattgcgtggtacacagctgtaccgcgtggcgcataaggaaaggaagcgccaagcatcactgggcgttcgttctgagcgttcaccattcaaaggagaaaaagcatgcgccgaaataccgcgcttactcgcattatggcatccggcgtggccgccataatgctctgcgcaggaggcacgttcactgtaaacgccgccgaagaagaaccagttaaagccgacgtctcggtcaaggccatccaaggcttaagcgatgatttcatcggcggtatggacgtctcatccatgctctcgctggaagaaagcggcgtcacgttcaagaacgccaatggcgaggtcgaggatttgttcacgttgctcaaggaatccggcgtgaactatgtgcgtctgcgtgtgtggaacgatccgttcaccgcagacggccaaggatatggcggcggcaacgtcaacgccgatcgcgcactgaccatggccaagcgagccacggcagcagggctgaaagtgctggtcgacttccattactccgatttctgggccgaccccagcaagcagcaggtgcccaaggcgtggaaatcctttgaaggcgacgcggacaaaaccgccgacaccgtatacgactacaccaagcagactctgaccacgttcaaacaagccggcgtggacgtcggcatggtgcaggtcggcaacgaaaccactgcgaaaatcgccggcatctccggctgggacggcatgtccaaagtattctccgcaggttccaaagccatacgcgaagtgctccccgaagccaaggtcgtcattcatttcaccaacccggagaaagccggcacctacgccacttacgccaaacagttgagcaaccacaatgtggattacgatgtgttcgccagctcctactacccgttctggcatggcaccaccgaaaacctcaccagcgtgctcaagaacgtggcctccacttataagaaagatgtgatggtggcggaaacgtcgtgggcatacaccttggatgatggcgacgacgattccaacacagtgcccagtaaagtaaccgccgataacctcaagaaatacgacatcagcccgcaaggccaggccgatgagattcgcgcggtcgccgaggccgtgaacaatatcggcgacaatgatggcgatggcgaaaacgacggcctgggtgtgttctactgggagcccgcatgggtgcccgtgggcaccggcggcaaggataacgccgaactggtggatacgtggaacaagtacggtggcggctgggccactgaagcggccggcgaatacgatcccaatgacgccggcctgtactggggcggctcaggtgtcgataaccaagctttgttcgatttcgatggcaaggcgctcgcctctctgccgacgttcaagtacattcacaccggtgccgtcaccgatcatgtgttcaccaagatagatccagtggagattaccgcgactgactcggattccatcgacgcgatcaaagcgcaattgccgagtgaggtggccgcacactatcaggatggggtggacgagaccgaaaccgtgacctggcaatccgctgcgcttgactggattcgtggcgcaggcacatacaccatcaccggcaccaccaacgctggccacgacgtgaccgtcaccgtcaccgtcaccgccactcccgccaaggattacgtaacggacggcagcttcgagaacgctgagaacgataagaactggaccattgccggcaccggtgcgtccatcaccgaagacagtggcaacgccgccgacggcaagcgtgcgctgaagttttgggcatccgatgcctacagtttctccgccacgcagaccatcaccggactcgagcctggcgaatacgtgctgaccgccatgagccaaggcgcggcagcggacaacgccgctattaccgatggtgtggccctctccgccacaacgggtggcaagaccacgtccgatgcgctggaactcaacggttgggttaagttcgataccgccaccgtgcctgtcaccgtgggtgctgatggcacagcgaccatcaccatcacgggcaacctgcctgccgacgcatggggcaatgtggacaaggtctcactcgtcaaaaagaccgaaactccggtgaagccatccacggagaacctggacaaggccgtggccgaagccgggaaaatcaatcgcgatgagtacaccaacgagtcgctcgccaaactcgatcaggcgcttgccgccgctgacgtgctgcttgccggcagcacctacaccgagcaggacgtgaacgatgtgatcaagcttgttgccgatgccattgccggcctcgcccaaaaggaggtctccagcctgaccgtcacgccaagcaaaaccacctatcaggtgggcgatgccatcgatgccgaccatgatctcaaggtcgtgggcaactattccgcaggcatgggcaacgtgacgctttccgccgaccagttcacgctcgattacgatttctccgctcccgctgatgcggcgaaggttaccgtaacgctcaagtcgaatccgaatgtcaccgaaacctatacggttgcggttaccgctcgggccgaaggtggttccggcaacggctcggacggtgcgggtaatggcggggctactatcaatcccgatacgggcgagggcgataagaccaacggtgcgaatggcgacaagatcactggtgtgctgagcaataccggtagcgcggtgactgccgtgggtcttgcggttgtcgttctcggcgtggccggcggggtctcgcttgctttgcgtcgtaagcgctcctgatagagactgatgcggcattatgatgcggttgccggcagccggcaaccggctgccagatgccatctgtcggctgtcgtttatcggttgtcggctgtcagatgcgtctgtctcggcgcagcgatgcgattctgtcccggttcgtgcatcaatcgtttgatgtgggtaccaggacagaaatcactgtcctggtttgcgaaaacgggtgtttttcgcgtaccgggacaattcccgttgccccggtttgcacgtcaatcgttctacgtgagaaccgggacagtatgttgatttcgggattggctgtattccgccgattctgtttgtcggggtatgtggactttggggattgtcttgtcctggttctcgaaaatggcctgaaattgcgtaccgggacaacgatttctgccccggtgcaaacgtcaatcgattgacgcctgtaccggggcaaattcgcgcccgggaacaatagggcgagggccggtcgcaggagtagagcgtgatgttgtcatgattgcgcttggctctcccacacggaaggccgggcgcaatcatgccgtttggttgcagcacccgcacatcgcctgcataaccgtgtacagtggcgtgtagttgcagtacatgaaggagcatcacaagccatgaccaacggacacatcaatcccgccaacgtgccggacatcgccttgaaagacggccattccattccgcaggtcggccttggcatgctacgtatcgatgacgagggcgtggcccctgtcgtcgaatctgcgctggaagccggataccgccacatcgatggcgccgccggatacaacaacgaggccggcgtgggtcgtgcgctcgccgcttccggatacaacaccggcgccaagcgcgagaccctgtgggtcaccaccaagctgcgcgactccgagcagggctacgactccgcgctcaaggcattcgacaactccctgaaactcctccagctcgattacgtggacatgtacatgatccattggcccacgccgttcgactggcgcagcaccgacacctggaaggcgttcgtcaagctgcgcgacgaaggcatggcacgcacgctcggcgtatgcaacttcatgcccgccgatctgaagcgtctgcacgaggagaccggcgcatggccggccgtcaatcagattgagctgcaccccacgtggcagcagcgcgaagtggtggcgttctgcaaggagcacggcatcgccgtggaggcctactcgccgatggcgcgtggcgccgacctcaacgccggcgacggcaccatcgagaagatcgccgccgcccatgaggtcagcccggcccaggtgattctgcgctggcacatcgaaaacggcacgatcatcatccccaagtccgtgcatgctgaccgccagaaggagaatctcaacctgttcggcttcgccctgaccgccgatgaacacgctgccatcgacgccctcgacggccccacccgcgccggccacgaccccctcaccttcacctatgcgtgattgatggcacgtcgtaacacccacttccgccgtcgtttcaacgcctctggaccgctggagcgcgtgctgattctcatcgttctcgccgtagcaatcggcgtgaccatcggcctgctactgccgcaggtcagctccgacgcggccaaaatcaccggtggctacactgccaccggttcagccgccgacactttgaacgcgctcgccgtagacgacaaccaaagctcctccggctacgaccgcgattccttcggtttccgcaccaccgacgtcgacggcaatggctgcgacgtacgcgacgacgtgctcgcccgtgatctcacggacatcacctacaaatacgccggttcctgtgtggtcgagtccggcacactggccgatccgtacaccgctcagaccatccattttgtacgtggccgcgccaccagcgccaaagtgcagatcgaccatgtggtggcccttgaaaacgcttggcaatccggtgcgcgcgactggtccactgccaaacgccatgaattcggcaatgacccctacaacctgctggccgtcgacggcccggccaatcaggagaagggttcggcttccgccgcctactggctacccaccaacgccgactaccgttgcgactacgtggcccgccagattggcgtcaaagacaagtaccagctcaccgtcacctcccaagaaaaggacgccatgctcgccgtcctccacacctgcccgggccaggccgtgcccgcagacgaataggggctaccgttcaggattgttgagcataggtgcctgcccctcgtcataagcgcgcaggagccgtcggagcaaaaatgtggtgaagtatggtgcggtgaacacgtgttcgctgctaccgatattgccggcggatagtttcacgccgaactgaatttccggataagaatccgaagcgattagcgtccgcatggatttggcggtgccttttttcgatttcacctccaccggcaccagccattcgcgcgtgcggacgaagaaatcctgttccagtgtggaatcctcttttttgtagtagtacaggtcatagccggatttccgtagcgcttcagagacgatgctctcgtacatagcacccttatagacaccaagattacgattggcccgcagatcatcactggcctcgtcgtcaagcatcgctacgaacagaccggtatcgccgaaatatatcttgaacttgttttcgtcgtaattgcctttcaacggcagttcaggataggacatacatcggcagatattcaccattcccgaggtttcaagccattccacgcatcctcgatagtctttgaaacgcgctccgctggcaaccttgctgatttggaacttcttgttttccttggcgagttgcacgggaatatggttgaacacgttgagaattcgtgcctgatcgagtccttgcgcgtatttgcggatatcctcctggtagtccaaaataagctggcgctgcaattgcagtgttccctcgaacgtgccagtgcgtatatgggaggcgacaaccgcaggcatgccgccaagcacgcagtaatccataaatgccgtggagaagacgttcatttccacttcagagaatggcgtagcatcacacaggtgggtgaacatgctttcgatgacggcctcatcgtatccgcgagcccacagaaattcttcgaagtccaacgatcgcatttcgtagtcggtcttatatcccacgctattgctttcgatttgcttatagctgatgcccagcattgaaccgctgcaaatcacatcatatttgccgtcgattttaaagaacttcagtgcagtggcgatatcaggatgggcctggatttcgtcgaaaaagatgagcgtatcgcccggaatgaactttttggctgggtcgatcagggaaatattgcggacgatggtatccgcgccataaccgtccgcagtgattgcacgatatttcggttcctcaacgaagttgatttccactaccgaacggtagttgtgtgcggcaaagtaatcgatagtctctgtcttgcctacttgacgaggacccttgatgattagcggggagcgattcgggtcggatttccatgcattgagataggcatcggctttgcgtttgagatacatgaggagcccctttccgaattactgctatagcaatgattttacactttcatgagcgagttttctaccgtctggcacatttcatgagcgagttttcggcggtttgtcacatttcatgagcgagatggcggggaatgccagctgccagtccgccagtcatccatcaatcgtccgcagattgtccgtctgttgacgtgagaaacatgcccgcgctataactgagcccggtatgaagggagaagggaataggaacagacgatatggcagtaacacacaccgcagcagatgccactgcggcaaccactatgacgaacgccgtggcagacatcgaacaggaaacaccggaaatcgagaaggaacgccagcttgccggagtcggagccggagctggaaccgtggcaaacggcaagaaaaagccgcatgaccatgcgctggccagcatcctcggccccgcgttcgtggcggccgtggcttacgtcgatcctggcaacgtggcggccaacatcacctccggcgcgcgatacggctacctgttgatgtgggtgctggtgttcgccaacgccatgagcgtgctcatccagtatcagtccgcaaaactcggcatcgtgaccaacaaatccctgccggaactgctgggtgagcgtatgagcgatgctggccgcttcatgttcttcatgcaggctgaagtcatcgccatcgccaccgatctggccgaggtgatcggcggcgccatcgccctgaacctgctgttcggattgccgctgttcatcggcggtctggtgatcggcgcaatctccacggtgatgctgtggttccaaggtggcaagacgcaaaccacgttcgagcgcatcatcatcgtgatgctgctgattatcacattcggcttcatcgcaggcctgttcgtggacccgccgagccccggcgaagtggtcaagggcatgattccacgcttccaaggcaccgactcggtgctgatggccgcctcgattctgggcgccaccgtgatgcctcacgccatctacctgcactccacgctggtgaacgaccattacgcaggcggcgaaaagccgtcgatcaaaacgcagctgaaaggctcgaaaatcgatgtggtctgggcgctgttgctggccggcaccgtgaatctggcgatgctggtgctcgccgccaactcgctgcacggcatgtctggcacggattccatcgacggcgcacaacgggcgatcgcgcaggtgcttggcccggtgatcggcacgatcttctccatcggcctgctggcttcgtcgctgagctccacgtcggtcggcacgtatgccggctcggaaatcatgcacggtctgctgcacgttaacgctccgatgtgggcctgccgcgtggtcacgctggtgccggcactgattgtgctgtggttcgccaaggacccgactcaggcgctggtcatcggccaggtggtgctttccattggcatcccgttcgccgtgattccgctgatgcgatacacgcataacaaggaactcatgggcaagtgggctgatggaaccgtcaagcacgtgatttttatgattgtggtggcactgattgtggcgctcaacgtgctgctgattgtcctgacgctgatgggcagggcgtaatagactccagctgaaatcctgcgatagcacaacataataagaagccccggtgctggaaccggggtttctcattatgttgagaatggttgaatctgccgtcagttcgcagccatacgccgcgcacgccgttcgcgcagcgcgcgcaaggaaataatgtctcgcgtacgaccggcaccgtcgcccttgacgccgaagaacaccatcaacaccattgccaggcagatcattgcggagatgcgcagcgcccattgaatgccgaaaatcgaagcggcgacggcggaggcgccgccctgcttatgcaaagcggcaaacgtttccatcagaatcaccaacacgggtgcgcccacagcgcccgcaatctgacgcgcggtattcgtcaccgatgatccggcggacacttcgctcggcccgttcaggcaattcagggaccacgtggtaatcggcatcagcaggaaacccatgccgatctgacggatgaactggcagatcgatacccaccagatccacgtatccatcgccaccagcgacatgcccaaggtgccaagggtcaacacaatcgaaccgaacaaagccaccgggcgcgcgccgaaccgatccatcgcgcggccgccgaagaactgggagacgcactggccgatagcgcccggcagcatgatcagaccgctcatcgtggccgaatagccgcggtcagtctggatgtagagcggcatgatgaccaaaatcgaactgaaggcgaaaaatgccagcgacgcggtaatggtgccgacggtgaacgaagggttcttcagcacttccaagtccagcagcggcggctgggggagtgccgactcgtccttggctacggcctcgcgataccgcttgccagcgcgcaggttgcgcatcacaaaccacacgatgccgaccagccccacaaccatcggcccccacgtgaccggtgccgcgaatccataggtctctgaattggtgaagccgaacataagcccgccaaagccgatcaccgacaggcatgccgagaagaagtccgcgcgggccgaagggtcgtgtgaaccgaaattatgcagtccgaacatggccgccagcagcgagattacgccaatgatggtcatggtcaggaagatcgagcgccagccgttggcatcggtctgccagccgcccaaggtggggccgatggcaggcgccacgctcatggccatgcccaccgtgcccatggcaaacccgcggcgagacagcgggtagatggagaacacggtgatttgcagcaccggccacatcacgcctgtgccggcagcttcgagcacgcgcccgaccaacacccatacgaagtttggccccaaccatgccagcacggagccgattgtgaacaccgccatcgagcagatgacgatctggcgggtggagaagcgtcgggtcagaaacgcggtcagcggcaccatcacgcccatgaccagctggaacacggaggtgagccactgcccggtggttacggagatgtggaattcggaaacgataatcggcagcgcggaactcagctgcaactgcgtgaagttgcccacgaaggtaataaaggtcaatatcgcgatggagatgaacgccgcccggctgagtttgccgtctacatatgattcctcgcggctcagcacccgctgcagttcgccgcgacgatttttgattccccgagctccgttcattccactcacgtgcatactccactctcgctgatcgaccgcaacaacgcatcaggcagtttctcaaagcaaccccaacacgctacacccaggggtagtccgtcgagatgcaatgccgagatgactggccgcccggttgcagagcaaattagtcccgttattcgagacgtcaaaatgaacgtagttactatccgatcacgttcgctatgtggttttccaacacccccccccccctagcggttaggggtgtgatgtctgtaccatgttgaaggggtaaccccgtatacacccgtacacaggggaatccagagaagtgagagccgcgagacctgaggtatacggttgaaaaggaagaattggtgtttgagatgtcatctctgagcagtaacggtcagccgtctacacgcagcagacaggccaatagcggtgaccgaaccaccgctcagctcagtgatatccgccaaaagcagctcagccacgtgctgtactggcgattcttcgtcaatctcgccctcatgcttatcgacgccgccatgtacatcatcgccggagctacggtgctcaatctgcgccatgaggcaacgccgctctattcgagcagattcaatttcacgattgactccaccgtttaccttattattatggcctgcttctgggtgtggtcgctctatgttgccggcatttatcaccgccatgttatgggtgacggttaccagctcaacgtgctgctggtcaaaggcatggtcgtgtgctgggtggtgcagtgcgcgttcaactacttcttcaatctgggtctgaccctcacgtcgctctgcttggtggtgattgccggatggttgctcaccatggtggaacgcattgccagccgtgcattcattacgcgtagtcgtcgcaagggcgcctacgcttatggcacggtgatcatcggttccccgcacggcattggtcgcacgctacaattcctcggtcagcgtcggcaactcaactaccgcccggtggcagtatgcccgattcatctcaatcccgataccggattgattgaacagagcgccgaccatgagacactccgtgaggagatgcaaaagaacaagggctgccagctgcccgtactcgagtacagcgatcataatcttgctgaacagattattgacatgaacgcgcagaccgttatggtggctgacgagctgcgtcgctattcggataattacgatatcttctccgtgcgcatggaatcgttcggtctggagattgccatgctggcttccgccgctgacacttctaaccatgagattcaggttcgatccatccaaggcaccacggttatcacgcagcgtcttgcgcaatacacgccagcccgtcgtttgaccaaacgcttgtttgatttggtgatttcttcactggcgattatctgttcgctgattatcaccattccggtggcgatcgccatcaaagtcacggacggcggaccggtgttctacaagcagacccgtatgggcctgcgcggcaagccgttccagatgtacaagttccgctcgatggtagtgaacgccgacgcgctcaagaaggagctcgcaaaagaaaccggtcagaccgaccgcttcatcttcaagatgaagaacgatccacgcatcaccaaggtggggcacttcattcgccgcttctccattgacgagttgccccagttcctcaacgtatggatgggcgatatgtccgtagtggggccgcgcccgccgctgcctgaggaatatgcccgttacaaccgtctgtacgccacccgcatgctggtcaagcccggcatcaccggtccgtggcaagtgtccggccgctccgatctgtccgccgaggaaagcgaggcccttgatgtggcttacgtgcagaactggtcgattatgggagacatcgtgctgctgttccgcacggtgggtgcagtgctgagccataagggagcgtactgattccttcccgtttcgccgtcacagttttgccgcgcccttgccacaccgcccttgaacgtgattacagaaagataagtcgatatatctatgactgattcgaacataccagaaatacctcagccgccggcaccctccgagcggtcgaaaaacgcggatgatcgccaagtgatacagccgtatgttgaccccgaggtacttgctgaagacgtccgagcggcagaacggcgtaagcaccgccggcgtatgagccatgaacatatcaggcggatcaagcgcaaaaagcgcattcggatggtgctgattgtaatcggcgcactgctgttgattattgcagcgctcgcggcgtggctcggcctttccgcgctcaaagcgaaaaatgaagtggaagcagcgattcaggccgcaagccgcatccaatcacaagttcaagccggcgacaccgacaaagcgcaagccagcattgaagcattctcccagcatatcgacgctacgtatgcgcagaccaagcagccggtatggaaactggccacattggtgccctattacggttctgacgtgaaggccgcgcgagacatggtgcacattttggaagacgtgtcgaacaacgcattgccgaagcttgccaaggcggcacaggccttggatttcaacagcatcggtatcaaagacggcacgattcagctgggggatatggccagcgtgactcaggatcttgccgccgccaatggagtagtggcggatgccagcgtagacatgggcaagattggtgatacgcatattccgcagattaccgaggcggtgcagcaggggcgtagcaagttcaaggagcttgccagcctgacggatacggccagtcggctgacggatgtgctgcccaagatgttcgacttggatagcagtgatggaggtggtagcggcagaggcccgcgaacctacctggtgctggcacagaacaatgctgagctgcgtgccacgggaggcattccaactgcgtgggccacgctcaccgtcgatacaggcaaaatcagcatgagcacgttcggcgatccgcctcggaatggtctgttcagccaggatgaagccgcgagcgtactgacggcggaagaacgcaatctcttctccaccaagatggccacggactacccggacatcaatttcactcccgatttcccccgcgtcgctgatatcgcgagtcagatctggcatcgagccggtcatgacgatgtggatggcgtcatcagcgtggacccggtgttcctgcagcggttattgaaggttgccggccccgtgacgctctccgatggcacggtgatgagcggcgacaatgccgagcagcggattctgaaccagatttatattgataccgatacgcaggcggagcaaaccgacttcttcacgatggcggccagtgagatcttcacgcatgtgctcaagaatgtggacggcaagaatcagcagctggtgcaaacgttccaggagtccgtatccgacggccatctgtatgtatggagtgctcatgaggatgagcagcggcgtatcttgggtacgaccatcgccggcgaattgcagtcgaaaccggctcattcggttacgggtgtgtacttcaacgatgccactatgggcaagatggactggtacctgaagcgtgaagtgaccagtacatatgacaaaacctatcccagtggcgccaagcaatacaccgttcacatcaaactgacgaatacggccgatgccgccgaggtgaatgccgctccggatctgttgcgcggctatgaccataacggcaacccccgtacgggggagatcgaaacggtgctgtacgtctacgcccccgatgaagggcgcattgtggattggacccaggatttcgatcagttcgctgtgcacgatggactgacggtgggtgtgaaaaccgtgacattgcggccgggggaaagtttcgagaccacggtgcatgtgctggccagtcccgcggccgatgaaaatgaaatgattttgagacagacccccttggttgattaaaggggcaacccctatacattaaggtggaaccgtgaataaggaagaacggagcatagctgtggatgaagctgaacaggtgcaggacggtaatggagtcaccattctcgatttattcaatgcggtaagaaagcatgtgattaccgcagtggtcacgctggtcattgtgatggtggcaatctgcgcgtacacctttacccgcactccgcaatacaccgcaacttccgaactcttggccacttatcgcagttcagcggctgcgtcgggcgcatccagcaatgcaagcgagctgagctctggcgccaattacatcaatagccagattcaaacgtatccgcagttggtaaaaaccgagtctgtattgcagccggttattgatgatttgggtcttgacaccacggtaaaggaattggctgagggcgttaccgcttccaacccggatggcaccatgctggtggatatttcggttaatgatccagacccgaagcaggcgtccagcattgccaattcggttgccgaaaacctgagaaaacaggttacttccacgatttacagcgatgagggcgataagatcatctctcccgtcaacctaactgtggtgcagcaggcgtacgctccggcttcccccagttcacctaacgtcaagctcaatttggcggcaggtcttgcggtcggtgtcattctcggcatcgtggttgcctttatcaaggatttgctggacacccgtgttcgccgcgattctgatgttaccgctgttatcgatgctcccgtactggggtcgctgagccgcaatgaggcttatgccggtacgtcgccggtgattatctcccgcccggcctcccgcgaggcagaagagattcgacgcctgcgcaccaatgtgatgttcgtgctgcccgatgagccgttatccaatgtaattgtggtgacttccaccggcccgtccgaaggcaagaccacgctgagcgtgaacctggcgactgcattcgccgaaaacggcagcaaggtactgctgatcgacgccgatgtgcgcaacccctcggtgagcaaggccctaggcattgagggtgcagtgggcttgacccatctgattaccaaccgtgtatcgtcgcatgatgcgattcaacgctactggaagccgaacttccacgtgcttcctgctggaaaacaaaccatgaaccccagcattctgctgaattcccgcgctatgaaggcactggttgagcaggtttccggagcctatgactatgtgattatcgataccgcccccatgcaggtggccaatgatgccgccgtattcgccaaggaagggccagaactgctgctggtggccggcttgggagtgacggaaaagaaactgctccggcagaccgggcacgaactgagcacactgagcatcgatcccgtgggcttggccatgaattacggcgagacggagaagccccagaagggtggctattactactacggcgacgagtccgacgacaacggcaagaagcgccaaatccagcacaaaaagagcgagaaaacgaagaaggactgaggccatgaggatcgcgttcatcggccacaaacgcattccgtctcgcgaaggtggcattgagattgttgtggacgaactggctacacgtatggttgcacgcggggagcaggtcgtggtgtacaaccgcaaaggccacaacgtggccggcgaggagttcgacaaccagtcgagcaccagcgacaagccgtatatgtaccggggagtgaaggtcattcccgtcacgaccatcgacgccaagggactggccgccctcacgtcctctttcttcgccacgttgaaggcgatcaaggcccgtccggatgtgatccactaccatgcggagggcccgtgcgtgccgcttcgtctggcgcattggttcggcatccgcaccgtcgccacgattcacggcctcgactggcagcgcgcgaaatggggacgtttcgcctccacgtatctcaagctgggcgagcgcacggccgcgaaatgcgcggacgaggtgatcgtgctgagccgtggtgtgcagcagtatttcaaagacacatacgggcgggagacacgtttcattcccaacggcattgcgccggtagaatccgtttctcctgacgtgattgctgacaagtggagtctggagaaggattcctacattctgttcttgggacgcatcgtaccggaaaagggcgtgcattacctcatcgaagcgttcaagcgattagacactgacaagaagctcgtgatcgcgggcggcgcatcggattccgccgaatactacgagtcgattaagcaggccgctaccggagatcagcgcattattctgaccgggtttattgaaggacgtgaactcgaagaactgtatagcaacgcatacatatatgtattgcccagtgatttggaaggtatgccaatgagcctattggaggcattggcttacggctgctgctgcctgacctccaatatcgctgaatgtgctgatgtgctgtgtgatgagtccggaatgatgcatggagtcacgttccgacatggcgatgtgaacgatttggccgacaaactcggtgagttgctcgtagacgtgggtaaggtacgaaaaatcaagaccggcgcggccggctatatcactggccgctatagctgggacaaggttgttcaagcgaccctcaagctctaccgaggagcagataaatgaggattttactggtcaacaaatatttctaccgcaaaggcggtgctgaaacatatttcttcgcgcttgcggagggattgaaagcactcggccatgaggttgcgttcttctccatgcagcacccaaacaatgagccgagttattggagcaagtatttcgtatccgaaaaggactacgtcggcaagatttccgcgttcaaaaaagtgaaggaagcggcgacgttggtgtattccttcgaagcgaagcgcaagtttgaggcgctgctcgaagaattccagccagacattattcatataaataatgtgcatcgccagctcactttgtcgattctggatgcgccttatttgaagaagcaccgtgttccggtggtgtatacagcgcacgactatattctgctgtgcccggcttacacgatggtggacggttccggcaaggtttgcgacgattgccttgactgtcacttcttccatgcggtgaagaaaacttgtgtgaaaggatcgaaagcgaagagtggtctggcgttccttgaagcggaattcctgaagaaccatcattcctacgacaagatcgacaaaatcatcgcccccagtgaattcatgaagcacaagctggatgagggtggatatgccggcagaaccgtggccatgcagaacttcctgaccaccagccaaatggacatggcgcataaggtagccaacacgaataagttcaataccgttgagccgtatttcttgttctttggtcgactttccaaagaaaaaggcatccttacattggtgagggcgttcctgcgggctgcaggcttgatgaatagtggggttgcaggcagcaaactcctcccagccaattggaccttgcatatcgtcggcgatggtcctgagcgccaggctatcgaaaatctcatcaaatcagccggccctgaagctgaacgccgtatcaaactccttggctacaagaccggagaggatcttcagcgcgaggttggcaatgctcgcttcagcgtgctgtgctccgaatggcgggagaacatgccttattcaggtttggaatccctggcagcgcagactccaataatcggcgcgaatatcggaggaattcccgagcttgtggtggaagggaaaaccggattcaggtttgaatccgggcagttagatgatttggcaaaccatctattgcaagcgtcagcactcaatggtgatgaatatgcagtcatgcaacaggaatgcggcgactatatcaatcgcagagctcaacaaagcctttatatccgttctcttggggaactatacatgcgctgtttgcagattccaacccagcaaagggatgtcgaggaggagaaatgaagaacacaattgatttgcataatgccgctgtactggtcactggcgctgcgggattcatcggctcgaatcttgcaaagcaactgcttgattctattgaagggattcatgttatcggtttcgataatgtaaatgattattacgatgtgcgtcttaaggaatatcgccttaaccagctctctcattatgaagggttcactttcatcaaagctgatttggcagataaagacgcagtaaatgatgtattcgagcaataccgacctaccgttgtggtgaatcttgccgctcaagctggtgtgcgatattccatcacgcatcctgatgcttatattcagtcgaatctgattggtttttataacattcttgaggcttgtcgccatcatccggtggatcatcttgtgtatgcatctagctcctccgtatatgggtccaataagaaggttccatattccacggatgacaaggtagataatccagtgagcctatacgctgctacgaaaaagtctgatgagctgttggcacatgcctactcaaagctgtatgacattccttctacgggcctgcgtttctttaccgtgtatggacctgccggacgccctgatatggcgtatttcggtttcaccaataagcttcgcgcaggagaaacaatcaagattttcaactatggcaattgccgacgtgactttacctatgttgatgacattgttgagggcattctgcgcgtgatgcaaggtgcgccttcgaagcagacaggagaagatggtctgccggttccgccttatgcggtgtacaacattggtaacgggcatccggaaaacctgctcgaattcgtcactattctgcaggaggagcttctacgagccaaagtgcttcctgcagattacgacttcgaatctcataaagagctggtccccatgcaaccaggcgatgtgccggtcacgtatgcggatactgcggccttagaacgcgattttggctatagaccttcaactccgctgcgtgaaggcttgcgtcgatttgccgagtggtacaagaccttctacctcgatgactctgataaatagggcattcgattcgctattccagtcattcacgtagttcataacatattttacaagaagggatgaaaaaagagatgaaggattttgattcattgaagattgccgttgctggtaccggttacgttggcttgagcttggctacgcttttggcgcagcatcatcaggttaccgcggtggatattgttcctgcgaaggtcgacatgatcaacgcccgtaagtccccgatccaggacgattacatcgagaagtactttgcggagaaggagttggacctcactgccacgctggatggtgaaagcgcataccgcgacgccgatttcgtgatcatcgcgactcccaccaactacgacagcacgaagaactttttcgacacctctgcggtggaggccgtcatcaacctggtgatgaaggtgaatccgggcgcgatcatggttatcaagtccaccatcccggtcggttacaccaagtcgattcgtgagaagaccggttccaggaacatcatcttcagcccggagttcctgcgcgaatccaaggcactgtacgacaacctgtacccgagccgcatcgtggtcggcaccgacccggaggaccggcatctcgtcgaggcggccgagacgttcgccaagctgctgcagcagggggccatcgaggagaacatccacacgctgctcatgggcttcaccgaggccgaggccgtgaagctgttcgccaacacgtatctggcactgcgcgtctcctacttcaacgagctcgacacctacgccgagtcgaagggcctgaacacgcgcgagatcatcgacggcgtgtgcctcgacccgcgcatcggcacgcattacaacaacccgagcttcggttacggcggctactgcctgccgaaggacacgaagcagctgctcgccaactaccaggacgtgccggagaacctcatccaggcgatcgtggattcgaacaccacccgtaaagacttcatcgccgaccgcgtactcgagcttgctggtgcctatggccccaacagcgaatgggatgccagcaaggaacatgagaccgtggttggtgtgtatcgcttgaccatgaagtccaactccgacaacttccgccagagctccattcagggtgtgatgaagcgcatcaaggccaagggtgcgacggttatcatctatgaacccacgctcgaaaacggctctaccttctttggctccgaagtggtcaacgaccttgatgagttcaagaagcgctcgcactccattgtcgcgaaccgttatgactcttgcctcgatgacgtaaaggacaaggtctacacccgcgacctgttccgcagggactaaacagcacatataccaatataagcaaggacgtatcgatatgggtgagagtatatgtttcattatgccaactatggacggtggcggtgccgaacgagtggtctctattctctctggcgaattcgctcgtagtggatgtgatgtgacgttgttcttaactaacagcactcataccgcgtatgctttggacaagcgcgtccatgtcgatacatcctgcgcggaaagcaacccgaattcccttgatcagattaaagctattcgggcgaagatgagagcgatgccgaatacggtatttatttccttcatggatagtcaaaatttgttcactctaatagcgggaattggtatgcggaaccgcataattatctcccagcgtaatgatccacaccgtgcttttggaaagcgtcggctggttagggctattcatccgtggctatacgctcttgcggactgcgtggtattccaaacacaggatgcacttgagtattaccccaaatatgcggctggtaagtaccgtgtgattcttaatcctctcaataatagcatgctgccacgctatgaaggtgaacgatccaagcgagtggttaccgtttgtcgtttgaatgagcagaagaatttgccgctcgccattgatgcgtttgcagaattccgcacacggttctgcgactataccttcgagatttacggcgaaggcgcactggaaaatgatctaaagcgttatgcagtttcccgaggggttggcgatagcgttcatttctgcggcttccggaaggatgttcatgcctgcattttcgatgccgccatgtttgtcatttcctcggattttgagggactctcgaattcaatgattgaagctattgcgttgggaattccgacgattgctacggactgcccaatcggtggggcccgcatggtcattgacaatggcgtaaatggatatcttgttccggttcggaacaaggagcgcatggttacggctatgtgcagtattgcaggcgatactggtgtgcaggaacgctttagcaaagctggcgtgcggttgcgtgaacgtttgtcggttgactctatttcgaagcagtggctttcggccattaaagagaaataagacatcaagaatatcaaggagaaaatcatgaagattttggttaccggtgctaatggatatttagggcgcggtgtggttgatgagttgcttaagcgtggaaacgaggtaatcgccacagacttcgcctgtgaccatgtgaattctgcggctcattgcgtgcccggagacatcttctcgattgaagatccctatacgtacttcggcgagcccgatgtggtgttgcatctggcttggcgtgatggttttgtacacaattcgaatgcgcactttgaggatttgcctaagcatgttgcattcctgaaaaaactgtgcgaatccggaatccagcaagtggcgtgcatgggatcgatgcatgaaatcggattccatgaaggcagcatcaacgctcacaccccatgctggccgatgagcatgtatggaatcgccaaggatgcgctccgtaacgcattgcagaccatagcgttgcagaacaaagtaaagttccagtggcttcgtggatattacatcgtcagcgatacgcaatatggcagctccattttctcaaaaatcgttgcggcggagatcgaaggtaagaaagagttcccgttcaccacaggtcagaaccagtatgattttctagattatcccgatttctgtcatcaagttgccgcggcggtgaatcaggatgaagtgttggggattatcaatatctgttccggtaagcccgaaaaacttgctgatagggtggaacggtttattgccgagaatgggttctccatcaaattgaaatatggtgcattccctgatcggccctatgactccaaagccgcgtggggcgatgctttgaagattacccgaatcctcgatacggaacattgattttccattttttcgcaaaggattgaggataacaatgggtactttgctcgagcaggataagtatcgatacgccgttgagaaaatgcctagattccagcggttatttcgttgttgccaagagtgcaggttcaagcctatgcagttggtgtatcgactgctgtttcgctggtgccgtcagaggaatttcatcgagttaagccatcaaacggttatcggtggtggcctgtatatcggacatccttattgcatcaccatcaatcctcaagccgttattgggcggaatgtcaatatccatcgaggggttgttattggccaggagaatcgtggaaagagaaaaggtgctctaacgcttggtgatgacatttggattggaatcaatgcgtcaatagtgggaggagtgaaggtcgggaacgacgtaatgattgctcctggggcctttgtgaatcgcgacgtgccaagtcactcggtagttattggcaatccttgcattatcaagcataaggatcatgccaccgagggatatatcaatcataaaagtcagtgacgtggtattgcaaaaaagcagggaatgaaatgggagctcacaatagcattagacgctatcttcaccgcattggtgaggaaatacgatctacggcggaaatagcgaaattgacttcatggccggctgcagtggaaacgcttattgctaaggcggatatccaaattatgtgccgtaatgggtatgcggaaccgccgaatgcgcgtcgtcgtctgattcgtaagcatgaaacactgcttaagtatttcgagaaacgatatggagatttcgcttctggctatcgctataaggtaaatcttccagccgtaccggaggaactcaaaggttgcatctggttatgctggtggcaagggcttgaccatgctccgcgtatcgtccaacgctgtgtagaatcgattcgcgaatatgcgggagatcgacgtgtgattgtgattaccgaggacaattatcgtgattatgtgaccttccctgactggatgatgcgcaaatatcatgaaggcactattgctcgcacacatttgtcggacttgctgcgtttatcgttgctggctcagtatggcggattgtggttggacgcgacgttctattgcgctggcgatattgaagactgttttggccagccattgttctctatcaagcgccccgagtatttgcatgcaagtgtggcgcagggatattttgcaaattactcttttggatgtgatgccgaccatcgttggatatttgccgtgatacgtgatttcttgcttgaatattggcgtacaaatgattttatggtcgactacttgttcttggattatttaatcgtactagtgcaacgacattgcactgcggttaaggaggcgtttgcagcaatcacccccaataatccacaatgcgatgacctgttcaagtgtttaggtgatgtctttaatgagcgtcattgggagtcattaattgccgatacatcattgttcaaattgacatggaagcaagagtttcccaccgaaatcaatggtgtcgaaacttattatggaagattgctcaacggcaatttgcgtcgaaattagttttttccagaggtgttgatgattcgcataacgaagaccaaaacactccagtacgcgtggctgtaccttatgttactgattccgggcagctgcgcgatgtcacgctatctgaataccacattggtgtatggcgtgattattgctatatatgccctgcttgcgttgttgagcgcaaaatataggaatgtttatgtgctgtcgttttgccttttgcttgcattggcaacgattgttatccgattgaaaacaggaggtgtggggcccctaagttttctttccaacgcagcgatgctggttgtcacctatatcgcaatgactattgatcggagaatgtttcttacccgattcgtaagaattgtttgtttctttggcatcatcagtgtgctattttgggcggcgttttgcattaacccttcgctggtgaatgcatggcctgcaacatcattctggacgcagaacttggggacgggtcaatgggccactgtgcttcatggaaaaggactctggctttactcgtatcttgaaatacacgcaacccgtaattgtggtttctacactgaacctggcgtgtatcagattgtactcaatgctgttttattcgtcctgttattttggaaaaagaaattatattttgataacgagaagcaatatcgtacggcgaccgtcattgtcttgctcacactgattacttgccagtcgacgaccggttatctttctatgatggtcatcttgttgtgcttcttctttatgcgtggcagagagcgaggcatacgtacgctgaaacaaaagcttgcagtgctagtggtcgccattacggcggtgctgatcactgattatttgcttcgcggggaagagagtctcctttatgttcaagtgctgaacaagctatttggtggaggcattggcggtggtgtcaatttagaggatagcacgggacaatatcgttggattacagtgatggctagtttgaaggctctttccatggacccgttcggtatcggttttgacgcattctatgcgatacgagactcatttgacccagctgcagttgccgctagcattgcgacctatgccgcagtgtatggaatgattttctggctgacgatgatgattatgattttctatccaatgattcgacgggaaccaaagaaaatactcattgccgtatttgcttttatgtttatcaattccacggttagcgagacgtatttgttctatccgggtctcatgatgttcccgatttatctcagctcctatttcacacataagcagtccagtgtcgttggacatgcgattgctacatgtaatcctcgccattcgctaatggtttccaatctgatgaatgctaaagaggtgatgtaatggaacggactctgctgcttgttcccagcggtagcttctattatttcaatagtatgaaacttcctaatgtggtggttttccctgtgttccgcgaagttcatggcgcgtccgaaatggtttggaaagcaatgaggaagctgaggcttgctgccagctcgctgttctatactgattggtacaaggatttgcagtcgttttccaagatcattgtttttgattttacggtatggctggatccggcgttattgcgcaacattaatagacataaaaatcctgacgcgaaatgttatctatattcctggaatattgttcgcgacaagcaggttgtccttggtcatcttacggcgtgcaggaagtatggtttctcatattattcgtatgacgaaaatgactgcaagcaatatggattccgcttcaacaccatcatgtatgacgagaacttgcgtctcccggaacgtgctctgacgtcagatatcctgtttcttggttttctcaaggatcgcaaggcaaaaatgcttgctttgcatcaaatcatctccgatgctggcatgaaaccggaattcgtaattgttgaaaacggtaatcagcatgaagatttgccattcaccattaggcactcatatgttaattatgcggattatctcgatatggtttcgcaaagcaaggcgattttggatatcacgcagcaaggtcagaacggattctctatgcgcgtgatggaatccattttcctcaacaagaaactcgtttcgactaacatggctctattgtcagcgaatttttatgatcccaataatattctggtcattgatttgcagaaccctgatgaagaagagcttaccgtgttcctgcgttccgagtttcacccatattctcaagagacaagacactactattccgtcggctcatggatcaatcgtttccaacaatgatggtgcagacgaataatggcaaaacacattaaaaaacatttttggaataagcggccatccgagggtatgaaatcggcggtagcatacacattcgcatcgctgttttctaaaggtttggcctttgttactgtgccaatttttacccgaatcatgtcaacttctgagatgggcacagtcaatctgtacaattcttggcagtcgatactgacggttgtggcgacgctctcgttgacttacggcggatatatggtcgcgttgaaggaatatgagcatgagcgcgataggtacgaatcttcagtgctgacgctcacgacgttcacatcaatcgtattctttgccgtatattccgttgctcccaatttttggagtcgcatacttggcctagacaaatcgctgttgctgctgatgctagttggtttcctattgctgccggctacggagttctggctggcaagacagcgttacgagtataagtacaaggcagcaacactggtgacgattggctccgcaattgtggcatcagcactttccattgtcgctgtattgtatatgcgaggaagcggaaaagcggccgaaggacgattgttcgcgaattatgccgtgctatatgctgttgctcttgtgctatgggtatacatcatggtgcgagggcgcaagttcatttccatgcggtattggaaattctcacttgctctgagtgtgcctcttattgcgaatcagttcgccacgcagattctgaataattccggtcgcgtgatgattggttggttcgttgataattccgctgtgggcatttatggcacactttcctcggtgagtaccgtttccgcaatcgtatggtcggcaattaattcttcgtttatcccattcctctatcggaatattgatgattccgaaggcaagaaaagagttcggagcctcgcttcgattctgctgctcacctatgctgcggtatgcgtattgatgactttcctagctcctgaggtggtcaagataatcgcaactgatgaatatatggcagcgatttacatcatgccgccaatttctgcagccattttccagaacgctatttccaatatgtatgcaaacgtgttgttgtatcacaaaaaatcttcatacataatgattgcctctatttgtggcgcagtactgaatattgtactgaatgcagtactgattcctctatttggataccaggcagcggcctattcgatgttgattgcattcgtattcttgtcgtatgtgcaaatgcgtgtgtccaaaaaactgcacttcactatcacgggaaccaaggaaaccgtatatgatgacaaagtcattatcggtatacaatggctggtaattgtgctttccgccattgcgattcctctatatcacttcacgattattcgttatatagcagcatttgtcctgatggttgcctccttgttcctatacaaaaagagcaaaatatctgtctgatatagaaaggaaccgcattgtttgagaaattaatgaatcatttccgtaatgctgagaaaaatgctgctcattaccgaaagctgggtttaaagctgggggggggcttcgagattctcaatggctgggattttggaagtgaaccgtggttgattgagatcggcgataatgtcaggattacatctggtgttagatttgtgactcatgacggtggcgtgtgggtattgcgtcataagtatcctgagttatccgatatcgatctctttgggaaaattcgaatcggcaataacgtgcatattggttttaatgccattattatgccgggggtaacaatcggagataattgcattatcggatgcggcactattgttacgcatgatattcctgcaaattccatcgtagtgggtgtgccgggtagggtgatcgagtccgttggtgaatatgcggctaaacatgatgatgattttatgcatactaaaaagatggctactgatgagaaaaaagctttcgtacttggccatctaagatgatgtgaatttttttaatgagattgttcttggaactggccgaagcaatatagcattatgcttcggccaaggttctagatgcttactttcgaataaacattcctgaacgttccatctctgtaagggattgttcgtaacgactgttgtcggtttcttgtcccagcacccattcgcaaaactcggtcaaaccttcctgcagggaaatcgacggagtgaaatcaagcagctttcgtgccttttgggtatcagcgacattatgtgcgatgtctccgatacggaaatcaccggtaacgttcagattgctggtactgccatagattcgtttcaatgtctcagctatttcgatgacacttgttccgattccgctgcccaggttgatgatttctccgttcgatgcggccgtattgatagatttgatgaccgcggaagcaacatcctttacgtggatgaagtcgcggctttccttgccgtcttcaaagatattgatgtctttattgtccaaaagcaatgaggagaagatggaaagaatgccagtgtaaggattcttcaatgattggcctgctccgtacacattttggaaacggaagatggtgtaatcaatatccatcgcagggcacattgtctgaatcatcatctcttgtgaaagcttggtgaacgcataaagagaatttggggtggttttgctgtcttcggtggtgggcattaaggtcaaggcggtattgcacttgtcgcaatgcatagtgaaatcgccttgcatcatatctttagttttgcgtccacgggggtagactacgccacagtttgggcattgatactcgccttcgccatacacagaacgcgatgacgacaggatgactttgcgtatagtgttgctttcccccttgagcgatagtgcttgaaaaatatttgacaaacccatgacattgacctcgttgtactggttgatcatgtacatggattgcccggtaccggtttctgccgcaagatgcaaaacaacatctaccccttcaagggctttctggactgttgtgaaatcacgcacgtctccacggatgaaatcacaacaatcttttatggattggaaaagatatgacttttcaggattgttgccatgaatttgtttggtcaatgcatctagaacgcgaatttcgtattcatcatgagcgctcagttgttttacgatctcgctaccaataaaacctgcgccgcctgttaccagaatcttcgctgtcatatgtcttgaaccgttcttttgtagaaacttgccctagaaggagagtatgctttcagtgtagttcaaactatctcatttgatattaagcaatataacccctctaccaatctttgggaatctatcagaacaaacaacgaggtcgatagagctgcttcgaaaacgatgtgaattcgattggttttgtcgtaagcctttatgcccatcaagagaattcaacagactgttcccttacgtatattggattggcaacggtgtgttggactgtttctagagggtttttccttgttgtgtgaactccacggggctcaggtacccgagggtcgagtggagccgttggtggttgtaccaccacacgtaccggttgacgtccgagcgtggttgctccacgttcgtgtagacgttcctgtggatgagttccttcctgacgagccggttggtggattcgaccaccgcgctgtcgtacgggttgcccggcctggaaagggaacgcgtgacgccgaacacgtcgagcacgcgttcgacgcgttccccggcgaacccgccgccgcggtccgtgtggaacacctcgatctcatccagcgggaagcgcagcgcggcgaacgcggccaacacgagatcggcgtcgtgcccgacgccgaccgaatggccggcgatctgccggttggccaggtcgccgggcaggcagacgtacgcccacgaactgccgaccctcacgtaggccgggtcggaggccagatgggtgcgcggcgcatagccattgaactcgcgggcgaggatgtcgggagccgggtcgtcgtccggcctggccgggcgtggcctataggcggccttggaacaggagccggccatgccgttccccttcatgatccggttgacgcggcggcgggacagcgtcacgccctcgtgccccagggcgtgcctgatcttcctggccccgtacaccttgccgctgtccctccacacgcgctccacatccttctcgtaagggtcggcgcgctcggcctcggggtgttcgagcacccagtagcaggtcgacttggcaacgcccaggatcccgcactgcgccgataccgggcagcggccggcgtcggaccgtatcacgcctgctttcgtgcgaataccggcgccgcttgttctgaaacatcgacctccatctccagctgcctgtcgcgtttccgcaattcgatcagctcgttctcctcgggagtgcggttgtcggccgctttcgtggagccgctgttacgtatcccctgcacccaacgccgcagcgtggaacgcgggatgccgtactccgccctgatctgcgacgacggcttgccgttcccgttacgactgcacgatctgcctcttgaactcctcctcgtaatgacggggacgattcggatcggccatgatgatcaactccttcgttgtcatgtcccgcatgaaccagtccgatacattgtagccaatccagtcgtcgctcacatggaagacatccacacgctcacacggcccactttctattgaatagacacactccaaggaaggattcaccgacaacatgaaacgtctggccgaagaggacgatgccgtccgactcgtctcgttcgatgatgaagcctatgttcggtttaccgtaacccgaggagggtgtttccgcggggtgcccccctccttgtaggatatgggggtatggctgatgaagttttctctccgaagaacgttattgtgaccggtggctgtggttttatcggttcaaatttcgtgcattacgtgtatgaccatcatcctgatgtgcatgtgacggtcctggatgcgttgacgtatgcgggcaacctggagaacatcaggggcatcctgggcgaccgcgtggagttcgtgcacggcaacatctgcgacgcggaactgctcgacaagttggttcctggtcatgatgcgatcgtgcattacgcggcggagtcgcataacgacaactcgatcgcgaatccggagccgttcctgaagaccaacgtggagggcacgttccgcctgttggaggcggcccgcaagtacgatgtgcgctaccatcacgtgagcacggacgaggtgtacggcgacctggccctggacgatccggccaagttcacggaggagaccccgtatcatccctcgagcccgtacagctcgacgaaggcgagctcggacctgctggtgcgtgcctggcaccgcacgttcggcatccgcgccacgatctcgaactgctcgaacaactacggcccgtaccagcatgtggagaagttcattccccgtcagatcacgaacatcctcgaggggctgaagccgaagctgtacggcaacggggagaacgtgcgtgactggatccacacggacgaccattcgacgggcgtgtgggcgatcctgacgaagggccgtatcggcgagacgtacctgatcggcgcggacggcgaacgcaacaacatcaccgtgctgcgtgacatcctgaccgtgatgggcaagtcacccgatgatttcgattgggtgaaggaccgtccgggtcatgaccgccgttacgcgatcgattcgacgaagctcaggaccgaactgggttgggagccgacgcatacggacttccagaagggcctggagcgcacgatcgagtggtatacggagaaccgcgcgtggtgggagcccgcgaaggccgccaccgaggccaagtacaagcagcagggacagtgatcgggtatggcgtttgatttcgagaaggagctgaaggtcacggagacgaacatcccggggcttttggtgttcgatctgccggttcatggcgataaccgcggctggttcaaggagaactggcagcgtgcgaagatgatgggtctgggtctgccggatttcggcccggtgcagaacaacatcagcttcaacgcgacgaagggcgtgacgcgcggcatccacgcggagccatgggacaagtacatcagcatcgcgaccggtgagatattcggcgcgtgggtcgatttgcgtccgggcgagagcttcggccaggtgtacacgacccgtttggacccgtccaaggcaatctacgtgcctcgcggcgtgggcaacagcttccaggccttgcaggacgggaccgtgtacacgtatctggtgaacgcgcactggagtctggaacagaagaagacgtacacgttcgtgaacctcgcggacccggagctgggcatcgagtggccgattccgttggaggagtccgaacgctccgaggcggacctgcatcacccgatgctcaaggacgccaagccgatggagccgaagcgcacgctggtgacgggctgcaacggccagttgggccgtgcggtccgcgcgtacgcggaggcgcatggtctgcgtggtttcgaatacacggacatcaacgagttcgacttctccgatccggccgcgtacgacgagtacgattggagcctgtacggcacgatcatcaacgccgaggaactatccgcggacaagtgcgaaatcggggagaaccatgctcgggcatggaccatcaacgcccaagggcccgcgctgttgtctcgtgcggcgaaggatcatcacgtcacattggtgcatgcgagcaccgataaggtttacggagccgattcggaagccaaagcgatcgccccggagagcgtctacgggcagacgaaggctgcgggcgacatcgcggtggcgaatgcgccggaacactacatcctgcgacgctcggaatccgccgattcccggaacatcgtggacacgctgttccagctgctcgattctcacgccgaatacggcgtctatgccgtcggtgactgactggacagcccggaaacatcaggaccaaggaaggacaagcgtatgaagggcatcattctcgccggaggttccggcacccgcctttacccgctgaccaccgtcacgtcgaagcagttgctgccggtgtatgacaagccgatgatctactatccgctcagcgtgctcatgcttgcgggcatccgtgacatcctgatcatctccacgccgaaggacctgccgaacttcgaaaagctcctcggcgacggttcgcattacggcgtgcatttttcctataaggtgcagcccagcccggatggtttggcgcaggcattcctcttgggagaggagttcatcgacggcgagccgtgcgcgctcgtgctgggcgacaacatcttctacggtaacggtctgggcgccacattgcgcaaggccgtcgctaaggccgaaggcggcgagggcgcaagtgtgttcggctactatgtcgacgatccggaacgctatggtgtggtcgagttcgacgagcataaaaaggccgtctccatcgaggagaagccgaaggagccgaagtcgcattacgcggtgacgggtctgtacttctatgacgagcgtgtggtcgagttcgccaagcgggtcaggccgtcggctcgtggcgaactggagatcacggacctgaacaagatgtatttggaggacggctccctgaacgtgcgaacgctgggtcgtggttacgcatggctggatacgggtaccatggattccctgtacgaggcgggcgagttcgtgcgcaccgtgcagcgcgcccagggcctgcccatcgccatcgtggaggaaatcgcctacgaaaatgggtggatttccaaggaggagctcctcgaatcggccgaacgttacggcaagagcccctacggcaagcatctcaaggatgtggccgaaggcaaagtcgtgattgttcctaacgactgatcgactcggacgaatgcggaaacgccatagtattttgagattaatgctgagtgcgatagcagattacgcatttgccgatgtatatgacgacattgttcatcaatagtaaaagggggctgctgcattgcagtatgcagcagcccattaccatgtttggtaggccctgaccatcgaggcctaccaaacatggtaatgggcggacggaaagttggacgttttggcgtccggattggagtccgcatgttttcgatagaggatcggcgcagggccgttgacctgtatttcacggagggcatgaccatcaggaaggtcgtcgccaagctcggctacccgtccgagggcgcgctggcgaaatgggttcgcgaggacccgcgctgcacggttcctttggccttccataagttctaggtaaaaatatacacttatatacacatatatacatgaatatgtgagttcaagcgaactgatgctacgccggctcgtccccgtccccatcaaacttgtgctcatcctcgtaggcaacgatgtccatatcgcctcgatggagtttcttgagtgtttcagccactcgcgcctgctcatcatcaacaacagggcgctcgccggctaagcatgtgagaccatcggacactgcggaaaaacactgccgaacccgcccaacaaacattgaagcaatacttttttatttgcttcgttactgcgtattctgtacttcacatgtgcgaaacgttggaattccgccaaaattttatttgcctggtatttgcttgggtgggtcgcaaagcgcggttgcggcacgattcttagtggtggtgccttatggcgtcgggctttccttgcaaatcgaggtaaggaaactggcccttaacccggaatttgaaaaagtaaaaggtccctggctgttcaccagccagagacctttttggtaacaactgaggttgaggaaacctcggcagttgggtccaacggggcgaaagtctgtggcgccgccgagaagattgccccgaagctagcgcgacctttctgctacaacacagcataccagcatccatcgaaccttatcttttacgggttccggcccctcgtcttcaatcagggcaccatttcaaggcagaagaatcaggcggcctttttgcggccgcggcgcttcatggtgccagcggtggcattggccacatcgaaaatcacggtcttgctttcggggtaggcggtaccgttgacggactggtaggcgatttcgccttccggagcctcgggcagagtgaagtatgccttcactgcttcaatgagcgtggcttccttgacgcttaccgaagcagcctgcttgccttcggtcttgctgaacttaatggcgttgtcggccttggcggtggtcggggtcacggcgatctgcctggtcttgtcgttaatcagcaccttgacgtacgccgggaatccgagcacttcagcggtggctttgttgaaacgaatggcggaatcggtgacggtcagaacggtcttgcccaccggcttgaccagctgaacctcttcgaatccctgaagcaatgaagccataattgctctccttattgcattggtaacgtgtttttatttacgccactaattgtaaccagctaatttcgcattatacaaaccatatgcatgcatgattgcataattgaagaacatttgacctacgtattgcgctccccgaatagcattgatttaaccaataccaagaaaagaggaaacaagaacccgcaatatcagccgtattgaatatagaaatatgcaatttcaacatcgcaataactgacggtctttttgctggctctattcgccgatatcgcattcaggccacagcgccgagcataatatcgacgccgtgcttgatttccgcatacacgcgttcaaacacctcgcgtgattgacgatgagggtcttcggtttcgagtgccgtaggcaaaaacggccgcagcataggtacgcaatccatgatttcgatgagcctgtctgcggcggtatcgccggcaatcggaccctcggcatgcatatgtttgcaagcgttcacgaagtcattgaacagaaatactttgcgaatagccagtggattctgttcaagcaaatcggaaatttgctcacgctcaaaacacagaatcaggtcggcttgccggctgatatcggtggtgagaggggtggaagaatgggaattcgcgtcaatgccgtcgttcttcagcaaatcgataaccatcggatcagcgggatgcgggggatagtgcagagtacccgcgctgcgcacggtgatattgccgctctgcaagccaattcctcggtcggcaagcttggctcgggtgtagtattcggccatcacggaacggcattgattgccggtgcatacatacatgatttgcataacaacgtcccttctcaagtgttgtgagcattccctcatatattccagtgagcattcctcgcgaatatgcgtgcgttatgtaccgtagcaataacatgaaaaaaccgggaatcatcgactcccggttcagtggtattcgcgaactatgcttcagcgtctactgtttattatgtcagtcacgtcagcgacgagtggtgttcttgcggacggcgaacagggcgatgcccgcggcggcaagcagcacaacggccacaccgtacggtgcgatggccgcaccggtgttggcggtggtagcagtcgtggtaccggactggtcaccggttccggttgccggaacctgaatggtggcggtcttggtaccggatacagcgccaacagccttgaccgcgatggtcttgccagcttggctggccttgaacgtgtacagcaaagtcaaggaaccatctgccttggcagtgaacgtcttggatacttcagcgatcggctggacgtcggcgacgatggcatcatcgtagtacacggtgacggattcgttcggttggaatgtgcctgcagggaacgtcacggtagcggtggtgccgccgtaagtaaccgttgcaccgtaatcatcagccatagcggtattcgttgcaaaaccaaagcccagaactgcggcgataacggccagcacggccataatcttcttcttcataacttcgaacctccacaatagaaccggttactaccgataaaaaatcggttcttatcaatagaaaatcggtcttttttcaattacagcccccaaccatacacccccctttgccggtatataaggggtaattatgttaacgggtaagggggtgtgacaacgtggtcacaccatgtgacaacgttcgaacatattgtcgccgcattaccgttgcggcggggtctcctgacattctgaaaacgttgctattccaacgattgcgctgattggcgatacgtgcatggtaaacaacatgggaaatttttctgcgacacgccgacgggctactcggattctgattcgtactcgtcgtcaaaactgaacaggtcctctacggtggtgccgaacacccgcgccaaatccatggccaggcgcaatgatgggcagtattgcccctgttccagccttcctatggtctcacgtcgcacgttgaccagatcggcgaggtcggattgcttcataccgcgttggagccggtgaagtttcagactagtcttcatcgtcgcctccggtgccggtatcgtgttccagccatagatatcgaatatcggaaatggccagggcgcacatggccaatgcgggcagtagcattggcggaataatgtgaactatcgagcggtcaatcagattcagtgtggtgtagatgaaaccgacaattaccagaatgcccaccaaactgaccagcgcgaattgcatggccgcgctttgatgcatatcggaaagctcgtcgcgtcgcgggttctgccgtcggaatgcagtcatgccccatacttcgccgccgatccacaacagcgccgcgatcgctgccacgattactctgagcaggttattgccaataagagccatcagcatgcaggcaatggcacctatggattcaaggatggcacgaaagcaaatataccgattaaaagtcatggccgtctccgtgaattatgcgagcgatattgaattgcatacgcaattataaagttaggggggtaaccccttgtgtggtggttagaccaaccggcggaggctctttgcgtagaccgagaataatcgcaatcagtaattgttatgggcgatccagtagttgtacgctgcgacgatgccgccgtagcgctgctcgcagtagctgatgaaccacttgaactgggtcttgtagttggtctgccagtccgcgccgaaggaagccatcttgctaccggggtaggcctgacccaagccataagcaccagacgtggggttggtggcggtggggctccaaccggactcgtggttgatgatgtagttcgcagcggtgaagtccgcttcgctatacccgttgtccaacagatactgatgcgcccaggactgcacttctccagccggaacagtggtgccgagatcggccgacgatgatgacgacgtcgacggcgactcggtggaaccagtgcccaccaggatcaccttatccaccggggccttcttgacccatgaggcgaatacgttggaagagatgaccttgtcgccggctcgcttgaccagcgaggtggtctccataatgcccttctggccctcggtctcgaccttttcctgacccttgggcaggctgctggtctccttgcgtacttcattgaaggcgatctcggtatcgttggtctccacatcggcatccgcgcgattaatggtgaccacggtggcctcggtgaccttggatttcagcgagggagatacggcatcatccgggtcaagcgtgatatcacccgtctccagcacgtccttgacggtggtcatgttggctttttcgccaagtactacgcgcgaatcgccattaatcttcaccgtaacgaacgtggtgttcttgtcggcgctgttgattgcgccacgagtggcagaacgggatgcggccgaatcggtggcggagaacgaagtgatggtggaaatcggcttcacatcatcagcatggtagaaactgcgcgacaccaatcccgccgcgccgagcagacctgccgcggccaccacagccgcgatcttcatccactggcgcttgttcaacggtctgagcatacgggtcggcttggcatgtctcgtcattgcgctccttgatcggatttcacactgaccaccatgataggcggcgcagtggatgaaggaaaatcaggctcaggcctgctggtcggcaccggactgggcggccttggcggcggccagatcgagtgccttggcctgggcgatcagatcgtcgagatcggcggcctgcagcgcgccggcctgctggaagatgacctcgccctgcttggcgatcatcagcgtgggcaccgcctggatgccggcggcctgggccagatcctggttggcgtcgatatccaccttgacgaaggcgatgttcgcgttctccggctcgttggaggccgcctcgaaaatcgggccgaacgcgcggcacgggccgcaccatgtggcccagaagtcaacgaacacgatctcgttgtcggtgatggtcttctcgaaatcggcagaggtgatagcggtggttgccatgatgttcccttcttctgtgttttccttggcatcgccgtacggccctcatgcgtggccgccgggcgattgccttattcatgcaatacgtcttggcgcttggagccgtgcggttcgtggccgtcggctccctgctggctaccagcttcccagcaccacccaacatttgtgtcgtattttccgccgccggccaaacgtttcccaagatttcgccgtaaggtgacgcgtggcgtgattttgcgcgcaataatgggatgcatgccagtcatgaatgatgaagtgcccgacgagggcgattatgatgccggccgtggccgcggcgaattcgacaacatcacgcccgaggacttcatccacggaggcggttccggccacggcaacccgccgggctggctgggaccggccgacatcaaccgggcgcgccatcagatgcccatcgcatacgtggagatcgtgcccgtacgcaccgatgagatgggccgcatctcccaggtgggctcgctgctgcgcgtatccgatgacgggtcgatcgaacgcacgctgatcaccggccgtgtgctgtaccacgagacgttgcgcgaggccatcgcccgcaatgtggccaaggatttgggcgatatcgccttgccgctgctgccgatcgggctccagccgttcaccgtggccgaattcttccccacgccgggactaagcgaatactacgatccgcgccagcacgccatcgcactgtgctacgtggtgcctatcgccggcgactgtaagccgcaggatgagacgctggatgtggaatgggtggatcccaagagcgacgtaatggacacgttcgtggcgcagatggtcaacggccatgggcgcatcgtgcgacaggcgttggcctgggccggaatctgacagttgttttgccttccgttggaggggatggcgcgtagcgacggagggcggtccgcgttgagaccgctcccagccgactgtgccgacagctccgccagtggggcgcgaatgtgaaggagtaattcatggcaatcgaattggccaatcatatctaccgcgacggcgaaggcgtgccggtggtgctgatgaacgcctacccggtggaccaccgcatgtgggacgtgtgcgcgaaggcgctcgccgacttcgccgacctgaacgacgtgccggacttcccgatctgggctccggacatggccggctccggcgcatccccggtgccgagcgacgccgattcgggcccccgcatggcgaacggcgcgtacagcgaggcgttggatcgcctggccggagcctacgtggacctgatcaaggccgccggctatgagcaggcgatttgggtcgggctgtcgatgggcggctacgtggcgatggacatccagcgcctgtaccccgaaacggtggccggactggccttgtgcgacacgatggccgcgtccgacggcgtgggcggagagaaccgactgaagatggcggacgccgccgaacagacgaactcggtcgaaccggtgatgcacttcgcgcagccggccgatggcgattccaccgtcaagaagactcctgaattcatcgcgaccatgaccggctggatcaacgaacagaacccggctggtctggcctggcgtcagcgcatgacctacggacgtcctgaactgggggcggtgccggaaacgatcagcgcaccgagcctggtggtatccggcgaactggacccctccagcaatccgagtgtgatgcggccgctcgccgaacgaatcaccggcgctgaattcatcgatattccggactgcggccatttcagtgccgtcgaacatccggataccgtggcgcgagcactgctctcgctcgtcaagcgcgtgcagagcgcgcagaagaacgcataggagacctcgatgaccgctgacattcatttctcgcctctggcactgacccatgcgctgccgttcctgccgctcgcacaaggcgacatcgactatcaggtggaccggcgaagcgaacccggcctgatcgacgagctgctggccgagccgaccaccaaagtcgtgcttacgcgcggcggacttgtcgccgtaccgcgcggccaaggcgagcttgtggactatgagaacgtgaaaatgcggctcgccacgttgccgggcgcctatgtgtccgccgaactggcacgctaccccgaagcggtcgccatgttccttggctcctatgtcggggcgcgcggcgaatccgtggtcgccgtggatatcacgcgcgtgccggaagccggcgttcccggtgttggcgggattgccggtgttggcggtgccgtcggcggcgtgctcggcacccaggattccggcactgtggacggcgcgctgggcaagaacggcatcagcggaggtgctgccgccggaatacggcagccgggaaacgccaagggtaatggcggcgtagccgcagccaaaatcgccgggccgctcggtgtaccggattcggccgggcaaggtgcggacgatgccttcgatgattcggtcggcgcgcccgtacagcccttggccccgaagcccacgctgctgcaacaggccgtgacccggttcgactgggtggacctgcgcggatttgcccctcactccaacgcgcgcgaggccgggcaagccaccagtgccatcaccttaagcatctggcacagccgccagcggttctgtcccacctgtggcgcggcggtccggccggcgctcgccggatgggcgcagcgatgcaccaacgaggcggacggcaaccgtgtgctgttcccacgcgtggagccggcggtcattaccgccatcgtggacgggcacgaccgtctgctgctgcaacacaacgcggcatggaaggattcgaggctgtattcggtgtccgccggatttgtggaggcgggggagaaccttgaacacgcctgccgccgcgaggccatggaagagaccggcatcaagcttggcgaggtgcggtacctgggttcgcagccgtggccgttcccggcttcgctgatgatggcgttcaaggcacatgcgatcaccaccgacgtgcgtgtggacggcgaggagaccatgaccgcgcgatgggtcacacgcgacgaatacacggccgagctcatcgccggccgtatggcggcgccgggccgcgccaccatcgcccgctacatgattgaggaatggctcggtcgcgagctgtgacggaccgcgaagataggttaggcttatgactatgagtgatgacaacgaaaacgaacagccgctgaatctcgacattcccgaccacctcgaatactccgcggaacatgcatgggtggaccgttcggtcgaccccgcaatcatcggcattaccgaatacgccgccgaccagcttggcgaacttgtgttcgtggatctgcctgagcctggcgcccgtgtggaggccggcgacgagatcgtggagcttgaatcctccaaggccgtccagccgctgatcagccccgtggcgggtacggtcaagtatgtgaaccgtgacgtggcggacgacccgtccgtggtcaacggcgatccttacggcgaaggctggctgctgaaggtcgagcttgacgacgatgagccggagctgttgagcgccgacgaatacgcgaaggtcgtgcggtagttctacccatggctcccctcagagaggggagccaagaaaaatgaggcgtatggcctatattggtgtctatgagaagcccacgcgaggattttgaggcggcaggcaagcgactgccttgggatgctgctgctcgcaatgcagcgctgtccgccaccgcgccagtctctgacgtcaaggcatccgccaatggtgccgacaatgccagcaacgctgaacattccgatgacatgcccaccgtgccgattcccgcacgcaaggctgccacgacgttcgacaccccctccaagcgtgagcgcatcgaggtcaagccgccgattacccgattcatacgtcgtgccgtcacccgcgtgttcggcgtatggtcacgcatctccactcaggtggtgcgccaatgggactggtatccgcgagtggaaccctatgtgggttatggtaccggcgattactcgcgtctgatctgccgcacggtatacgcccccaggcacgcgcaatccggcgaactgatccgcggcatccgcggcatgcttgccatacccgcgccgcgcacccacgtgcaggccagcattgatgacatgccgctcaacaccgtgcagatcggcgtctccgaggtctatgacaaggtggaccgcacgcgcgatctcggcagcgaatacgccatctccgattccgccggatacctcgacctcgtggccgagcatcgtctggtgcccggcatccatcgcgtctcctacagcgtggccaaccgcaaacccgtgagcgccaacctgtacaccatccccgccagtgccaaagtcggcatcatctccgatgtggacgacaccatcatgatcacgcaggccccggtgccatggaaggccgcgtacaacctgctgttcctcgaccccaagaagaaagcctccgtgccgggcatgagcgtgctgttcacccgcatcgccgacctgttccccggcgcaccgttcttctatctttcgacatcgccctggaatgtggagagttcgattcgcaacttcatcactgaccatggttttcccgaaggcccgctgctgctgcgcgacctcgacccgaggcccaagaccttcgtacccaccggcccccagcacaaacttgagtttgccgaacaacttatggccgacttcccagacatgaagttcattctggtgggcgatgacgggcagaaagacccgaccacgtacgccaccatcgcccgcagatatcccggacgtgtactggcgatcgtcattcgtgagttgagcccgcgcgaatcaaccggattggcgtcggtgacgggactcacctcgacccagccgactccggtaaccgatgtgccagtattcaccggcaccaccggctcgaacattctgaagaccatgctgccgtatctgaagacggtgttgcgataggcgcggcgtgatgaacactgaatgcgtccccggtgcggtgcctcgcctataatcgcgtggtatgactgacgagagcacaaacgccgcggccgcgatgccgccttacgccaagcgcgagccgaagcgccgcgaattccacggtgacgttttcgaagacgattacgagtggatgcgagacaaagactccgatgatgtgcgcagctacgtagctgccgaaaaccagtactgcgagcgtcgcatggcgcatctggcggatttccggcatacgttgtttgaagagctgaaatcgcatgtggaagagactgatatgtcggttcccacgcgcgtcaatgattactggtacttcacccgcacgcagcagggcaaacagtatggcgtgcaatgccgcatccccgtgcgcgatgccgatgactgggacccgccggtcgtggatccgcaaggcgcgcccggctccatgcccggtgaacaggtcgtttttgatgcgaacaaggaatccgagggacatgacttcttccggctcggcggcttggatctgagcaaggacggccgttggatgctgtacggcgtggatgttgcgggagacgaacgatatgatttccgcattcgcgaccttgccgggctggagaccggggagccggtcagcgaactgcccgaacagttcaccggcattggcagcgcatgcttcacgccggacggccaatgggtgttctgggtggaattggacgattcctggcggccgctcgctgtgtggcggcatcgtgttggcacggcggtcgaatcggatgtgtgcgtgtaccgagaaaccgatgaacggttctgggtgggcgttggcatcagttttgatgagcgcaatatcgtgatcggcaccggttccaaaaccaccaccgaagtgctgatgctgccggtggccacgcctgaaggcgaattccaagctttcattccgcgtcagaacgatattgaatatgatgtgagctttgcctgttttgaaggcgcgggggagaacggtgcggatgtgccactcgccgtggtctatcacaacgccgccaatccgaatttcgaaatcgacgtcattgacatgcgtggccatgagccgccgtaccgactcggcgaaggcgtgtgcattgccgccgggtcgccgtacggctgtgaacatggtgagccggataagccgattaccgaggcatacttcaacgccgtcaatccggcgatattgcagggtgcccacggtctgggcatcgaaggcatcgcgttgcatcgcaactttgtgtccctgagctaccgtgccgacggccagccgcacgtggcatacatgaccaagagcgcggctgccgccgacttcctggccggacggccgtggcggtttacggaattgctgccgcctgccctggaggacgactgggacatggttgccgacgatcgcgaaaacttcaccggcgatcatggcgaaatcttgtggaccgaagatgaggcccccacggatcacacgtcatcttccgatggtgctagcgacgaccacctgcccggtgagacccggcgcttgtacaccatcggcgtcggcggcaacccctcgtatgaggcgccgcgcatgcgctactcgttcgccagctacacccgcccgggcgagttgcacgaaatcgatcccgccaccggtgaagatgcgctgctgaagcgagccaccgtgttgggcaacttcaatccacgcgattacatggaacgccgtgtgtggattaccgcgcgcgacggcgaacgcattcctgtttccctcgtctggcatcgcgattgcccggcgcaggattcgccgatgttcattaccggatatggtgcatacgagatttcctccgatccggggttctcggtctctcgtctgagcatgttggatcgcggtgtgctgtacgccgtgccgcatattcgtggcggcggcgaaatgggacgcgcctggtatgagcaggggcgcagactgaacaagaagcattcctttgaggacttcgtggacgccacacgcgcgctgcagaaggcgcatttggctgatgcttggcgcaccgtggccaacggcggatccgctggcggtctgctgatgggcgcgattgccaatatggcgcccgaatgctacgccggtgttgaggcggatgtgccgttcgtggacgcgttgacctccattcttgacccggacttgccgttgaccgtcaccgaatgggacgaatggggagacccgttgcatgaccctgaggtgtatcagtatatgaagtcgtacacgccatacgagaatgtgccggtcgccgtgctcgagggcggcaacgacgaggctgccggtgacggcagtgctgatggggctgccaccggcgcggtcgccgccgcgcaattcccgagaatcttcattaccacctcgatgaacgacacccgcgtgctgtacgtcgagccgctcaaatggctggcccgtttgcagtccgccggcgtggacgcggtggccaagattgaggtcgaggccggtcacggcggtctatccgggcgttacaagcaatgggaagaggtttcctatgagaacgcttggtgcatggatgtgatggggctcgctcattaggccatgtccactagctgagcgggttcgggccggcaggtgatagcgcgagtaggctccttgaactatggcaaagacatataaaatcgccgttattcccggcgacggtattggcaaggaagtcactccgtgggctcagaaggctttggaaaaggccgctgaaggcgtagctgacttcgagtacgagaacttcgacttgggtgccgagcgctatctgcgcgatggtgcgatcctacccgaggacgaagaggagcgcatcaaggccaacgacgcgattctgctcggtgccgtgggcgatccgcgcatcaaggccggcattctggaacgcggcctgctgctcaagctccgcttcgacctcgaccagtacgtgaacctgcgcccctccaagctgtacaagggcgtcacctcgccgctcgccaaccccggcgacatcgacttcgtggtggtacgtgaaggcaccgaaggtctgtactgcggtgccggcggcgcggtgcgccgcaacaccccgcaggaggtggccaccgaggtgtccatcaacaccgcatacggtgtggagcgtgtggtgcgttacgccttcaagctcgctatgaagcgcaagaagcacgtcaccctggtgcacaagaagaacgtgctcgtcaacgccggtgatatgtggcagcgcatcgtcgacaaggtcggcgaggaataccctgaggtcacccacgactaccagcacattgatgcggccaccatcttcctggtctccgacccgagccgtttcgatgtgattctcaccgacaacctctttggcgacattctgaccgatgaggccggctccgtggtgggcggcgtgggctactccgcctccggctgcatcaacgcctccgacgagttcccgtccatgttcgagccgattcacggttccgctccggacatcgccggtcagaacaaggccaacccgaccgccgccatcctctccgccgccatgctgctcgaacatctcggctttgatgatgcggccaagaagatccataccgccgtcgaagcggacatcgaggagctcggctccaccgtgcgctccaccgaccaggtcggcaaggacattctggcccgcatgtgacctcaaacttggctcccctcgctgaggggagccagaaaactctctatactgagttgcatgcaaatgcgacatggggaatgcaaaaccgttggcagcaaactagtcgccgtgaccgtatccgtcgatgatgacggcaccgcacagtcatgccatatcagcggtgatttctttattgaatcagtttcggatgccgaatctcatgctttgttgcatgacctggaacgagctctaattagcgatgattcattgcggtccgtattggacgcccatcctagttgccaaattatcggcacagatgaaattgccatcaaaaccgcatacagccgagccgtaagcagcaacttacccccgctggcgggggctccagcgcagcgggtgggggtgggcagccccgatgcgccgaacatcccagcatccatcaatacacaaaccaagcagcccgacaaaagctctgaataccgggagcgctggaacgccctcaagcctcaactcaccgtgatccacggccatccgcgtactccggacgagcaaatggccattgacgagacctgggcgcgtgaagtcgcagcaggaacacgacagccgaccatccgattatgggagtgggcgggcccggctgtggtcatcggccgtttccaatcggcccaggacgaggtgaatctggacattgccaagcagctcggcttcgacgtggtacgccgttgcacgggcggcggagcgatgtttatcgaaccgggcaacaccattacctattctctgtatgcgccgctcgatttcgttcagggcgtaagcatcgaagaatcctaccggctttgtgactggtggctggtcgaggcgctgcgcgaacttggtttagatgtgcggttcgcgggcctcaatgatatcgcctcgcagtacggcaagatcgggggagcggcgcagcggcgcttccccgtaggctcaggcggcgcggtgctgcaccatgtgaccatggcatatgacatcgatgcggccaagatgagccgtgtgctcaacaccagtcgcgagaagatgtcagacaaagcggtgaaatcagcggtcaaacgcgtggacccgatgaaaagccagacgggtctcagccgcgaacacatcgtcgagcaccttattgactggtttgcggcgtgatttcaccgatggccgtatacgattttgccgctggccgtgcgcggttttgtcatgggcgagcgcggtagccgcgacagtgccgtttttcgcggtaacgcattcgtcagcatgtcgtacggctatcggatcgtgccacacatgaagtgacgaatgagggcatgctcctgacgaaacctgtggggcgcgttacaatatgacggatgggcgacgacggtcataggacaataaggatggtgcgatgagcttggaaacgccaaacgtttttgctgacgaggagaacatcctgttgcatacggcattgttcaagcaggtatcgccagccgaagccgaggagctgttgccgcatttgaagcatgcgacgttcgataaaggcgactatatcttctccgaaggcgataccgatcagcgcatgtatttactggagcaggggcgcgtcaagctgattcgcacttcttccgatgaccgcgtgcagctgctgtccatccacgcgccgggcgaagtgcttggcgagattccggtattcgaccctcatggtggcccgcgcaccgcgtccgcggtgtccatgagccatggcacgcgcgtggtctggctggagcatgatgccctgttcgcatggcttgatgagcatccgcgtgtggccatcgacatgttgcaggtcatggccagccgccagcgcggcaacaacgaacgcatctccgacttggtattcatggatgtgccggcgcgtctggccaagacattgctcaacttgggctcacgtttcggcgagccggtggaacagggcctcaaagtgccgcatgacctgactcaggaagagctggcccaactggtgggctccagtcgtgagaccgtgaacaaggcgttgatggacttttccaaccgcggatggatcgcacgtgacggccgatcgatcatcatcttccagcccggtatgctgattcgacgctcgcggcgctgaccgttcggctgacttccagccaatgttacgctagtgcgattcttgtgatgatatgttcacgggagctgaccgtaagcccggttggtagggcaccccatttagaatggggcccatgcccaaaaagaagtccctcactctccaacgtgtgcttgttctcctcttggcctatatcatgcttgccgtctgcggcggcgtggcggccagcgtgttgtttgtaccgggtgtgatcggtgccaataaagccgccaaagcggtgattccgtcgctcaaggtagaaaacgtggacttcgacgtgactagtctgccccagaagtcgacgatgtacgcgcgagacggttccaccgttatcgcgacgttctacaaccaaaaccgtatcgtcgtgccgctgaagaagatttccaaaaccatgcagcaggcagtggtggcgcgcgaagaccgtcgattctggactcacgccggcgtcgacgtgcaaggcgtgatgcgtgcgttcgtgcagacctacctcgtcaaaggctcccagcagggtggttcgtcgctgacccagcagtacgtcaagaacgtgctgctgatgcaggcgatcgaggatgacgattcgatcgcccagtaccatgccactgaagacaccatcgcccgtaagattcgcgagatgctgatttccgtgcagatggaaaagaagtattccaaggccgagattctgcagggctatttgaacatcgcccagttcggcaacaacctgtatggcgtggaaaccgcggcccagcgctacttcagcgtgtccgccgccgatttgaacgtggtgcagtccgccaccatcgcggctatcaccaagaacccaagcctgtatgatccgctggtcgaagagaaccagaaggaaagcgaaaaccaacgcaatatcgtgctcaagctgatgctgcaggaaggatacatcacccagaagcagtacaccgaagctgtgaacacgccgttgaaggacacgctgaaagcacaggacgtgaatgtcggctgtcaggacaccggcgattacgcgtacttctgcgattttgtggtgcatcgcatccagaactccgaagaattcggcaagactcgtgccgagcgtaacaagctgctgcaggagggtggcctgaaaatcgtcaccacgctggatgtggaagcgaattccacgatgatggagaccgcgcgtaataccattccaccggacgatcccagcggcatggagatagccatggccgcagtcaaaccgggaaccggcgaagtgctgagctttggcctgaatcgttactatgacgccactccggcagccgcgaacgatcccaccaagacgagccagaactatgccgtcgatttggcggatggcggtggttctggttggaccatcggttcgtcctggaagccgatcaacctgattgcgtggatggaagcgggccattccatcaacgacaacctccagacctcgacgtcataccccactacggacttcgcctgcagtaactattcgggcggtgccgattcgtggaacgtgtcgaacgccatgggcgcaggtacagtgaacccagaaagcccattcctcggtctggtccgttcgcataacactactcaggcttccatgggtgccatcctcaaactgtgcaaggtggcggacaccgcgactgaactgggataccatgacgccgccacgggtgagaccatcgacaaaacccaggtgtatacaccatccatgatgatcggctcggtgaatgtgtccccgctgaccatggcgagcatcttcgccgtatacgcctcgaatggtgtgcaatgcaacccgattgccatcagcaaggtgaccgataaggacggcaacgatctcaaggttccatccgcgaactgccatcaggcggtggataaggacatcatccaaacactcgcttataccctgaaccaaggtacggtgcggccggatggtgccggttggtcattcagattggctgacgggcgtaagtcgtttggtaagaccggtaccagtgaggatcttgcggtgtccggtgggtcgttcattcctaatcagattgcggcgttcgctgtggtcggcgatgcacagaacccgtacaccaaccgtatttccaacattgccatcaacggccggtacaacagctattgggatggttcgacaatcgcggctccggccgttaccaacttcttcaatagctacatttccaagaagaaaataccgattgacaacgattacggccagcccgtctcgaagtacaccacgactggcaagtatctgggcattggcggacgaacgttcagcgtgccgcagaccactacgaatggcaacagccaatcgcagagcagcaacaatcagtctcagtcgcagaacactgggcaaaacaacacccaaacccagggcaccaattcagagcagtcgaatgatggccagtgattggtgattggcgtttgacatttggtgattgcatgccggctgagtctgcgtaacatggccgactgcgatacccaaattacgtagtttgcgggcgttacctgtttcaggtgacgcccgttttacaatacttaatgacaacgccatcgcgttcatcgaatatttgccatgaacgtgcatcggaaaggggaacgatgagcaacgacgatctgacgcatgagaattttgattttcgtggattcgacgtgccggatctcaaagcggtgacgctggcttcgtcttcggacggcgatcagtccaagcagccgaagaccaagcacgaggatgcatcgaagaaccgtaagcacggtaagaagaagtcaaaatccgatgcacggtccaagaagcgggccggcgcgggcaagacgagcgaatcgttcgatgattatgaggattatgaggaaagggaagctgtgagcaaggcagataagaaagtcagcaaggaccgtccggggctgtttgcgccaatgacgctgcgcgaggtgaccgtgcgtaatcgtatttggttgccgccgatgtgcacgtattcgtcgttcgcccgcgatggtaggcccacgccgttccactaccagcattacgtgtctcgcgcgttcggcggattcggcatggtgattgtcgaatccaccgccgtggctcctgaggggcgtatcacgccgtgcgatctgggcctgtgggaagacgggcagattgatgcttggcgctggatcgtggacggtattcgcgaggcgggtgcggtgcctgccatccagctcaaccatgcggggcgtaaggcttcgactggttgctttgccgttggttacgacggtcagagcgtgccggaggaggcgggcggctggcctaccatggcaccgtctgaaatcgcgttcggtgggttgcgtacgccgcgcgcgctgtccgtggatgagattcatggtctggtcggcgcgttcgccgcggcggcgggccgtgcggtggccgccggcttccaggcgattcagattcatgccgcgcatggctatctgatttctcagttccttgacccgctgagcaatgagcgtgatgacgaatatggtggcgatttgaccggtcgctctcggttcctggtcgaggttgtggatgccgtgcgtggggccgtccctgagggcgtgccggttctggtgcgcatttcggccacggattgggccgccggcggttgggatttggaccagaccatcgcactatccaaggtgctgaaggagcatggcgtcgatgtgatggacgtgtctaccggcggcatcatgtcgggagtgtcgattccggtcaagccgaactatcaggtgccgttctccgagcaggtcaaggccaaggccgatattccggtgaccgcggtgggtcttatcaccaagccgaagcaggcggccaagattctggcccatggcgaagccgatgccgtggagattggccgcgccgcattgcgcgatccgtactggccgttgcgtgcagccaacaagctgggcataccgtccaccgagatcccctacgccccgcaatacgtggccggtgcgtactaaatcctcatggggcggtaactttccatggggcggtaaaaccctcatggggcggtaacccaaaacggcggtattctgcggaatgtgaaatttggctaaccgccccatgggacaatcaccgccccatgagggttttaccgccccatgggtaatagggcaatatgtgagttcactccacgtctacgccgacggcgtcggagacgtgctcgaatccgtcgcggcgcagcagctgggccagaccgcgcttcaacacggtaatctgctgcgggcctcggtacatcagcgaactgatgaacatgaccaagctggagccggaacgaatcttcgcataggcttgctcgggggtaaagacgccaccgatgccggcgatagcgaaccggtcgccatactctttatacaccttgcgaatcagctcggtgctggcgttggtgcacgggccgccggacaggccgccctcccaatcgcgcggaatctcgaggccggtgcggtccttctgcagattggcgatggacagcccctgcacattgtgctcggccagcacatcgagcagttccttgtactcgccccacggcttgttcaacggcatcttgaccagcgtgggctgcgggcggtcgatcttgtcgagcgccgtaaacagacggtcgagcgcttccggagtcgcggtgaacggttcgccgacgtgcgtgttcgggcaggagacgttgacctccaccatcgcggtgcggccggcggcgcggcgcattgaaatgcagtaatcctcaatgccttcgtccaaatcgccgcactggtcgtcgttggtgcgggcgatcgacacggacagctgcatctggcgggcctgagtccaagccttctcggcgcgctcgatgaccttgtccgaaccgatgttggcgaggccgacgtgcaccatcatcgaatcgtattcaggcagacggtggaaccacggcttggcgttgcccgggcagggacgcgaggtggtggagcctacggtttcgaagccgaagccggcatggtccagcaccacgggcatctcgcagttcttgtcgaggccggcggacaggccgaacgggttggtgaaatcgacgcccatcacattcgtttccagaatggggtcggtgtagtcgagcatcagctgttcggcgagcagcagcggcgggacgttcttgacgacgtggcagaactcgatcatctgatcgtgtgcctcatcggggcggtggttgaacacgaagttcggtttgatgatgtgcttgtagccgaaggtgaacagatcggtggtggctttgttgacggcgtcgtgccagaagctttcagaaacgtaagtcataccgcctattgtctcacgcttgggccggtgcggctaggtgattccgacctaggcgaattggggaagggggctactgcgtgtcgaggcgcacgcaggcgtcggctcggcagaagatacatgaaccgggacgcaccaggtatcaggcgtgactctccgctgagcaacgcgcgcgggagagtcgtcggtcgtgagctatcgcgctagtggccgctgtgagaatatcggttcgcgcaatgtgcgattttgcgcggttttgtggaaatgacacctgaattgctcggaattttcgagaaattgtccccaaaacgctcaagccggtttggtttgtgagcttttgcgtgcgataatgttcgcatgatttcgtcacaacgtcagcacctcatcttgagcaggttgcgcacacgcggggcagtgcgcattacggcgctatcgaaggaactgggtgtgtcggcgatgaccatccgccgcgatatcgccgaacttgccgacaagggactgttgaagcgcgtccatggcggcgcggtgactaccagtaccttgctcagcgaacccctgttctctgtcaagtctcagatggatatcggcctgaaggacgccatcgcccaggaagccatcaaatatgtggctcccggcgatgtaatcgccatcggcggcggcaccacggcctatgtcttcgcccagcatctgctcgaatcgcagcagtccagcggcatcaccatcctcaccaattcgattcccgtggccgagctggtccaggccctcgaatccaaggatgtggaggtgatcgtcaccggcggcgtgatcacccgatcgaactcgcttgtcggcccgatcgcggacaaggtcgtcgcttcgctgcgtgtcaacaccgtattcctcggcacccactcggtgtcgattccccgtggcttcctgatgccgaattcgctggaagccgcaaccgatatggcgatgatggacatcgccgatcgcaccatagttttgaccgatcacaccaagtggagctgcacgtcgctgtcgctgtttgcgcgcttcgaccaagtggacacggtcattactgacgacgggctcgaccccgactccgccgccaaaaccaaggatttagtaaaggagctcgtgctggcccaccagagcgagaccattgaggaaagtgagcaaacccatggctgatttcgccaactacacccccggggagtatgcgaaggagcatatccgcatcacgccggcgacgcttgccgacggtcgtgacttcttctacctggacgacgaccccgagttcgtctccggtgccaagacccgcgagctcaaggacccgcgcccgctggactaccgtttcgccccgcatctggacgccgacggtaacgaagtgccgtacgccgccccgcagatgcgccgcgacccgctgaccggcgactggatcccgatggccaccgcccgtatgaaccgcccgatcaccgccggccccggcgccaccgccaagggcaacccgctggccgcccgcaagcccggtgacccgtaccaggacggcgaagtgccggacaccgactacaacgtcgtggtgttcgagaaccgcttcccctcgatggtgcgcgtgcccggtgtctccgaggacgtgacctacgttgacggcaacccgctgtgggagaagaagctcgccgccggccgctgcgaagtcatctgcttcgacccgaacgaggacggcctgccggccgatttgccggtctcccgcctgcgcaccgtggttgaggcttgggccttccgtaccgccgaaatctccaagatggaaggcatcgagcagatcttcccgttcgagaaccacggccaggaaatcggcgtctccctcgcccacccgcacggccaggtctactgctacccgttcatcgccccgaagatggagaaggaactccagcacaccgaggcctaccacgagaagaccggtggcaacctgcttaaggacatcatgaacgccgagctcgaagccggcgaacgcatcgtgatgcgcaaccacagctgggtcgcctacgtgccggccgccgcccgttggccccttgaagtccacgtggccccggtgcgcgacgtgctcaccctcgaccagctcaacgacgaagagcgctgggaccttgcctccatgtactcgcacctcctgaagcgcggcaacgccttcttcgacaagggcgacggcaagggcatggacctgccgtacatcgctgcctggcaccaggccccgatccacgacaagcgccgcgagaactaccgcctgaacctgcagttcttctccttccgccgtgccgccaacaagatcaagtacctcgccggctccgaatccggcatggccgcctggatctccgacaccacgccggaactcatcgccaagcgcttccacgagctcggctccatcgacatcgccgactgatagaaagaaaacatcaatgactgctgttgaattcattgagccgctgacccatgaggaaggcgtttcgcaagctaccaagctgttcgtcgacacctacggcgctgcgcccgagggcgtgtgggctgctccgggccgcgtgaacctgatcggtgagcacaccgactacaacgccggcctgtgcctgccgatcgctctgccgcaccgcaccttcatcgccctgaagccgcgcgaagacaccaaggttcgcgtcgtctccgacgtggctcccgacaaggttgccgaagctgatctcgatggcctcaaggcccgtggcgtggacggctggtccgcctacccgaccggcgtggcctgggcgctgcgtgaagccggcttcgacaaggtcaagggctttgacgccgctttcgtctcctgcgtgccgctgggctctggcctgagctcctccgccgccatgacctgctccaccgctctggctctggacgacgtgtacggccttggttacggcgattccgacgccggccgcgtgaccctcatcaacgctgccatcaagtccgagaacgagatggccggcgcttccaccggtggtcttgaccagagcgcctccatgcgttgcaccgaaggccacgcgctgctgctcgactgccgcccggagctcaccccgctggagaacgtctcccagcaggagttcgatctcgacaagtacaacctcgaattgcttgtggtcgatacccaggctccgcaccagctcaacgatggtcagtacgctcagcgccgcgccacctgcgagcaggccgcgaagatcctcggcgtggccaacctgcgcgtcaccgccgacggcatcgccaaggccgacgacccgttccaggcgctcaaggagacgctggacgcgctgccggacgagacgatgaagaagcgcgtgcgccatgtggtcaccgagatcgagcgcgtgcgctccttcgtgcgcgccttcgccagcggcgacatcgaggccgcgggccgcctgttcaacgcctcccatgattcgctggccgcggactacgaggtcactgtgcccgagctcgacgtggccgtggacgtggcccgcaagaacggtgcctacggtgcgcgtatgaccggcggcggcttcggcggctccatcatcgctctggtcgacaagggtcgttcccaggaagtcgctcagaagatcgccgacgaattcgaaaagcaaggcttccacgcaccgcgcgcgcttgccgcgtacgcggcgaaatccgcttcacgcgaggcatgataataaatcacaatgctaaatggcgggtgtcttccctatacttgggtagtcacccgctttttgtatacgaccagggagagccatgaacaaggcaatcatcaccgtcgtcggtcaggacaccgtcggcatcatcgcgcgagtctgcacctacctgtcccagcacaacgtcaacgtgctcgacatctcgcagaccatcatcgacggttacttcaacatgatgatgattgtcgactacgccaacgcggacaaggacttcggcgcgatggtcggcaaccttgaggacctcggcgacgacatcggcgtgcgcatccgctgccagcgtgaggaaatcttcaccaagatgcaccgtatttgaggcggcccgctcagcaggccgcctcacgcgaggaggtggaaagcccggtgggctttccactgacggagccatccttatccctctgatgagggtgaccgccaaactagtctttaaatatcctgtaaggaacaaaccatgctgaacatcatggaggtccacgagaccaatcagatgatcgagcaggagaagctcgacgtccgcaccatcaccatgggcatctcgttgctcgactgcgcctcggacgatgtcgacaagacctgcgacaacatctaccgcaagatcaccacctatgccaaggacctcgtttccaccggcaaggccatcgaacgcgactacggcatcccgatcgtcaacaagcgcatcaccgtcaccccgatctcactggtcggtgccagctcctgcaagacgagcgaggatttcgtcaagatcgcccacgcgcttgacaaggcggccaaggaagtcggcgtcgacctgatcggcggctactccgcactcgtttccaagtccatgaccccggccgaggagctgctcatccgctccctgccgcaggctctctccgagaccgacatcgtctgctcgtccgtgaacgtcggctccaccaagaccggcatcgacatgaacgcggtcgaactgctcggccatatcatcaaggacgttgccgagcgtaccgccgacaacgactcctacggctgcgtcaagttcgtggccttctgcaacgtgcctgacgacaacccgtttatggccggaggcttccacggcgtcaccgagggcgacgcggtcatcaacgtcggtgtctccggccccggcgtggtctcccgcgcactcgatgcggccaagggcaaggacttcgagttcctgtgcgagaccatcaagcgcaccgcgttcaagatcacgcgcgtcggccagcttgtggcccaggaagcatcccgccgcctcggcattccgttcggcatcatcgacctgtcgctcgccccgaccccggctgtgggcgactccgtgggcgaagtgctagagaagatcggcctcgaacaggtcggcgctcccggcaccacggcggcgctcgccatgctcaacgaccaggtcaagaagggcggcatcatggcgtcctcctacgtgggcggcctgtccggcgcgttcatcccggtctccgaagacaagaacatgatcgacgcggcttcttccgattgcctgaccatcgagaagctcgaagccatgacctgcgtgtgctcggtgggcctcgacatgatcgccattccgggcgatacctctgcttccaccatctccggcctgatcgccgacgaggccgccatcggcatggtcaaccagaagactaccgccgtgcgcgtgatcccggttgccggcaagggcgtgggcgagatggcgaacttcggcggcctgatgggctacgcgcccatcatgccggtcaaccagaccagctgcgaggcctttgtgacccgtggcggtcgtattcccgctccgattcacagcttcaagaactgattcagtagggtatctgccttcaaagaggtacatttgcgcagataggtatctgctttcagaggggtacctcaatcaagaaaccccgagtacaagcgttgatatttcaacgcctatactcggggtttcgtcctttaacagcccctcgaagcggcaatagacctccggcagatgccaaatcagcccctcgaagcgccgatagacccattttctgcgatgatggtcgtgctgcgaggctcagggtttcctctctcacgcctgtcggcgttcgttcggcgtcgctactcgaaggcccaccgggccttctcctcagcgccctccagcgaagttgagttggcgccaggcttcgtagatggcgatggacgcgcaattggtgaggttcagggaacgcaaggacgggcgcatgggcagtcgcacttgttcggccacatgagggccctccatgatgtccatcgggtcggggatgtcgccgggctcggggccgaacagcaggatgtcggtcggcttgtattccacctcggtgtacagcttggtagcatgtgcggtgaacgcgatgatgcgcgaattgggcatggactccaccaggttgtcgaaattcgggtgcagcaccacgtgggccatgtcgtggtagtcgaggcctgctcggcgcagcttggtgtcgcgcaggttgaaacccaacggctccaccaaatgcaggatggtgccggtcaccgcgcacaggcggatggccgagccggtgttgccgggaatgcgcggtgagtagtagcacagatgcggtgttacggtttcggtggtggcggccttttcagccgagagcatcgcgtccaccacggagatggggttgccatgcgcgtcggttacgagttcgtccggtccgtaattcgatttacggtacccgtactcgaacatcttctcgacttttgtttcgggattctgtgcgttctgcgaattctgttctgcttcgttcgtcatagctgttaagaataagaacgatgaacgacacagcaatttctttgcgattgggcgcatggtgggaggccaatgcgcgcgatttgccatggcgcttcggccgggccacgccgtggggcgtgctggtatccgaagtcatgagccagcagacgcagatgagccgtgtagtgccgtactggaccgactggatggaacgttggcccgacgcccgcgccctcgccgaggcccccaaggccgaggtgatcaccgcatgggggcggctcggctatccacgccgcgcattgcggttacaggaatgcgcccgcgtggtggctgaagattacgccgacaaactgccgcgcacgtatgacgaactcactgcattgcccggcatcggcgattacaccgcctccgcggtgatgagctttgcgttcggcgaacgaattgccgtgatcgataccaacattcgccgcgtgctgagccgcgtgttcctgggcgtcgaatcgcgcgggggagcgaccagcccggccgaacgcgcgctggcgaaccgcatgctgcccaaagacgagattctcgggtgcgatgctgacgtcgccgataatgccggtagcgccgaacatgtcgtgaacagcactatccgtggcggcaaacgctctcgactgcatcgtggcgagcgcccatcggtcacgtggaaccagtcggtgatggaactgggcgcggtgatctgcacggccaagtcgccgctgtgcgacacctgcccgattgcggacgactgtgcatttctcaaggccggccgccccggactgggggagcgccgcacccgcccacgccaacgattccaaggcacggatcgacaggtgcgcggtctggtgctcgccgcgctgcgcgagcttcccgctggagccacgttgcccagggaagatgccgacaagctttggaaggaccagattcagcttgccgcctgcatcgccagccttgacgatgacggcctgatagagattctggacggcggcctgcgactacccagctgacattgtgaaaaatggtgggctccccaagcgtgtatgggcgtggtgaccgtagactggaagagttatggcagtgcagaggaacacatcaggcgcgagaacggcacgcggagccggcaccggggccaatgggccatccggcgggccctcccaaaacaaccgttccggcaagccgcgcaagcgcaggatcagcaaaaagcagcaggccatctatcgtcgtcggcgtatcgtggccggtacggtgctgctgctgataatcgcgctgattgtattctgcgtgtatagccttggccggggtatcggtgccgtgaactcgatgatccaccatgacgaggtgtatgcgatttcccgcgacgccacgccggcgccgaagaaagtcagcaacgtcaaggattgctcggccagtgatgtgacattgcagctttccgcggcctcccaatccgtgccggtaggaggatcgcttgatttcaccgcgaccatcgtgcacgaggggtcaggcaactgtttagtggacgggtccgattccggccgtgtgctcaccattacttccggtcaggaaacgatttacaagtccgatgtgtgcccggcggattcacgtctgctgctgatggctaagggcgataaggacgttcagaaggtcacgtggaataccaatgcgaacgccacgctcgccaaatgcacggatgagtcaggttgggccaaagtcaatgcgggaaggtacgtggcgcagctgagtttgaaggatcatccgaaggtgaagagcgatccggtgacgtttacggtgcagtaaaagtcttgccttagcgctattcttttgactttgcatgaggtgtgtcatattgcgggcatgccgtcgacaatgaagcgtccgcataggcatatggtggccatgccggcgctcccaggggaattaccacatattagcgagcgataaggaacgtccattggctactgagtctacgacgaacaccaccaccatcatcgcacgcgccgaccagcatgatattgacctgcacaaggcgtcggatcgcgtgaacttcggttccatcaaggaacccatcgatgtgccctacctgctgggcgtgcagaccgacagcttcgattggctgatcggcaacgaacgctggaaggcgcgcgtcgaggaggacgaaaagaacggcactaacaccgtggcccacacctccggcctcgatgaggtcttcaacgagatctctccgatcgagaacttcgctcagaccatgagcctgaccttctccgatccgtacttcgaagagccgcgtcacaccgtgcaggaatgcaaggagaaggattacacctactccgcaccgctgtacgtgaatgccgagttcgagaacggcgacaccggcgagatcaagtcccagaccgtgttcatgggcgatttcccgctgcagaccccgcacggtaccttcatcatcggcggcaccgagcgagtcatcgtctcccagctcgtgcgttctccgggcgtctacttcgaccgccagcaggatcgcacctccgataaggaagtcttcggcgcgaagatcatcccgagccgtggtgcatggctcgagttcgagatcgataagaaagaccagccgcaggtgcgcgtggaccgcaagcgcaagcagtccgccatcgtgttcctcatggccatcggcatgaccaagtccgagatcgcccaggcattcaaggactacccgctggtgctcgacgcactggagaaggaaaccctcgagacccaggacgaggccctcgttgacctctaccgcaagattcgtccggccgacaccccgacccccgaggccggcaagaatctgctggactccttctacttcaacaccaagcgctacgatctggcccgtgttggccgctacaagatcaaccgcaagctgggtgtcgaggccgatttcaacgatcgttccctccaccaggaagacatcatcgccacgatcaagtacctggtggccctgcacgacggtgcggcgaccttcccgggcaagcgcaacggcgaagacgttgacctgcgcgtggacgtcgacgatatcgaccacttcggcaaccgtcgtatccgccaggtcggcgagctgatccagaaccagctgcgtaccggtctgagccgtatggagcgcgtggtgcgcgagcgtatgaccactcaggacgccgaggccatcaccccacagtccctgatcaacatccgcccggtgaacgccaccatcaaggagttcttcggcacttcccagctctcccagttcatggatcagaacaacccgctgtccggtgtgacgaacaagcgtcgtctttccgcactgggccccggcggtctgtcccgcgaccgcgcctccatggaggtgcgcgacgtgcacccgtcccacttcggccgtatgtgcccgatcgagtctcctgaaggcccgaacatcggtctgatcggctccctggcaaccttcggccgcgtcaacccgttcggcttcatcgagaccccgtaccgcaaggtcgtcaacggccacgtgaccgacgaggtcgagtacatgaccgctgaccgcgatcttgaccacgtcattgcccaggccaaccaggagctcgacgagaacggcaacttcgtgcagaagtccgcccttgcccgagtcggcgaagaagaggcggtcgatgtgccggtgagctccgtggactacatggacgtctccccgcgccagatggtctccctcggcgcctccctgattccgttcctggagcatgatgagggccaccgtgcactgatgggtaccaacatgcagcgtcaggccgtgccgctgatcgaatccgagcgcccgttggtgggcaccggctccgaatggcgcgccgccaacgactccggcgacgtcatcaagtccgagaaggacggtgtggtcacctacgtgtccgccgacctgatccgcgtgatgaacgacgacggcaccaccagttcctacaagctggccaagttccaacgttccaaccagaccacctgctacaaccagcgcccgatcgtccacgacggcgagcgtgtggaagccggctcggttatggctgacggccccgccatccagaacggcgacctggccctgggcaagaacctgctcatcgccttcatgccttggaacggctacaactacgaggatgctgtgatcatctcccagcgcctcgtgcaggacgacaccctctcctccatccacatcgaggagtacgagatcgacgcccgcgaaaccaagctgggcgccgaagagatcacccgcgacctgccgaacgtcggcgaggacgccgtggccaacctcgacgagcgcggcatcatccgcattggcgccgaggtcgaggccggcgacatcctggtcggtaaggtcaccccgaagggcgagaccgagctgaccccggaggagcgcctgctgcgcgccatcttcggcgagaagtcccgcgaggtgcgtgacacctccctgcgcgtgccccacggcgagaccggtaccgtcatcggtgtcaaggagatcacccgtgaggatgccgaggaggacggcgacgagctgcccaacggcgtcaaccagatgatccgcgtctacatcgcccagcaccgtaagatcacggtgggcgacaagctctccggccgccacggcaacaagggctgcatctcccgcatcctgccggaagaggacatgccgttcctggctgacggtactccggtcgacatcatgctgaacccgctgggtgtgccttcccgaatgaaccttggccaggtgctcgaactgcacctcggctggattgctcactccggttgggacatctctttggatccgaatctggaagccgagtggaagaagctgattccgtccggtgccgagaaggccgagccgaacaccccggtcgccaccccggtgttcgacggtgtcaagcctgaggtcctgaagggcctgctgtccaccacgctgccgaaccgcgacggcgaccgtctggtcggccccgacggcaaggccaccctgttcgatggccgtaccggtgagccgtacaccaagccgatttccgttggctacatgtacatgctgaagctgcaccacctggtcgacgacaagattcatgctcgttccaccggcccgtactccatgatcacccagcagccgctcggtggtaaggcccagttcggtggccagcgcttcggcgagatggaggtgtgggcccttgaggcctacggcgccgcctacacgctgcacgagatgatgaccaccaagtccgatgacgtcgacggccgcgtgcgtgtctacggtgccatcgtcaagggcgataacctgccgccggcaggcatccccgagtcgttcaaggtgctcctgaaggaaatgcagtccctgtccctgaacgtcgaagtgctcaacgccgaaggcgtggccatcgacatgaaggatgaggatgacgatccggccagctccgctgacgacctcggcttcaacatcggcgcccgccccgacgcggccgccaaggaagaccagaaggccgaagagcccgaataccagtgatccctcgggctgcatgcggtcaatacgccgcgtgtagctccgccaacgtgaaataaataacgtacagagacctttccggtttgcactacccctcagtcagccttggctgacagctcccctgacaaggggagcttgggaaggtctcaagaacagaaacggattaacaagtgctggacgtcaacgcatttgacaagattcgcatcggccttgccaccgccgatgacatccgtggttggagccacggtgaggtcaagaagcctgaaaccatcaactaccgtacgctgaagcctgagaaggacggtctgttcggcgaacagatcttcggcccgacccgtgactgggagtgcgcctgcggcaagtacaagcgcgtgcgcttcaagggcatcgtctgcgagcgatgcggcgtcgaagtgacccgcagccgcgtgcgccgtgagcgcatgggccacatcgagctcgccgccccggtgacgcacatctggttcttcaagggtgtgccttcccgcctcggctacctgctgaacgtcaccccgaaggacctggagcgcgtgatttacttcgcctcctacatggtcaccgaggtgaacgaagacgagcgtcacaacgatctgcccggcctgcaggacgagttcgattccgagatcaagcgccttgagcagcgccgtgactccgacattgaagcccgcgccaagaaggtcgaagaggatctcgccgcccttgaggaggccggcgaggccaagggcccggcccgcaccaagttgcgtaacggtgccgagcgtgatatggctgccatccgcacccgctacaacgaccagatcgcccgtgtggacgccgtcttcgacaagttcaagaagctcaagcccggcgacatggtcgacgacgtggacctgtggcgcgagatgcaggaccgctacggcgattacttcgacggctgcatgggcgccgaagccatcaagaagcgcctgcagtccctcgacctggagaccatctccaaggaactgcgcgaggagatcaaggacgcttccgaacagcgtaagaccaaggccctgaagcgcctcaaggtcgtcaacgccttcctgaccaccggcaacaagccggaggccatggtgctcgacgtgatcccggtcatcccgccggacctgcgcccgatggtccagctcgacggtggccgcttcgccacctccgacctcaacgacctgtaccgccgtgtgatcaaccgtaacaaccgtctgaagcgactgatcgagctcggcgcccctgaaatcatgctcaacaacgagaagcgcatgctccaggaagccgtcgactccctgttcgacaacggccgtcgtggtcgcccggtcaccggtgcctccaaccgtccgctgaagtccctgtccgacatgctcaagggtaagcagggtcgtttccgtcagaacctgctcggtaagcgagtcgactactccggccgttccgtgatcgtggtcggcccgtccctgcgcatgcaccagtgcggtctgccgaagccgatggccctcgagctgttcaagccgttcgtcatcaagcgcctcgtggacctgaactatgcgcagaacatgaagtccgccaagcgtcttgtggaccgcggcgacgccgaagtgtggggcgtgctcgaggaggtcatctccgagcaccccgtgctgctcaaccgtgcacctacgctgcaccgtctgggtattcaggcattcgagccgatcctggtggaaggcaaggccatccacctgccgccgctggcctgcgccgccttcaacgccgacttcgatggtgaccagatggcagtccacctgccgctctccgccgaagcccaggccgaggcccgctcgctgatgatggcttccgacaacatcctgaagccggccgacggccacaccgtgaccatgccgagccaggatatgatcctcggtttgtactacctgtccaccgtgctggaaggcgtcaagggccagggccgcgtgttctcctcgctggaagaggccgaaatggccctcgaccgccacgagatcgacatgcaggccaaggtgctcatccgcctgcccgagagcttcgtgctgccgaagaactgggagcccggcgaagtcaaggtgctcgacccgcgcgaaggcgaggacgaggtcgtcaaggaagaacgcttccacgacggcaccgtgctgttcgccacctcctacggccgcatcctgttcaacgagaccctgccgaccgactacccgttcgtcaacgagcaggtggccaagggccgtctgtccaagatcgtcgatgacatcgccatgcgttactccacccagcaggtggccgccacgctggatgccctgaaggatctcggcttcacccgcgcaccgtggtccggcgtgtccttcgcgttctccgacgtgaacgagccgcccgagcgcgacgagaagatcgccgagtacgaggccaaggccgacaaggtcaacgccaactacgagatgggtctgttgaccgaggaagctcgccgtcaggaactcatcgacctgtggaccgagtgcaccgccgaagtgtccaaggaagtcgaggagaagttcgacccgacctccaacctggccatcatcgtgcagtctggtgcacgaggcaacatgatgcagatcaaccagattgcaggtatgcgaggcctcgtggctaacccgaagggtgagatcattcctcgtcctgtgaagtccaactaccgcgacggcctgtccgtgctggagtacttcatctcccagcacggtgcacgtaagggtctggccgataccgcactgcgtaccgcagaatccggttacctgacccgtcgtctggtcgacgtctcccaggacgtcatcgtgcgcgaagaggactgcggcaccaaggccggtctgcccatccgcgtcgccgagcgcgacaacgacggcaacctggtgctcgtcaaggccgccgacggtggcccgtactcccgtctgctcgccgccgacgtcatcgacccggccgacggacaaaccgtgctgtacaagcgcgacgacgccctgtccatggacgtgctcaacgacctcgtggcccacggcgtcgaggaagtcaagtgccgttccgtgctgacctgcgagtccaagcgcggcgtgtgcgccaagtgctacggctggtccctggccaccaacaagctggtcgatgtcggcgagaccgtcggtatcgtcgccgcccagtccatcggtgagcctggtacccagctgacgctgcgttccttccactccggtggtgtggccgcggcctccgatatcacccagggtcttccccgtgtcaccgagcttttcgaggcccgcaccccgaagggtgaggccccgatcaccgagttcgccggcagcatcaagatcgtggagaacgatcgcggtcgccagatcatcctgaccccggacgccgattccggcgcaccgaaggaagacggcgtgatcaagccgatcacctaccaggtctccaagcgcgtgccgctcaaggttgccgacggcgaccacatcaaggtcggcacccagctggtcgaaggttctgtggaccccaagaagatcctcaccatcctcggcaagcgcgccgcccaggtcaacatcgtggaggaagtgcacaccgtgtaccgctcccagggtgtggatatccacgacaagcacatcgaggtcatcgtgcaccagatgacccgtcgcgtgaccatcatcgactccggcgacaccgacctgctgccgggtgagctggtggacaacgcccgcttccgcgagatcaaccgcaacatcgtcaagaacggtggccgtccggccgtcggtcgtccggcgcttatgggtatcaccaaggcgtcgctggccaccgactcctggctgtccgccgcatccttccaggagaccacccgcgtgctcaccgaagccgccctctccgagaaggtcgacgacctcaagggcctcaaggagaacgtcatcatcggtaagctcatcccggccggtacgggcctcgcgcgctaccgcaacgccgtggtcgagcctgacaaggccatccgcgacaccatctacccgaacttcggtctgggcggcgatggcgatctcggcgacgcgagcttctccgacgccgacctgtctgacctgaacttctcgaacctcgagttcggcgatctgaagctcggcgacgacttcaacccggatgatttctactccgatcagggcggtcagcctgacatcgaggagtaagtgagaaggtcctagaaaggatgccccttctaggactcagatcttgcgttaatcgcaataagatggcccggaactatatcagttccgggccatccgtatatttgccattgtgattttcctgttgaacaagagcaggcagccgctcgttgcttgattactcaagcctgtttttcggtgaactggaagaactggtctccgatacgcaccgtggcaggcgcgctgagcttgagcggtgtgcccttggtgacttgtgtctcttggccattggtgatgatgtaggtgccgttcaacgagccgtagtcctcgatccacagcgcgccatcggtgtcgatgctgatggcggcatggttgcgggatgtggtgcgggtcgggtctacgatacgcaccgccttggcaccctgcggcacatccatggaaggcttgcggcccagcaacgtgctcttatcgatcacgatggtctggccggtgacatcgttatgcagcaggtacgtcttcttcggtgccttggacgtgaacgaggaggagagcacggtgctgtcccaatcctcgatgtcgttttcggcggcgtgcggtgtggtgtctgccggagcggtggcagcgggctcagcggcggcggccgtggcggcaggctctgcggtaaaagcggtattggttgccgcttccgcggtactgggctgcccgtagtcgttctgcggttcggctgtgccaactgcggaatccggggtgccttccaccggatcgtcagaataccaacccagttcaggtgctggagggtagggaagtttggccatgatgatgccgtcctttcactgacgggaagccagagcggcgttgattgccgggtcgccgagctggcccagccattcgatcagtgccggataggtgttgggattacgtgcgatgcaggcgcgtagttcaggcgcgtactgggcaatctgggcgatttgcatctggtcggtggtggtcagggcctgttcggcggtgaaaccgtaaggattggtggccacaggctcctcgaatgccgcctgagccgcgggctgctgagcctgttcggcggcgggctgctgggccgcctgtgccgtggctttctgatcctgaaccgggccgccgaatgcctcggcagtgaacccgtattgcgccagggtctcgcgggcgcgatcgtcaccgaactcggcgatccaacgcttcaagccgggataacagcgcggattcacggcgacattggcaccgaattccggattctcgtaggcgatttttgccagcagaatcggatccgcgttcggatcctgaacggcagcgaccgcagcatcataatcaaccatgggattacctccttatgttcgctcggttatgccgaacgtatggtccgtagtgtttgtagtgttgcgtcttcaatggcgccgatatcctcaccttcgtccagcctgaatgcgctgaacgcatgatgttcgggttcggtcaatggcatatcggccacaatcacagtgatattgtcggttccgcccgcatcaagagcggccgccaccaaggcgtccacggcctcctgcggactggaatgcgccgcggcgatggccgcgatctgttcgtccggcacctcgccatgcaatccatccgaacagatgatgaagcggccggtcagatcggcgacatatacgtcgggcatgatgccatccggatcacccagacattgggtgatgatgttgcgtggaatggtcgcctccgcctcttccggcaacatctgcccggaatcgatggcttcttggcgctgggaatggtctcgcgtgatgcgggtcagcgaagcggcgtcccacacgggaatgatatccgtggcgggagcatcggcatgcgccaacggactgagatggtaggtgcgggaatcgccgacattgaccacataggtctggtccgagaagtcctgatcatcggcgtcactgaacaaagcagcgctgcgggcgctggcggaatccgcatgatcttggggcagtaccaaaccggagcaggttgtgccggccacgccgccaaggcggtctcccagatcgagaatgtcgtgctgggcccgtgccaaggtgtcgtcgatatcctgacgggtgcgtgaaggcatggcggccaattgtgcgaaatgctgggcagccaactggcttgcctgctcgccgcctttgccgccgcccatgccgtcacagaccatgaacacgccttgttgcgcgaatccggtgtcttggttgtttttgcgcctaagacccacgtcactggtcatcgcgatacggatggagcctgtggtcatgacgccttccccttcttacgcgtgcgcttgacatgcgtcgtgtgcggctttgctgcgtgcccatttgacagtatagccacgcttttcagggaaagtcgtgtacgtatcctcctgaaacgcggcaaagaagcgagcattgccttgcgtaattggtcgactcctgtccaatatgtggtggcttggcccgattcaatgtcttgccccgagaacgtggcgtagtcggcttcccggccaagctggatcaaagcctggtcatctgtgccgagttgacgggcgatggcaccggcctgatctcgacgagtgcccttggctgtgatgccgctttgctcggcaagcatgcgtatggcattccaacctgctgccacacgggctttcggactgccatgccgccgcgctcgtgccagcagtatggccttgaacatcagaatcagaccgcaggcgatgagtagggtccacaatgggctgccgtacagggccaccttgcgggtcactcgccagaaccgcgcccagaacaggttggtcggcgaatcatcggcgtcggcgccggccaatgagctttggcccttggcttgcgtctgatcgcgcagcggatcggtcaacggcactggtggttgccggaccagcgtctgcggattcggcggcgtcaggttctggttttcatcaggcatcttggtctccttgggcgtcggatagaacgccacccatcccaggccctgcaatttgatttccacccaagcggtgacatcgttgccggtgaattcgattttggtgccattgcccgaggtcttctccgtgcgggcatcggtgatttcgccatcctcgtttttcggcaggaagcccaggaccacacgggagggcagtcccagatcacgagccatcagtgccatggcggaggcatattgctcggagtcgcccaccatggccgtgcctgccagcagcttgttgatgcggtagttgccatggccggcatcggagggatggtcgccttcaagtccatgagagaaccatccggagtctttcaatgtgtcagccaacgccgtggctgcggcaccgcccgaggactgcccgccggcaatggacgtggccagtttgctggccgaatcgggaacatcctgggcttctggttgggtgatgcgggccgcagccgcactgctgatctgcttatcggtgggcttgcgggcgataatgccggattcggtataggtgaggcctttacgcgtgccggcgggaataatggcggaatcggtatccgtgttgtagtaaaacgtgtcattgccgttgtcggcatcgttggcgaagctcacgccagtggccgctcccgccagcggcagccaggtgtcggtcagttcctgatcgacggtgaaggtcgcagtgaaggatttaccctgctcatccgccttgatcgtggtgcccacgcgatgataattcgaggagtccgtggcttcggaagaatcggacaggttccatactgtgccatcgaatcgatccatcaccgcaagtttgaccggtgttccggccggcagattatgaacggtcagcaacacgtcttttttgtggtccttgatataggatcgcatgccgctgagcgggctggtgtaatcgtaggggcttaacggcggatcgtagcggtcacgcagcacgaaacggtcctgtggcaccagcaacgtgcccccgaaagcaaggccggcagcgagcacgacgatgatcagcgcggatatccagcgcccccattccagcagttcaagacgccaagacagccagataatcagcagcaaggcaaaggcaataccgcagatggcgcgttgccagccgctgtctgtgcccagcagggcacatacggccacggccgccgcaaggggcagcactcccaccagagacaaccatgcgttggcattaatggcaaacacgccggtgaagaacgtaagccacaggccgatggtccataccgccatcagcacgccgtcttgcgtgcccagaggcggatcgacggaaataatgtacttgaacgagccaaacgtcatttcccaacctgaactcaaggtcttcaaggtgggaatcacgtaatgggacgtagtggaactcagcgttaccaccgggccgatgatgaattgggcaaacgccagaaacacgatttgccaccacagtcgcaacgccggcaacatgcccgccagagcgatgatcgcgcccagcaaggtggccggtacagcggcaatcgcccaagtggccacgccgccgtacacgtcgatgagattggcttgcgccagcaacatcatcgccgctatgagtacgaggctggcgattcgtttgccccacggctggcgactgaggcccatgccgcgaagcacattgcctctggtcatccagataaccgaatgtgtggagtcggcccaggagccggtggtggtggaggtcccggtgtacgtgccggaggaagtgccggtgtatgtgccgctcgatccggcgtacgcagcggtattggtattggtgatactggactggtcgaaggtcatgcgagcacccccatgatcagcgggagatcatcgaggtcgccgatggtggccaatgtgaagttggcgaatcttctgatgccgcgattggcgccggcgctggcctgcaataccacgcagctggccgatcggggcaaggccaaggtcatgcgcttgatttgctcgatgtctttcagcgatccaacagtgaaaaaatagaacgaagcatcaggactgtgcttcagcgtgccctcggcgagattcggattatcctcacgatcagactctatggcactggcgttgtcgaggaactccatggcgttgcgcggctggccgtgcgtgttgcccgcgtggcagaacaatggacgatcctgcagcaggcatttgacgccgatggaggagtggatggacaccgccatctcgaattcctcgccgttgacgtattcgtccgggttcacgctgatggtcaccgaggtgtcggtgcggcgcgtggcctcatattggcgaatcatcaacgtgccggttttcgcggagctcagccagtggacgttacgcacgtcgtcgcccggctcgtattcgcgcaatccgtagaagtcgagatcatcatccacgatctggccggatggttggccttccaggtcgcggggcacgccggcattcagagtatcgagacgcacggtacgagggtggatgaatacggtgatgcggtcggccagctccttttcgtgacgcaccagaccgaacgggtctcccttgcggatgcgcaatgggccgatgggcagtattgcgcgcgatacggtacggaactccacatcggtttgcttggattgcccgggagccagcatggggatgttgaatcgttcatgcgcatcgccgattggcagatatccgcgtgccgtggtcgtcggcgttctgccggtgttgtcgatgccgacgataacggatacggtgtctcccacggtcacgcgatgattggatacgacgatggacgcgtggaagcgtgtgttgccgagggaaagcacgattgccgcgagcatcatcaccatcgccacgatgccgaatacgagcagctcataccagcccagaaacgggaacgcaataaggcatgcgatgcctgcgcccgttaccgcccagcccaagggcgagacgtaggatgcgaagaaccgtctgatgcgtcttaccgcgcgcttgaacatgcgttcagcgcgccggcgacggcgtaatgcggcggatgtagatgccatggtcggatacctttccgggccctatcaggaaccgatggtgggggagggaacgtcttcgagcacctgtgcgatcaggctttccggagtcgcgccatcgaaggtggcttccggagtcagcgtgatacggtgtgcgagcacggccactgcaaggtccttgacgtcatccggcaccacgtaggcacggccatcggccgcggcccagatacgggcgcatcgggtcagtgccaaagcgccacgcatggaggagccgaccgtgatcttctcgttgtggcgggtcgcctcgacgagcctgacgatgtattcacgaatcgcatcatccacatagatttcggtggccacctgacgcagccgcatgacatcgtcaccgctcagcaccggggaaatggtctgcgcacggtcggtgatatcgacctgcttgaggatatcgacggacacatcatggcccgggtagccgattgacgtcttgataaggaatcggtccatctgcgcctcaggcagcttataggtaccgagctgctcgatggggttctgggttgcaatcacgataaacggctgcggcacatcatgtgtgacgccgtcaacggtgactttctgctcttccataacctccagaagtgcggactgcgtcttcggcgatgcacggttgatctcatcggccagcacgatggaggcgaaaatcgggccttcgcggaactcaaattctccgcgcttctgatcgtagaaagtcacacccaccacatccgaaggcagcagatcgggcgtgaactgaacacgcttgaaaccggtggaaatggaattggccaagcctcgggccaactgggtcttaccggtgccggggttgtcttcaagcagaatatggccaccgaccatcagtgcggtgacgcattgcttgatagggatggtcttgccgataaccaccttggagacattttcgaccagcgcattgaaggactgctggaaatcccggacctgagccgtgggctggggcagtagtccggaattgatgctggcgggcagtgccgatgcggctgcttgcgcggctttgctcgactgacgctgcggctgggattgtggctgtgattgcgcggtgacctgctgcgggatggctggcgtcgatcccttgcgcggcttgagcacggtgctgtcatcgcccgcaggaatggaggcggcatcagtagtaggagacggcttttctgacggcgcttgtgacggccgctgcggcaggttaggcagcgcaacggactgcggcgccgactcggtgcttggggtcgtgccggtgtgtggtgcggatgccaggtgcgtggcgtcggacaagtgcgtgctgtcggatagctgcgtgctgttggacaggcgggtcgtgtcagacaactgcgtcgcgtcatcgatgttctcgctcatggatgttctcctactgcttgtgaatggtggttgacgatattggggtattgccgaaaccaagaatccaggggttcttggccaaagtggtgacatcggtaccggatttgagcgacttggtcccctccgaggagtcagagggacgtgtgcccgcgacgctgcctccgtccgcagtgttgtcgagaccggagtatcccggcccgccggtgactttgacgctccacgcgtagttgccatcggcggccacggtcaagtcggtgacatccaattgctggccggagttccacgtgaacggttggccattgatgatgatttgtacagtggccgacttgccatagacatcaaccgaaccgccggtgacgttaatgacgtgagcgttgtctgaccagcgcagctcctgcggtttgttgattacagccttcttctcataggtgtaaggagcgccattgtgcgggcctccggtgacggcgtcgctggtagcgccgttgaacacctgttgcaccgatgcggtgttgcatttggcccaaggactcattcggaagtcgagtgagttccggttagtagctgtaccggaatcgatgccatcggcagtcacgctgtaggactgcgcatgtccctgcttggtccaatgcacggtgcatgtactgccggatccggtggtgtagacgtcagtgggcggctggaccttgtactgcgggacaaagctgctcttgcccgtgccggaggaagcatcgcgctgcggcaccacggtggccgttacggtgatttcccgggtgttcaaatcgttctcattgatatcgaacgtagcgccactgtcactgcaatcgatggtgtccttgacgtctcctcccaaggaaattcgccggcagccggcattgcggttattgccgagagtgactttcgccgttaccgtggtgtcgtcgttcgacaacgcaatgttcggcgcatccgggtctccccagatcttctctgacggcgatgcggcggactcggcactccaattgattttgttatgggctttgacggtcgccgtaatggcggtgccatcggaaatgtcgttgttgttgaacgtaaacgacagctcggtggccgtattgccggtttccttggtctgcggagcacctgcaccggtgacggtcactgaatagttgtcgacggcgctgaaatcaccgctcggcgctttccacgtcaccttggcggttttattgccacctgtgaccgtaacatcggtgggagcggacggcaccttgtccggtgtggcttcgacggcggtggacggcttggaccagccgacgtcatttcgcgcggcgacggtgaaggaataggttttgccgttcttcagaccagtgacctggcatgaggtgacggtaccgcaatccttctctccggtgacggcaccggtccaactgaccttgtagttggtgatcgggctgccattggcggcaccgggcgtccatgtgaggctgaccgcgctgtcctgcggttccccggctacgggggagagcagtggcggctcgggcttgtcgatcacggacacggtaatcgatgcggtgacttcacgatccttggacttggtgccgtcttgcacggtgacgagcacggtgttcgtggaagcacctacatcggatgcgacggcgatggtgatgtttccggaggcatcgcatccggcgatggtgagtttggcggcgtcatccgccttgcagctgatgacggtcagcgaggaatcggggaacggattgtacgcgccggtaagcacgttcacggcatcgctggcaccggccttgatcttcaacgtcttgttgccgacgcgtgtcagcggacgggtcgaagacactacgcgcacggtcacaccggcattcacggtgcccgcgccgtatgcgatttgcacgggaatggacgcggtggtgccaggagcggcatccttggtggcggaaacctgcaagctaccggaacgggacaggtttgcggtgatttgcctggatgatgagcttccaccggaatacgtgtattgcttttcgtcgtcatacacgccggacggtgcatgggtgagcgccgtcagatcaacggtcttggggtccgcgcccgcctcgacatcaatagtggaggacgagaacgtgggcggcggcacatcgcggcctatcaccgtgatctggagagtgatcactgcggaattgatgatcttggtcttatccgatccctgcttgccatccacagcggtaaaggtaatggaggcggggcctgcgtagtcttttgccgcagtgaacttcagggtcttgtcgttcacgtagaaatcggagttggaagccttggtggcgctgacggaatcagcgctttcgatatacggttccttgccggcgccgacgcggacatagtcattgatgttgatttcaatggtctcgcgcgagttgaccttcaattccggtgccttgggacgcagcgtgggcggaaagacaccataggccggtacctggatgaacgcggtggaggtgatgttgtatttcgtattggtcaccgtgtaaggcacggctcgcgcctgtgacgtcaggtcgacggtgatggtggtcgaatgctcgccgcccttgacgtgagcgtgagcgctggcggagggatgcacgccgaccttgagctcattggctgtgccggaaggattggcgatccactgggaaacatccacatccacggacttcttatcgatggtggcggcggacggcacacgatagtcgtaggcggtaggcggctcgatggcggcactcggatccacgtttaccgtgagggtggccgtatcggacaagccggccttgtctttgaccgtgtaggcgatatagtcggtggtggcgctgccgggcgtggtgaaggagatcatattgtctttcacgctcaccccgtcgagaccttggacctcgacatgcttgtcgacggtcagattggtgttgtcgccggagatgtcgttctgcgcgaccggcacggttgcggccgtattgggcctcaacgtgatttcgtcatctctggcgtatacgccggagtcggacgatccttggaatacgcccacgcggatctgcgcctgtgcgcgctgaccggtccaatcctccacggcataggagaaggtgtcggtgccggacgaatccggatacgcttcatagaccaagtagtcggaaccgacttcggatatgcggcccagcgtgggtgccttgttgcccagacccaacagctgatcgtcgtcgccatccgtgtctatgccggtcagtgtgatggggatgcggaccttctgcccggcggcaacctgcgcttcggcgtcatgcggggttggcgcggccttgctcgctgcgtcgctcttatgcacggtaatggtgatattggcggaagccacattacccagattgtcttcaaccgtataggtgatggggaagttgccggtctcgctggatgcttggtagcggaccgtgtctccagagacgaaggccagacccttgaacgtccccttgtcgtattgcaggttgttcttgagtttgaccgtggtgccatccgagtaggccacatggtcaagcacatccacggacacgatgccgtcggtacgcacctgggcattgatattgctggccttgggcactgaattcgaggtggccagagccggcggctgcaacacgatggtgcccttggcggttccggaggcgttggccacggtgtaggtaagggcgacgggcttcgtgggcacctgacgcgcggtgatatacacgcgcttatggctgacgagaccaaccttgatgccggagtcggccggtgcgctcaccgtggtgacggacagcacaccgcccatcggatcgacgtcattggtgagcggctccacaatggcggtattatccgcgccaagcagggcgacatcgttggcggcaaccggtttggcggcctcgccggtggcaggctgcacctcgactcgagccaatccggtggccggaatcgaaccttgagtaatgatgtagggcacataataggtgccgggattggtggccttgaacgtcaacgacatatccgccgcattggtggtcgtcgaagcgccgttgggcgtatccacctgagtcagttgtgccggctgcaaggaagtgccatgcacataagaggacagcttgacgacggtatccgtgttgggaacggtggttttcgctaccgggtcgatgaccgcggccaaggtgttcgcgggcttgaccgagaaatacaccatgccggtgccggttgccgtgccgtcggagacggtgacctcgacgcccacacgtcccgacgccagcgcaccggtgttgaacgtaagctggccgtcggctcgggtggacacctgcacctggtcggtgttctgggccacagcggagaccagagtgagcgggtctccatccggatcgttgaagctgctcagcgcattggcggtataactggctccctgctccacatcgatctcgggaggagtgtcgaactgtacgggagcgtggttgcctccatcattcagggttacggtcaccgtggcggaagaggtctggccgcgaccatcggaaatatcgtaagtaaaggtaacggtgcctgcggatgcggcggaggcatcgagttgcagataccggccgtcgtaaatcggcgaaatggtgacgtctttgttgtttggtgcgccaaccttggtgattttcagtacggaacaatcggtctgctcgtcattgcgcagcgcgtcgagaatctgttccgaaccggctcgtgcgccgatttcatcatcctcggctttgatttggccggattgtgcggaacaggtcttggagaagtcgtggtggttgttggccgagtcgttgttctgctgttctttctcggtctgctcggtctgtattttgttccactgtattttgatgactttggtggaatcctcagggttccacacattgccgttaaccgtgtcgttgagcaccacaaggcgatggttggtgcggaacaccaattcggaagtagtattgacggattcgagggtttgcggcttgacgctggtatccgtgggggagcaggcgcgaatgtagttgctggccttctggctccaagccgagtacacgcagcccttggacgataccggtcgtgctggattcgccttgcccccgttggctatgaaattcgccttggcattggacttcaacgggataagcgcaaggcctctcggtgatgccgcggccacccaatcggactgtatgtcatcggtgggaggctcctgaagggtgagggtgccggtcgtgtcgacatcgacgcggccgcccttgaatatgacggttttgccggttgcgattaccggcgtgctcccgatgacggtaaagctttcaacggtctgctgcttgccgtcggtcagcgattcgagggttttggccttggcgctgctgggattgtcaagacgcagcaccataccgtcggatggacggtatccgtagaccttgccatcgtgggttactgcgatgcgcccgccctcgcccagctttattttcggatcggaagtggtgggggtcacggaatcaaggttttccgacaagccggtccacacattgccggtcttctcgttgatcagggctgcggtatccccgccgaccacagtggtggtgttggctttgatgtcggtcttgacaccggtgctgaccgtggatgccttgatggtggaggctttggtcgtttcggtcaggatggtgtcgccattatgctgtgcgatgtcgaatcgtggggcggaggaggagacgccggcgtcagcctccttgttctttacgttgaatcgtgcggccttctggtttttcagcgaagtgacccatacggtgccatcgtccagttgcacatggcggcgcgtgacggtgctcatgatcaccgcgccggcaacaagtcccagaagcagcaggagcgtgattacgggaaccgtccacgtatgccctccggagggcataaggcggcgcaaagccgcgctgatgcgtcggcgacgatcgtatgactgggacgatgtggccatctgaactccctgacccctgttttctctggttgctggtgtaatgacaacgctttacggttccaatacctgccgttcctgttgtccatttggtgaattcgccgctgctgggcgcacgtctgatgcgatacgcaatgccagggtggcatgcccggcagtggcgagcggatcattcttgcggcttggccgcacaggcgatggcggggctgacggacatctggcggttcttgcgcacaatggacacctgaatgcaggtctgcgagccttcctgcgcgttgacggtcaccgtgggatctgacgttgtgacggtttgcgcgctctggtcggtattgctgccctgcactatggcccacgcataggtatcaccgctttgcgggtctggattcgtccaggtgaacgtcacggatgacccatccgccgcataggtgccgttcagattctccggggaaggaatctgggcgttcgcggtatcggtgatcacgtcatcctgattattgcggttgttgtcatcatccttggtgccgggcgtcgccacctgtttggtatctgatccggtggcgctgtccatgcggggaacgaccacgaaggcgaatatcagtgccgctgcggtgatcgccgcaagtataccgacggtaatacccaccggtttgacccatcgccgtgacgaacgggtgatctgatctcgctggtccgtggcccggcgccgacgctcgatgtctttgggataggccggcatcccttccacggtaacgggagtggcatgcccgaaatatgcgaattgcacacgctgcatggcacgtgcgaactccaacgcggagtagtaccgctggtcggggtccttgttcagggcccggcgcagcaccgcttccacatcggccggcacgtcggggcggttgaggcgaggcaatggctggttgacgatcagcgaaatcagttccgattgcgaacgcgggtgataatcgtgctggaatggcgagcagccgacgaacatggcgtacagggtggccgccagtgaatagatgtcggcggcttccgaaccattggtcagatgctgaagcacctcaggcggtgcccacggcggcgagaatccggtttcggtgcggtcatacacatcggtggagataccgaaatcacccagaacaggcaagccctgcgaggtgatgagaatgttgctgggcttgatgtcgtgatggatgatattgctgcgatgcgcggtgaacagcgcgcttgacagcttgatgccgaggtcgagtacctgctcgcaggtcatggaccgggccttcatgatgctgttgtaggtgccgcccggcgcatattcgatgacgatgtagccatggccatcggaggtgacgccggcaccatataccggcagaatgtacgggtgggatgacagcttggccatgaagttggcctcgcggttgaacagggcagcggcccgtgggtcaagggttttggcgctggcctttaccgccaccgggcgtgcgggcatacgctggttatataggtacaccgtggcggtggcaccgcttcccaacatctggacgaaatcatatccgggcagcttcggcggtctcatcggaatgttgtccatctgttccctccctccttggaaaatgcgctctccctgcattcgttctacaggataccgtcaagggtacgattcttcgtcgggttcggtaaaatttttccctctgtgacggtcgggtttaggctggagccatgatgacgagacttgaacctggaacagtgctggacggcatcgaccgtgatggagcggcgaggctgattgtcggcacgcctggaagcggcaaaactgaattcgccttatcggtgttgatggcggggctgcgccgctacggtggcacgcaggcggtgatggccgtatccggccgtgtggccgccgacgcattgggcaatcgggtgattcgtgagctcgggttttccgtgcaggccaggccggtcaccacgctgggtgccgtggcattccgggccatatcggcttcgcgcgagggaactggattgccgtcgcctcgattgctgaacggtgcggaacaggatgctttgctgcgtcaagtcatggccgtgcatctgcgccatgccgtagcgggagatgattgcggcacctgtgatttgctgcgcgtctactttgcccaggatgactgggcgagactcatacgcgatgccggtgccggcgagatgcccggctcggccgcttccgcacaatcaagcctctcgcaacaagggtcggattcgccgtctccgacgtcggcaggcggctcgaccagcgcggataggttcacgcgaggtatttcagatgcgtttatcagccagttgcgcgatatgctggcccgattggatgagctcggtgtaggcgttcacgaagagccacgtctcttggacgccgtgacggaggacgcgcgattgtcggtgcaatggcgtttggctttcgcgttgcgccgtgaatatattgcagcccaaagcgcggtatatccggggcaataccgtttggatgcctcgtatttgctggtggcaggcgctcgtgtggtgcgtgaggcattcgccgccgatcacgcggatgattccgaccggcctatgtgtgtggaggcgttgggcttgccccggctgctggttgtggatgatgttcaagacaccacgctggccggcatgcgcttcttggaggagttggggaatgccggcgtcaagttggtgctggtcggcaacccggatgaatcggtgcagaccttccgcggatcgtatccggaatatctgatgcgccgtgccgtggaagggcggctgaaggccaaggaagaacagctggttggcggtagtgccgtcgctgatcagtcgcacatgacgatggctgatgtgatcgcgtctcgtatttcgctgtcgattccctcgccggaagacgagccgctgcctccggccgagcgtcccggcaagctgaccgccatactgggcggagtcgatgcagcgaattatcaggcggacggcacggtgaccgccggcctgtaccgatcctcacgtgaggagctggatgatgtggtctggcgcatcaagcgggcgcatcttgaccggcatattcggtggaacgacatggcggtcatcacccacgacaatgccgccgtgcggctgttcggcgaacgactgcgccgagatggtgtaccggtgcggtattcgtcggtcacccgtcctttgaaggacgagactttcgtgcagggattgttcgcgcttgtggagcttgcccgattgcgtgccgaggggatggcggaatgccagatgacgttggcttcctgcgcggcatatataaggactagagtggccacgttgatgaacggcccgttggtgagtgccggggccaaacccggtcaggggcgtcccgcaaggcttgcgccgatcgaatcggccatggggtcgttggagtcgctggcgcatctcgccacggatgatgccatgctgacctctctgacgacggcatgggaaacattgcgtgaaacataccatgaaacacggcgtgaaacaggtcgtgaaacatcctcgtcagtggtttcgacgtcagcggtttcgtcgtcagtgacttcgttgccagtgtctgtcgaaatactcggtgaaccgtccggcgatgacttggcctttggcgttgacgcgctgtacgtgatgcttgccattgatgatgccgccgcgccggcgcaggctgcgctcgcatccatccacgcggtgctcggcaacgaccctcaggcccgcgcttttgcgaacctgtggcatctggtgggcagcgttgcttccggcttggagcggctgccggcaagccagcgcgtacagccgcgctatgcgctgtctgttgcgtggaacgccaccggtctggcaccggtctggcagcgtgcggcattattcaacacggcagaggggcatacggccaatgaccggctggacgcggcaatgcgcctgttccagttcgccgatgattccaccgccagtcgagacatcacgtcattcatggcacaggttcggggcatggaagtgcaggccgattccttggcccacataggaccggtggaagacgcggtgacattgactacgccggcaggcgcggccggacgccactgggaatatgcgtggataccggtggtccagcaagacgtgtggccgaacctcgccgggcgcaacaccatgttcggtggtgaagaccttgccgagctcgtgctgaggggagcgcttgaagaaagcgacaaaaccgggcatgatccgcggttcgcggctgtattgtcgggcgagaagaagagtttcctggtcgcgctgacccgtgcacggcgaatcatgatcagcgcggtatggaacgacagcatgagcccctcggactttctcttcgggtatctgccggaatactatccgcgcaaccggcaacaggcgcctttcaccacagtgggggcacatgcgggattcgccgaatatgatctggccggattggacgccgacccacgtgggttggtcagcgccgcccgcgcggttctggccactgctcaaccgcagcaggctgccgcaaaggacgccgcgattgcgttgacactcctgttagagcatggtgtgcgcgccgcaaatccgcagagctgggcgtttgtggaatcgccggcccaatcggatagcgcgtcatctggcggtgcgtcatctggcgatacctcatctgacagtgcctcatccgacagcgcgtcatctggtggtgtacagcctgacggtatccaaacagggaaaggcaagacggatgcgcaggccgcgcccatggtcaccttatctccatcggcggtcgacagcctatgggcgtgcccggtgtgctggatgctggagaaccggttcgccggtcctcgccccagctccgtggccaccagtttcggaaccctcatccatgcggttgcgcagcaaggcagcgaggaagggctggaccatctttcccacaatgcccaggcgttggccgcactgggcttggactccacggccggcgcggaacgtcgcatcgaggctgtctcggcacggcttaatgccatctatcagagcaaacgtcctgatccgaatgccatagccgacacccggaaccgctatgaggccacccgtaaggacgagtccgcggcggataccctgcgcaacatcgccgattactttgtgcgcagcgacgccgatccggaaacgtatcttggcaagaacttcagcaacttcagcattggcgcattggccggtgccgaatgcgaacgggagtttgccgcacgattcgatgtgcgtgacatactcgacgcatacaatgccgtgcccggcctgcacccaatcggtcggaacacgctggtccgtctgatgggagcactggtcggagggtggccggaaggcatggacgagcatctgaccgtgagactgtccgggcgcatcgaccgtatggaaacccgcgtactcgcagacggcggcgaatgcattcgcctcattgactacaaaacaggcagaacgcccacggtcaaacagattttcaatgatttgcagctcgtgtgctatcagcttggcctcgtgttccccgaagacgggccgcgcggtgccaaggcacttgccgcaatgccgcatatcagccaaagcgtgctattccatgtcgggcagaatgcggcaccagccagaagctacgctccggaaggtgccttccagccgccgctgttcactgatggctcgttgaatgccgaaccgttcacgccccgatactggtataaagaccccaaccgtttcttcgacatacccgccatagatccggctactcctcccgaaggtgtgagtgccgaagcgtgggcgcaattcgccgcgctcgccggtacgcagacgttatggtcgctgaccatgatcgcccgcgtattctatgccgcggcggccagcagatcagccatcatcgaggcccatccgcaagacacccatatcggattctgccgtatgaagaacgtctgccctgcctgtgcaggccagatcgacacgattttcgaaacgaggcaagcatgagcacgttcactcccagtgcggaacaggccgccatcatcgatgcgccagtcgatgctgacgtattggtggttgccggtgccggttccggcaaaacctttacgatgacccaacgcatcatcgcgcttatcaatcgaggtgtggcacctgaacgcatcctgggcctgaccttcacacgcaaggccgcaggcgaactgctggaacgcgtctccgccgcagtggccggtgatatggcgggctctacgaccgccacggtgtctgatcgggcattcctcaagccggccattttcacgtatgacgccttcttccagaccatcgtgcgccaatatggactgcttgtcggattcgatcagaacacgcaaccattgagcgcagccggagcgcttcaactggccaccgaagtcatcgacagtcacatggatctggcgttcagtgaggattttggcgccttctccagtttggcgaaccgtgttctggcgttgtcggatgccattggcagtgccatgatcggtgccggctgcaccagcttcgatgatgcgatcaatcgagtacggcaatgggattcggcattcatcaatcgattgcaacaagccgttgcagatgaacccatgcccgaggacgagccgaaaatccccaagatcaaacgactgaagaaagataccgacgccagctggcaagccaagctcgatgaccgtgccgaacatttgcacgcccgctgcacctatcattgcggtgcgctgctggagaccacacgcaaacgcgatattctgctccagctggtggaggcctatgcccaagccaagcgggaacgcaatatggccgaattctccgacttcaccattgccgcgtatcagcttatcgagcgcttcccctccatcggagagcgtacgcgccgcaggtacagccacgtgctgctcgacgaatatcaggacacctccaccacgcaggccgctctgctggcagcactgttccacgtggatgcgtcacagaggtccgccgtcaacgcggtgggtgatccgttccagtcgatttacgcatggcgtggtgccagccctggtgcattccgtatgttccagcaagatttccacctgtctgccggatacaagccattcccgctgtccgtcaccaggcgaaacagccgtatagtgctcgaagccgccaataatctcacgctgccgttgcgctccaatccgtcgcgtccttccagctcattgatgcgtgaggtcgatgtctcatcgctcgaccccatgcctgatgcccccgaaggaacattgggagtactgggcttcgccacggccgggcaggagatcgacgccgtagtgcgtttctgcaagacggccatcgcacggcaccgttccgcagccgaacaacaggaacagatgccgggcgaacagaaagcgccggtcgccgtgctgtttcggtccaaatcacatatgcccgaatatcaggcggcattggaacaggccggattgaccacattcgtggtcggctattccgcgctgttggaacgtccggaaatccgcgatctgatggcgttgctgcacgtggccgccgaccacaccgatacgggatcgctgatgcgcttgctggccacgccacgattcaccatgtccgcagcggatttgaccatgttggcccgttttgctgaagaacagaacacggaacaacgcttccaagcattggtgcaggccggccttgcccaaccggatacaccagcgaatgaatgggcggctgtggtgcgtgagtaccgcgatcaggtggccaatgcggtattcctgccagacgtattgctacgcggcgacctggtaaaactgcttgaacggttgagcgcacacgggcgcaacgccataacccgggccgcggtgatgctccgtcaggtgcatgatgccgtcgggcggccactgggcgacgtgattcgcgccggcatagaagcgttggatcttgacatcgacaccgtattggccggtgtgctgcataatccgcagcaccgcgccaatcccgctttggcgcatatgcctatggatgcgattgtggatttggtggatacgtacacgcaagagattgccgctgagcaaactccctcgttgcatgggttcatcacatgggtggatcatctggcttcggtggaggatgaagccgccagtctccctgacgctccggtggatgtggaactgatgaccgtacaccagtccaaagggttggaatgggatgccgttgcggtagtggggcttaccgccgtcggattccccagcaatcagggcgaccatctcaagatcgtgctggacgagcaccatacgggaggcaccgagcaaggtcactggaccgcacccgaatatcatgagaccgccgactcctggctcaccaaccccaccgccgtacccgtgcctatgcgtgccgatgccggcattctgccgcgattcccccatgatgccgatgtggaagccgaccccatcgcatcgttggcggctttggatgatgtggagcttattgatgatgaagtgttcggctccatgcgcgaattcggcgatggcgtggaagaagtggatgcatccggctggtatttgacgcaggcggaggaatatgggcgccggctgcatgccgacgaacgtcgattgatgtatgtggcgcttacccgtgcgcgagaagatgccctgatgacctattgcgcctatacgggcgaatccgggcgggacccgtcagtggtgcccaaaggctctcgcgccgctcagccatccaatttctggcttgaagtgcatgacgcgctccaagcccgtgaacatgcgatatcggctcaggactgtgtggaacggctgcaagccgccaatgccgggaagcccatgctgatctcggcgcaaggcgaagcgattgccactcccgaagggttctttatcggagagcatgccgcggcatacggtgacgccgtggtgggggaggcatggcagacgccgattacgcagacggatgccgctgtcgaattgccgtggccggctaccctcagcgacgcagtgcatgaacagctgtcacgtggcatcgatgttatcgccgcagattcctcgtcacttgagcagcaccaagacgccggtccactgctgcaacgggcgcaattgctggtggacgacgccgatttgatggccgatgccgccagcggccagtcgcttgatgaggcagtcaaagccaaggcgcaacgcgttctggctgcaggacgccagaacgtgacaagcctgcaagcccgcgtaggtggcatgaacgaacgggaggagcgcctctactggcgtagcattatccgcccgattccgcgcatatcgtctccggcggccgaggccggcacgcagttccatgcgtgggctgagcaattcatcaatgccggtaagccggatgaagcggtactggcatatgaagccgaatcaagtatgccgcatacaggtcaggatgcgggattcgtttcccgggaagccatgttggccgatttggccgaacgggagcggcaatgccgcaagccatccacacggcagcccgctgtcccacagcccacggctcaacaatccgcatccgccgtatccgccgcctccgccacttccataagtagcgacaatgccaccgagtccaagctggtggcgtggcagcgcagactggccgaatcatcgtgggccaagcgcatcccggcgtggacggagcgtgccatcgtcgtggacgtgccgggcgtgggcctggtcaatggcaaactcgatgcggtattcatcggtggacttgacccgtccagcaccaccgcacgctttaccgtggtcgactggaaaaccggtcgtcggcccaccaagccagacgacatcacccgcaaactcgcccagctcgacatgtaccgactgctgctggcagcggtcgaaggtgtggaattggacagtatcgacgccactctctactatgtcagtgagcccgacgagggcttgcgcgagcttcacgcccgcgcgaaaaccaaacaggaaatccttaccgagttgagctccggcattcccgaacaatctgacaacgactgagcccaaaggctcatgacctgtacagcatcggacggccttcaccggcggagagaccttatgcatcgcaaggcatctccgacgatgaagacgactggccacgtaccggtccgcggttgaaacgcgccgcgtgacgttgcttgggaaccgctacccctcggatggcacgtgtgggcgggcgcacgtgccggacaacgcaccagtaaggagttattgtgtccacgactcgcgcggtttcgaagtcgtccgctgcccactcgccctatcagcgcctgttcatgctgcccggagccaaggcgttctgcctgtccggtgcggtggcacgattgccgatctccatgatgagtctcggcatcgttctggcgctcaaccatctctacgacaattggaccatcgccggcaccatgagcgccgcctatgtgctggccatgagctgcgtcaccccgttctacgcccgcgccttcgaccgtttcggccaagcccgcgtgggccggcttgcgctcgccgtgcagatcgtggccatgctcgccttcgccttcgcggcgttggtgcgcgtgccgattccgctgctgttcgctttggccatcatcatgggtctgacgcagttctcattcggcgcattggtccgaacccgttggtcctatgcgttgcgcggtgtggaagatggcgaacagctgctcaacacggcctacgccatggaagccgccattgacgagatcgtctttattctggggccgattctggcggcttggctggccacctccgtgcatccggtatcccaactgttcgtgcccaccgtggcatgcggcatcggcggcaccatattcttctcgctgaaatccacccagccgccggtcatcgtggaacaggtcagcgtggccgcgcacgatgacggcagccccgctgcaagcgaagatgccgaccagctgaccctgcgccaactcaaacgcagcggtgccaagcccaagagtgtattgctctatgccggcgtactgccgttgctcgccgtgttcatcgtgttcaatatgagcttcacgtccttcgacgtgtccattaccgccaccatgaaatccatgggacttgagcccttcctcggtctgcaattggcgatgttcgcggtcggctcgtgcatcggcgcgctggtgttcggctcttgccaactcaaaggctcccattgggcgcatatggtgatgttcctgtcgctgctgaccgtcggctacgtgttcttccggttgtcaatggacaatctcatcctgctgggcgtcttcgaaatcctcgccggcctgaccgtctcgccgacgttcgccaccggcaacctcatcgtcaaggatctggtgccggcggaatccctgaccgaaggactgagctgggtaaccaccgcaggcacggtcggcacgtcgatcggctcgtccgtggccggcattgtgcttgacgcctccaaccctcatgtgggcatgatgctgccattcatcttcacgctggcgtccgtgccattggcgttggccggatgggccttggccaagcggcgtgggtgaaacgggatcgggctacgcccgatggatggttggcggcttcgccggggtctctccctcagtccgcttcgcgtccagctcgaacgcaattaatgatggctttcagccaactgaattattgctcactgtcgttcgccctcacctaaaaacgcctccggcgttttcttcacggttcggctcatcagagggagctcgacttcacggttcggctcgtcagagggagcttgattctgtggacggggtattggcgtgaggggcctgcggtgataggctgattgccgattggaaaacgtcccgggtacattgccgggcaggtacgggtagacagggaagaagacatgatcaaggtttcggtggtcggagcaaagggccgcatgggctcgcacgtggtcgaagcggtgaacaacgccgaggatacgcagctggcgctcgcattggatgccggcgacgacctgacccagatcaccaccgacaacaccgatgtggtcatcgaattcaccgtgccgtccgtcagcctgaacaacgtgctgaccctgatcggccaaggcgtggacgtggtggtcggcaccaccggctggaccgacgagaaactcgcccaggtcaaatccgccatcgccaacggtccgaagcccgaaacccagaaggtcttcatcgcacctaacttcgcgatctccgccgtactggccgactactttgccaccaaggccgcgaaatacttcgaatccgccgaagtcatcgaactgcaccaccccaccaaggtggacgccccctccggcaccgccatccacaccgcccacggcatcgccgaagcgcgtaaggccgcaggactcgcccccgtgccggacgccaccgaaaccgatggcggctcacgcggccaggtggtcgacggcatccacgtgcacgccgtgcgtctgcgcggcctcaacgcccacgaggaagtgctcttcggcaatgccggcgagcagctgaccattcgggccgacagcttcgaccgcaccagcttcatgcccggcgtcctgcttgccgtgcgcaagctcgccggcgacgctccggctggcctgaccatcggcctcgaccgcttcctcgacctgtaatcgacccgcagtcgaccagtagtcgcccccgcatttcaggcagggaagcgcgccgggacgcgcatcacggcattgccaccggctccggccataatgccacgcattcagcaacaatcaaggtacgtagtataagagtccacaatgggaagtacggtgaacactatgagcgagcatgacatgcaccttcttgattcagcacctttcggccgcattctgccggctatggtcaccccgatgcaatccgacggcagcgtcgatttcgccgccgcgcagaagctcgccaaatacctcgtcgccgatggcgcggatggtctggtggtcaatggcaccaccggcgaatcgcccgtcacccatatggatgagaaggtcgagctggtcagggccgtcaaggaggtcgtcgacgttccggtgatttccggcgccggctccaacgacaccgcacacaccgtgcgtatggtcgaacagactcaggaagcgggcgccgacgcggtgctcgtcgtcatgccttactattcccgcccctcgcaggacggtatcgtcggccactacaaggccgtcgacgaatccgccgaaaagccgatcatcgtctacgatgttcccggccgtaccggcttgaaggtcaaggtcggaacctacgaccgactggccgaacttgaacacgtcaaggctgtcaaggacgccaccggcgatcttgcagccgcagtggagaagcagcagcgcaccggcctcgcctggtattccggcgatgacggcctgttcctgccgttcctctccatcggtgccgtcggcatcatttcggtgattgcccacgtcgcctccaaccccatgcagcagcttgtccaggcattcgatcgcggcgatatcactaccgcccgtcgcctcgccaaccagctcgccccccttgtccacgcgttgaatggcgacggctatcaggccgtcatggccaaggctgcgctcaaggtcaagggcgttatcccctccaccaccatgcgtctgccgaacatcggtcccgacgccactcagcttgacaaggctgaagagggcatgcgcgctgccggactgctgtaagcccgaaacgctgcatacgggttgccagcccgccgcccctgcatgacagagcagaggcaccacaacagaaatcccaaaaaggttatggcacaagaacaaaagaaaacaagcaagaacacgaattctcgccgtcgcggttccgcgcgcggccgcaacgccaacggatccaacagccgtacgccgtcccgtaagatcaacgccacccggcaggccaccgcaccccagcaggatgccgtgctgatcgccccgccgaagtaccgcaagggctccatgcgcatcacgccgctcggcggcttgggtgaaatcggccgcaacatgaacgtgatcgaatacaacggtcacctgctgctcatcgactgcggcgtgctcttccccgaggaggagcagccgggcgtggatctcatcctgcccgatttcagctacatcaagaaccgtctcgacaaggtcgacgccctggtgctcacccacggccacgaggaccacatcggcggcgtgccctacctgctcaagctgcgcccggacatcccgctgatcggctccaagctgaccctcgccttcgtggacgccaagtgcaaggaacaccaccagaaccccaccaaggttgaggttgccggccgtgagaagctcaaggtgggtcccttcgacctcgaattcgtcaacgtcacccactccatcccggacgccctggccgtctatgtcaagaccccggccggctccctgatcgacacgggcgatatcaagctcgaccagctgccgctcgaccaccgcatcaccgacctcgtcgaattcggcaagatcggcgaaaagggcgtggacctgctgatgatggactccaccaacgccgaggtgcccggcttcgtcaagcccgagacctccatcggcccggcccttgaccaagcgttcgcccaggccacccgcaagatcatcgtcgccagcttctcctcccacgtgcaccgtgtgcagcaggtggtggacgccgcccacaagtacggccgcaaggtcgtgttcgtcggccgttcgatggtgcgcaacatgtccatcgccgccgacctcggctacctgcacatccccgaaggcaccgtcgtggacctgaagcaggccaacgacattcaggacgacaagctcgtcttcatgtgcaccggctcccagggcgaaccgatggccgcactcggccgcatcgccgacggcaaccaccgcgatatccacatcaacgagttcgacaccgtgattctcgccagctccctgattccaggcaatgagcacggcgtctacaaggtgatcaacaagctcgtgcagctcggcgccaaggtcgtcaaccgcgacaacgccgccgtgcacgtgtccggccactgcaacgagggcgagctgctgtacatgtacaacatcgtcaagcccaagtgcgccatgccgatccacggcgagaaccgtcatctggtggccaacggcctgatcgccgtcaagaccggcgtggacccgcagaacgtggttttggccgaagacggcgatgtggtcgacctgtatcacggcaaggccgcggtcgtcggctccgtgccgtgtggttacgtgtacgtcgatggcgattccgtcggcgagctgaccgatgacgagctggaaaagcgccgcattctcggcaccgagggcttcgtctccgcgttcgtggtggtcgacaccgacaatcacgaggtcgtcaccggcccgaagatctacctgaatgccgtggccgaggacgaaagcgagttcgacaaggtgcgtcaccagatcgtcgaacagctcaacgaccagatgatgcagggcacgcgcgacacctacaagctgcagcagaccatgcgccgcacgctcggcagctgggttgcgcgccagctgcaccgcaagccgatgatcgtgcccgtcgtggccgacatcgcccaggacgtcgaaaccgtagaaaccaagtagtccggattatccagggacgaccgtaaggagtaattgaagtcatgcccggttctaatctcactcgtattgaagccgaagaacgtaaggccgttatcgaagcgccgattcactatcacgtcgaccttgacctgacggtcggcgcgaagaacttcggttccaagtcgttcatctgcttcaacgcgaagcctggttcgtcgaccttcctcgacctgatcgccgacgaagtgacctccatcgacctcaacggcaagtccctggacccggccgtggccttccaggacaaccgcatcgaactgaccgacctcaaggagaagaacgaggtcaccgtcgaagccaggtgccgttactccaacactggcgagggcctgcaccgctcggtcgacccgtccgatggcaacatctacctgtactcccagttcgaggtgccggacgctcgccgcgtctacgccgtgttcgaccagcctgacctgaaggccaccttcgatttcaaggtgctcgctcccgccagctggatcgtcacctccaacatgccggttgccaccatcgaggacgatccgcgcgaaaccctcgacggcaccctcggcgacaagccgaacgaaagcacccgtctgtgggacttcgagccgaccccggtgatgagctcctacctgaccgccatctgcgccggcccgtacgccgaatggcacaccgaatacctgaacgaagacggtcgcaccgtgccgatggcccagtactgccgacagtcgttggccaaggccttcgcgaaggacgtcgactacctgttcgacatcaccaagaagggcttcgcgttctacgccaagacctggggcgtgccctacccgtacgccaagttcgaccagatctacgtgcccgaatacaacgcgggcgccatggagaacatcggcatggtcaccatccgtgactcctacgtgttcgaatccaaggtgaccgacgcgctggccgagcgccgcgtggtgaccgtgctgcacgagcttgcgcacatgtggttcggcgactatgtgaccatgaagtggtggaacgacctgtggctcaacgagtccttcgctgaattcacctccacgctggccactgctgaagccaccgaatggcacgacgcctgggccaccttctgctccggtgagaagagctgggcgttgcgccaggatcagctgcccaccacgcacccgatcgtcgcgccgatcaacgacctcaacgacacttacgtcaactttgacggcatcacctacgccaagggcgcctccgtgctgaagcagctggcattctacgtgggccgcacgcagttcttcgaaggtatccacaactacctgaaccgtcacgcctactccaacgccaccctggccgacctgctgagcgaactggagaagacctccggccgcgatctcaaggcctggagcgccaagtggctggaggaatccggcatcaacacgatcgccactggcctgaccgtaaacgcggacggcaccatcgccgaactgaagctcacccagagctcgccggccgaacacccggtgctgcgcccgcatcgactggccgtcggcttctacaatgaagacgccgcaaccggcaagatcgtgcgcaccgagcagttcgaactcgatgtagatggcgaaaccaccatcgtcgaggccgcagccggcaagccgcgcccggcattcgtgctggtcaacgacgatgacctgacctacaccaagattcgtttcgacgccgaatcccaggcattcgccgaagccaacctgcatcgtttcgatgatgccctggcccgcgccgtgacctggctcgccttctgggatatgacccgtgacggcgaattcccggccgaacgcttcgtggacatgaccctgcgtcttctggccacggaaaccgaatccaccaccttccgttacgcgctggcctgcatgagcaccaccgcccaccactacgtggcgcccgcccgccgcgacgatgtgctgcgccacgtggccgccgaactgtggactctggccaacgccgccgaagccggctcggacacccagttccagctcgtcaccgcctacttgggctacggtgaggagggcgacgccgcattcgccgccaacgcacacggtctgctggacggcaccgtgcgtcttgaaggcctcgaaatcgacaacaacttcacgtggaccatcgtccaagcgctcacctccgtcaacgagatgaccaacgacgacgtggacgcgcagctcgccaagaaggagaccacggaaaaccgcgagttcgcctacggcgcccgtgcctccatggccaccgctgaggccaaggaatgggcttgggatcaggcgctccacaacgacgagctgaccaactcccagctcgaggccgtggcccgtggcttctccgccaccccgcgctccgatctggccgagccgttcgccgccaagtacttcgagactgtggactgggtctgggccaacaagacctaccacatggccgacgccctgctcaacggcctgtacccgggctacgccgatcccgccacgctggtcaagctcggtgacgcctggctggacgagcacattgccgccgacaatgccctgaagcgtctgatcgtcgaaaacgtggcatcctcccaccgcaccctcaaggttcgcgaatacaacgaagcgctctgatttccttctggctcccctcgggcgcgaggggagctgtcgcctcaggcgactgaggggagtcgcttccgcgagaagctacgtccacattccaacataaaacccgcaaccaatcctcaacagcgtattctcgctcaaggccggcaatatgccggtcgatgagcgacaaggatacggggaatgattgcgggcttttccataacttcattactgctgattctgttggccggaatcggcgcaggattcgtgggctatgcggtaggcgcatcgtcactggtctcatacccggccctgctcgcgttcggcattccgcctgtattggcaaacgcttctaacaccgttggcgtggtcggcacgggcatcggtggcgtgatgggtgcgcgcaaagaactcaaaggccaagcggtacgctccattacgtatgtggtcatcggcgcattcggcggggtggccggtgcgtttctgttgctcaaactcgacccgagtgtctttgaatttgccgcaccagtgctgattttgctgagctcgctgatcatcgccatcaatccgcgcggccgcatgcaggccaagcaagccgccgcggatgccaccgcgcaactcaagcacatcgaagccactgaagccactgaagccactgaagccactgaagccgccaagcgcgcaaccacccctaccgcacctcaccgcccgccggaacaactcgtgcagcccatgagtcaggattcctggtgggtatggctgggcgtagcggcggtcgccatctactccggctacttcggcgcgggcgccggtaccttggctctcgccgtgcttgatgccgccaaaatcggcccattccacaagatcaatgcattgaaaaccctgatcggcacaggcgcgaacatcagcgcctcagtggtattcatcatccaaggcgcggtcgattggccggccgccatcatgctgtgcatcggatgcttcatcggcgggtacatcgccccgtccatcacccgcaagattcccgcaaacatcatgcgcgccgccgccgtaatcgccggcatcattcttaccatcgatctggggctcaaaacctattgattcgtgccttacactgatgcagtgaagcatacagcatggccgtcaaccgcagcgtggtcgcagaccccgataaggtggccaatgtctggcatttggcgactgcggaacctgagcgcctagaaaccagcgcggcaggcgaagcggtgaacgacttcctcgatccgccagacacgtcgcagattcacggcattgcgtgtcatgctgattggcggttcgcggcgcgagcaggtgctgttcgccggcgttatgaaggagctactcgcgcccatcaacaatccgcgatatgtcatcatcggtaaggaatggggcgtgcgcgcttactgcgtgagcttcccctgcccgtccgtatttgcccgccgccagcaggacgccgagatactgagccggcagttggaccgctgcctgacgcattgcaccatggtatacgcccgcactgaggaaggtcggcatacgctacttcgcagccaaacgcgttctttcctcaaccgcgacgagcaactgccgcacatactgaccacaacatcggagtaatagatcgttgcattcatggccgagaccaccccggtagaggagatgccgttgggcatgttcatcgcatggctcagcgtgttcctcgccgtcgttctgtttggtgttgctttgccggttatcgatgtacgctgggtagttccgttcgtcgtatttgccgctgtattgtttacaggcgcgtttgccggcccgttcttactagtgcgatggcttcgttcccgtgccggagtgcatcggtccgcccggcatgcccgctaacgaatgtatctcatcattcatccgccgaacaagatgaatatgcgggtttgtgggtgatgccattgcggctgttgaatgctgatttccggttctggagcagattccgtggcggttttttgccgagtcgggtcctagggtggagcacaacgactacgatggtgcgggtaacgcgatacaaggagtggaacttcatatgccgaagatgtttggaaccgatggtgttcgaggactggccaatagggatttgaccgcacgtctggcgttggatttgggcgacgccgccgtgcgtgtgctcggtgacgccggtacgcaggacgaccagcccgagggccgccgccgtgcgctggtgggccgtgatacccgcgtttccggtgatttcctggcttccgcgctgtccgcaggcatgtctgccggcggcttcgacgtgatcgatgccggcatcatccccactcctggcgtggcctacctgacctccgtgctcaacgtcgaaatgggtgccgtgatctccgcctcccacaacccgatgcccgacaacggcatcaagttcttcgcacgcggcggcttcaagctgcccgaccagaaggaagacgacatcgaggccgtgctcggccaggactgggaccgcccgaccggtgccggcgtgggccgcgtgagccacgaccagaccaccgccaccaacctgtacatcgatcatctggtggccaccatcgctccgctgaacgatgacaaaacccagcccaagccgctcaagggcctgaagatcgtggccgactgcgccaacggcgccacttccgtggtggctcccgaagccctgcgccgtgctggtgcggatgtaatcgtgatcaacgcctcgccggacggctacaacatcaacaagaacgccggttccacccaccccgagcagctgcaggccatggtcaaggccaccgatgccgtgatgggcgtggccttcgacggcgacgccgaccgttgcctcgccgtggacgaagacggcaacatgatcaacggcgaccagatcatgggcattctggcccgtgccaagcagcgcgaaggcaagctcaaccacgacaccctcgtggtcaccgtgatgagcaacctcggtctgaagctcgccctgaaggacatgggcatcaagaccgtggaaaccgccgtgggcgatcgttacgtgcttgaggaaatgctcaagggcgattactcgcttggcggcgagcagtccggccacgtgatcaaccgcgaattcgccaccaccggcgacggcaccctgaccgcactgaccctgtgcaacgaggtcgtcaagtccggcaagagcctgaaggagctcgccgccgacttcccgcagctgccgcagaccctcatcaacgtgccgaacgtggacaagaaagccgccgccaccaacaagcgcatccaggatgccgtggcccgcgaggaggaactgctgggagacaccggccgtgtgctgctgcgcccctccggcaccgaaccgctcgtacgcgtgatggccgaagccgccacccaggcctacgccgacgaagtctgcacccgcctcgccaagatcgtcgccgaagaactcgcgctgtagcacccttccctaaggaaaagcaatgtttggaaagaacgccaaagtcaacctcgaactcaaccgtgatgtcgaacaactcatcaaaaccggcggcaaggagaagctcctgcccatcgtgcaggccggcgaaccggtgttgcgccaacggacggtggcctaccatggccagctttccaagcgtacgctcgccaaactcatcgatacgatgcacaccaccatgctggaggcgcccggcgtggggctcgccgccacccagatcggcttggggctcgcgctcgccgtggtcgaagaccacgtgcgcgacgacgaggatgatccgcgcgaaatcgcggaattccccttccacgtgatcatcaatccgagctacaaacccaccagcgacaaaaccgcctcgttctacgaaggctgcctgagcttcgacggataccaggccgtgcgcaagcgttggctcgacatcaccgccgaatgggatgatgaagacggcaagcaccacagcgagccgttgcacggctggcccgcacgcatcttccagcacgagaccgatcatttgagcggtgaactgtatatcgatcgcgccgaaatccgttcgctgaccaccaccgaaaacctcgaggattattggtgcgacgacccggtacccaccgaggccgccgaagaactcggcttcgcactatgatcgaccgcacatggctggacgccgccaagggagacattccccaatgggcggcgtccatgcccaaagacgccgacggcaccaccatcgactgggactgggtgcgttctctggacctggcgcatggcgtcggcacaataccggaatccaccccacagtccatccacgacgcattgaagatcgattacgccacacgcgagcatctggaatcaatcatcgcccaatgcaacagcacattcatgaccgattacgatcgattcatcggctcctatcgtctgcctcgcgcgctcgcctacgccaatcgtcggctcaacgacaacatcaacacgctgttgcgtctgggcgaacagcaacacctatgggtggtcagtcgcgaacggcgggggaggactaccgttgccgtgctcaggccgtactccggcagccgcccatcgaacgatgaccaaggcatgctgaatctgagcggtgaaaccggtgacgcatctgccggaaacactgctgccgaaaacagcgatgtcaagttccccacaacagtcgccttggacgatatccaagaccgtacggcggcgattcttgacgcacgcgccgaacgacgtaaggcccagcgcttccagaagcgtgcgggcgatgcggcgatggcccgcgccaatctctccggcgcgacttcgccgggtggtgccgcctcgtctggcaacgctaccggccaccatcccaagcccgactggcgcgacgcctatctgcccggccgcgacgtggacgcggtgatgggcatcgacatcgaaaccaccggcatcgatccggcgcgtgactacatcatcgacgtcggcttcgagttcatgaacatggccagtccgcgcccggccggcgaacctgagacatacgcctatgagcagggctattacgccgccggcgacgcctacggccagtcccgcctcgcttttggcgtgccgccggaaaacgcggcgctcggcaacgccctcatcgccaaactcaccggcatcgatgtacgcggccgcagcagcgaggccgggtaccgactcttcgacgaatggccccaagcccaggccggcctgctcgcgcggcttacccagcagccgtacgtggcgcataacgccaccttcgaacatagctggttcatgctgaacgtcgccggatacgcggaaagctaccgcgccgggcgcatcaccatcatcgataccctgccgatgagccggcagtgggaccccggcgcggtacccaccaacgagcatccttacggagacaacacgctcgacgcctacgccaaacgtcagggcgcgcttgattccgcccacaacgaacgccacttgggccttgaggattcgcacatcatgctggtggccatgaaacaccatctggcggcgctgaaagcgcaaaggaaagggccgtgggggcccgccggcagggctggcgtcggcggcaagtcctgcggtcgtaagcggtgagtacactattggtctcgtgagtaactatcaggacggccgacagcagcgtgagaaccgccgccgcaccatcgtgcgtgtggtgtgtgtcgtcatagctgtggccatgctcggctccctgatcatcccggcgatttacgcggggctttgacgttgccttcgcatattcgtgcccgcagttgaacacgtctgatgcgagggatttgtgaggtcgcccggccggctatcggcaaggcaggcccggaaccttctggcagcatggattgcaggcggatgcgtgtgtggcgcggcaatgcccgccaacgccagaggaatgtgcgaaggctgtcaacaaggacgtgacttcccaaagaatctcaaagaatcaacagtaaggtaaaccacgatggcagaatttgactttacccaggcgatcggcgaagcccgcgccaaatacgaatccatcgccaaggcgctggacgtcgaccgactcaaggccgatatcaaggatctcgaaacgcaggccgcggccccgggcctgtgggatgacccggaaaacgcccagaagatcaccagccggctgtccgccgcggaatcgcagctgaagcgtctgaactccgcctcccagcgcatcgacgatgtggaaacgctcgtcgaactcggccacgaggagggcgatcaggactctctggacgaggcgcaaagcgaaatcggcgagatccagaaggatctcgaccagatggagattcagaccctgcttgacggcgaatatgacgaacgttccgccgtggtgaccatccgctccggtgccggcggcgtcgacgcggccgacttcgcgcagatgctgctgcgcatgtacctgcgctactgcgagcgtaacggcttcaaggccaaggtcatggacacctcctacgccgaagaggcgggcatcaagtccgccaccttccaggtggacgccccctacgcttacggccgactgtccgtggaaggcggcacccaccgtctggtgcgcatctccccgttcgacaaccagggtcgccgccagaccagcttcgccgccgtggaagtggtgccgctggtcgaggccaccgatcacatcgacattccggatacggacatccgcgtggacacctactgctcctccggccccggcggtcagggcgtgaacaccacgtactcggccgtgcgcatcacccaccttcccaccggcatcgtggtgaccatgcaggatgagcgttcgcagattcagaaccgcgcctccgccatggccgtgctccagtcccgactgctcgtgctgcgccacgaggaggaggccaagaagaagaaggagctcgccggcgatatcaaggccagctggggcgatcagatgcgctcctacgtgctgcacccctaccagatggtcaaggatttgcgcaccggctacgaaaccagccagacccaggccgtgttcgacggcgacatcaacgcgttcatcgaggccggcatccgctggcgccacgaacagcgccgcgccgccgaaaccgaggagtaagcagcattatggcgctgatctcactggacaatgtgtccaagatctatcccaaaggcacccgaccggcgcttgacgacatcaacctcgatatcgaacgcggtgatttcgtgttccttgtgggtgcgtccggctccggcaagaccacgctcttgagcctgctgttgcgcgaggaagaggccaccaacggcgagattcgcgtggccggcaacgatctgcggcgcatcaccaaccgtcaagtgccgcagtaccgccgttcgctgggcttcgtgttccaggattacaagctgctcaataacaaaaccgtgtgggagaacgtggcgttcgcccttgaggtgatcggcacacggcggtccaccatcaaatcgttggtgcccaaggtgctggataccgtggggctcaccggcaaggaaaagaactacccgcatgagctctccggtggcgagcagcagcgtgtggccatcgcccgcgcctacgtgaaccacccgcagattctgctggccgacgagcccaccggcaacctcgacccgaccacttcgctgggcatcatggaagtgctggacgccatcaaccgcaccggcaccaccatcgtcatggccacgcataacgaagagatcgtcaactcgatgcgcaagcgcgtggtcgaactgcacaacggcaagatcgtgcgtgacgaggctcatggctcctatgattccgccctgttcttcccggatgccgaagtcgaagccaagtccgacgccgcccatcatgtgctggcggcggcgaccaaggccatcgagggcagtgacgagccgtccgaaggcatcgcccgtctggccaactccgtgcattccggccgcaccggccgctatggcgagacgttcgcgccgctggaagacacgctgacctggggcaagggcatcccgttggacgagcaggccgccgccctggaaagcacccaggcgttcgacccgttcaatgacgagtccggcgagaccgccgcggttgccgatacgtccgtgtcatccgccgccgagccgccggccccgccggaaccgcccgagccgccggccccgccggaaccgcccgtaccgcctgtcggcgagcagtccgccgcagaccaaacatccgacgatcaacccgctgagggcgcgaaggagtaagggggatcatatgcgagcacgattcattctgtccgaaacgtgggccaacctcacccgtaacctgtcgatgctgctgtcgctgacgctggtcaccttcatctcattcctgttcatcggcgcttcggtgcttactcaggcgcagatcaccaaagccaagggcgactggtacgacaaggtcgaggtcgtggtgtggctatgccccgacggcaccagccaatccgcgaactgcgcttccggcaaatcgccctcagccaatgagatcacggcactgcagaaaaccattcgcgacgaactcaacgacgtggtctccaacattgactacgtcagcaagcaggacttctacgacagcacattcaccaagcagtacccgaatggcgaattccaaggccgtacgctgaccgcggacgatatgcaggactctctctggctcaagctgaaggatccgaccaaatatcaggtggtctccgaagtgctctccggcaaggagggcgtggaagacgtcaccgaccagcgccagatcttcgacccggtgttcgccgtgctcaaccgagccacggcggttacggccgtgctcgccggcgtgatggtggtggtcgccatcctgctgaccggaaccaccattcgcatgtccgccgcgtccagacgaaccgaaaccgaaatcatgagatacgtgggtgcctcgaactggacgattcgtctgccgttcattctggagggcgccatcgcctcactgatcggctcggtgctctcgtgcctgatgctttcggccattgtgaacgtgttcatcaccggctggctggcgaaatccattacatggattccttatgtgaatcagctcacggtactggtgatatcgccgttcctggttgtgggcgcgatactgctgtccatcatcgcttcaaccatttcgttgcggcgttatttgagggcgtaacgcgaccggcttacccgcgagaaatgtgatgacatcgtgtgcaagcctctcaggttcgcatgttatggtattggcttaagtgagcgaaaggaccattcacatatgacgaatgtacgtgtgatcaagcccgcactggcggcattggtggccgccgcagcctgtgtgggaggtctggcgttcagctcgtcccaacctgcccaggcagacacctattccgacctgatcaatgcgcagaaccagcacgccgcgtcggtacagcgcgaggccgaactcaagcagcagttggccggtgtcaaccaggaactggcggataaggtacttgagctggatgatttgacgaacaacaagattgtcgccgcccagaacaaggtcacgcaggccaacgaggatgccgccaccgctcaggacgaggccgacgccgcatccgaacgtctttccgccgcacagaaagacaaggagacgctcgaggagcagatcaagcagaccggcaaggactacgatgacgcgcacgccgccgtggcccagctggcccgtgacgagatgcacggctcgaatgcttccgacgtgatgagcgtggtcacgggtgccaccagcacacaggacttcgtcaactccatgcagtcccgggacgcgttgtcccgcaacgaggcgaatgcggcttcctccgccgcgaactcgctgagcacgtcgaagaaccgtggcgaacgtctgtcggccatcgaaaagcagatcgctgtgctcaagacccaggccgatgagaaggccgcttccgcgcagaccgccgccgaaaccgcgcaaagcgaacgtgacgctttggacaagctacgtcaggaaggcgaagcaaggcgtaacgaactgtcttccatgatcgacagtctggattcccaatccgccaagcaggcggcccagaccgtactgatcgcttcccagatcgattcctacaatcgtcagtaccagaaggagcagcaggacgccgccaaccgggtggacaccggtaaccagggcggtacgccgaccactccggtgactcctactcccactcccacaccgacgccggcccccaccccgacggttcccggcggtggcggcagtagcagcggcggccaaggcacgtcgaacggtgattacggcaacgcctatgccaccggccagtgcacgtactgggcgtatgaacgccgtaagcagatgggcattggcacgccgtcctatctcggcaatggcggcgactggtggcgcaacgccccctcgtacggcttgcgcgtggaccacaaccctcaggtcggcgccgcgctctccttcctgcctggtcaggacggtgccgacggtacctatggccatgttgccgtagtcgaagccgtgtatggcgacggcacattccagatctccgaaatgaactggggtggtccgtggaacatgcaccaccgcaccttgaccaatttgggtcagtactggttcgtccactgaccggttggttcggccgatatatgcggttgaagggttcctcttgaagaggaaccctttttcgtattcgaggccggtccgtgatatcgtcggatgttgcgttgctacccacgagttgctacccacgagttgttgcccacgaaaggaggagacatgcccaaggaaaccggtgagaaactcatcgtccagaacaagaaggcccggcatgactatgccatcgaagacaagtacgaggcagggctggccctgaccggcaccgaggtcaagtcgttgcgcgaaggccgcgcatcgctgtccgaggcgttcatctccatcgaccgccgcggcgaaatgtggctggagggcgcgaacatccccgaatacctgaacggcacatggaacaaccatgcgcccaagcgcaagcgcaagttgctgctgcaccgactgcagatcaccaagctcgcccgcggcatcgaggccaagggatacacgattgtgccgctgagcctgtacttcaaggacggtcgcgtcaaggcggagatcgcgctggcccgaggcaagaaggaattcgacaagcgccaggccctgcgcgaagagcaggacaagcgcgaagccctacgcgccatgcgctacgccaacatgcgccactagtcccgccccttggctcccctccggaggggagccaagggtaggatgtccgcgttgtgggtcatttcgcccacgattaacgcttccgtagcattgcactcctacgctctggaaccatctgggaaacatacccgcccagctgactatccggagagaggaaatccaatgtctctaagcaagggaatacaatccgctgcggccgccgccctgagcgcggccatgctgatcgccgtggcggcctgtggcacgactgacggcatcgacaccgcatccaagagcggcgattcatccaaggactcgtccagcacttcgattcaaggcttcgacaccagcagcatccagaaggacgacgagatagccgcactgctgcctgattccgtcaccagcgacggcacgctgaccgtcggcgccgatacctcttacgctccggccgaattcctggccgaagacggcaagaccccggttggcttcgacgtcgacctgtccaaggccatcgccgccgtattcggcctgaaggaagaaaccatctcctctaccttcgactccatcattccgtccgtgggctccaagtacgaccttggcatctcctccttcaccgtgaccaaagagcgcatgcaggccgtcgacttcgtcacctacttcaaggccggctccacctacgtggtgcagaagggcaacccgaacaaggtcgactcctcgaacctgtgcggcgtgaaggtggccgtgcagaccggcaccacgcaggaagaggaagtcaacaaggccaacgagcagtgcaaggcggacggcaaggatgccatcgacatccagtcctccaagctgcagaccgatgtgaccaccgccgtggcttccggcaaggcctccatcttctacgccgattccacggtgtccgcctacgccatcaagcagaccggcgacaccttggagacgctcggtgaagacgccggcggggtgcccgaggccgtggccatcaagaagggcgataccaagaccgccgaagccgtgcagaaggccatccagaagctgatggacgacggcacctacaagaagatcctcgacacttggggtgttggttccggtgccatcgacaaggctgagatcaacccggccgacgccgcctgattgccaggtgtccctgttcgttcccgctggcgggagctgtcgccgaaggcgactgagggtggtctgtagcataacagccaccagcagttgtattcttatgcggcggcctcccagcgggagcatttgtatatgtatacgctataatgtatatttatacctgattgttgatagtcgctatagggcggctccacagagaagaagagagagatcatgcagttcaacaagctgaagaccattgcggccgccgccttgagcgtggccatgctgttctccgccgcggcttgcggcacctccgacaaggcgggtgactccggttccgataagggcggttcctccaagtcggtcaccatcaccagctacgacgtgagctccgtgaagaaggacgatgcaatcgccgcactgctgcctgaatccgtgaccaaggacggcaagctcaccatcggcaccaacccctcctacgccccggccgaattcctcgacgccgacggcaagacccagatcggctacgacatggatcttgcccgcgccatgggcaacatcttcggtctcgataccgaaatcgtctcctccaacttcgatacgatcattccggccatcggctccaggtacgatctgggcatcgccgccttcaccatcaccaaggagcgcatggaatccgtcgacttcgtctcctacttcaccgcaggcatgggctatgcagtggccgcaggcaaccccaagaacgtcgatgagaacgacctgtgcggtctgaacgttgccgtcgagaccggcaccgtcgaggaagaggccatcaacaagaccgccaagcagtgcaaggcggacggcaagaaagacatcaccatccagtcctccaagcagcagaccgacgccaccaccgctgtggtgaccggcaaggccgacgtcttcttcgccgattccccggttgtcggctacgccattgcccagaccgatggtcagctggaacagctcggcaaggacttcgatgaagtgccgaacgccatcgccatcaaaaagggcgattcccagaccaccgaagccgtgcagaaggccatgcaaaagcttatggacgacggcacctacaccaagatcctccagcactggggcgtcgaatccggcgcactggacaaggccgaaatcaacccggccgtcgaatagccgacaagctgtcgcgaaaattcgaatggggcgcactgtttgtaacacagtcgccccattcgtacactaaggttcaacgctagttgcaacttgcagttcaggctgcccaacacgtccaaggaaccaaattatggcgaagaaagaagtcgacggtgagggagtgaacatccccaaccgcatcaaggcgctgccggtcaagcgccccggcccgattgtggccgcagtgatcgtggtgctgctcgccgcgatgctcattcaaggcttgattaccaatccgcgactggattggcccaccgtctggaagtacctgttcaacgagaacgtgcttgaaggcattcgctataccttggagctcaccgtgatctccatggtcgtggcgatcatcctgtcggtgattctcgccatcatgcgcaaatccatcaatccggtgctgcgcggcgtcagctggttcttcatctggttcttccgcggcacgcctgtgtacacgcagctcattttctggggtctgttcgccgtgctgattcccaagattagcctcggcattccgttcacctcggtggagttctggagcatcgactccaacgtggtggtcaccgcattcaacgccgcatggattggtttggctctgaacgaggccgcctacctgtccgaaatcgtgcgtgccggccttgaagccgtggaccccggccagaccgaggcggccaaggcattgggcatgaaccgcacgctcatcatgcgccgcatcgtgctgccgcaggctatgcgcatcatcatcccgcccaccggcaacgagaccatcggcatgctgaagaccacctcgctggtcaccgccgtgccgttcaccctcgaactgcagttcgccaccaacgccatcgccaaccgtatctacaagccgattccgctgcttctcgtggcctgcttctggtacctgctgatcacctccattctgatggttgtgcagtcccgccttgaggcgcacttcggcaagggcttcaacgcccgcccggtgggcaccaagggcaagcagccgccatacgatccgccgtaccccggcaagtctgacggcgagccgaaggacgatgtgaacaaaatcaatcagaccaccttcgctgggctgaatgcgtaaggcgggagcgagaattatgactacgaacgacatcaccaactccgctccggtcgtgcgcaaggcggttgacggttccgtgattcctgctgtcaaggccgtgcaggtgcacaaggcgtttgggccgctgcatgtgctcaagggcatcgatctaaccgttatgcccggcactgtgaccgtgattctggggccctccggttccggcaagtccacgttcctgcgtctgatcaaccagctggaaaccctgaccggcggttccatcgaggtggacggcgaactcatcggctacaagcacgtgaccaaaaacggccaggacatgctgcagaccctggacgataaggagatcgccgcacagcgttctcgcctcggcatggtgttccagcgcttcaacctgttcccgcacatgaccgcgctggaaaacgtgatggaagccccgattcacgtgcagcaccagtccaagaaagccgcccgtgacctggccgtggccgagcttcagcgcgtcggtctgggcgatcgcatggactattacccctcccagctgtcaggtggtcagcagcagcgtgtggccattgcccgtgctctggccatgaagccggagatcatgcttttcgatgagccgacctccgcccttgaccccgaactggtgggtgaagtgctcaacgtcatgcgttccttggccaaggaaggcatgaccatggtgtgcgtgacccacgaaatcggcttcgcccgcgaagtcgccgaccagatcgtgttcatggacggcggcgtagtcgtagaaaagggcggccccgacatcatcgaccaccccaccgagcctaggtttaaggacttcttgcagcacgtgctgtaggaaggctcgttgttgcagctccaaaaacgtacgctgatgaactcagcgtacgtttttttgcgacgcctaatcgcacccccatctcgtgaagaacgtacgctgagtggtagtcagtgtacggttttcacgaaggggcatgttccaatcctgcaaaggcggcgggttggattcgctttgcgcaataatcgtccgctaggctggtgaaccatgtgtggaatcgttggatacgcgggaaatattgaaacggcatgcggcaagcctttggaggtctgcctgcaaggcctggaacgtctggaataccgaggctatgactcggccggtgtggcgctgaccgcgcccggcatggataaggtggtcgtgcgcaagaaggccggccgtttgaagaacctggtcgaagacatcgagcgtaagccgatgccgcttgccacggtgggcatcggccacacgcgctgggccaccaatggcgagccgagcgacgtgaacgcccacccgcacaccagcatggacggcaaggtggccatcatccataacggcatcatcgaaaacgcctctcagctgcgtctcgacctgcaagccgaaggctaccgattcgcctctgccaccgacactgaggtggccgctaagctgctcggcaagatcgtggacaagattatcgcggacgaaggcaagccagacctgttcaaggctgtgcgccgcatggcccgcatgcttgaaggcgcgttcaccattctggccaccgactgccgccagccggacatcgtggtcggagcccgccatgattcgccgctggtcgtgggccttggcgagggggagaacttcctcggttccgacgtcgccgcattcgtggcctacaccaagcgcgccatggaagtcgaccaggatcaggccgtatgcgtgtccgccgacaaggtcatcgtcaccgatttcgacggcaacgtggtcgaaaacccgaagacctacaccgtggattgggatgcttcggccgccgaaaagggcggctgggattcctttatggacaaggagatccacgaagaccctgccgcagtgcagcgcaccctgcttggccgcttcgatgcgaatggcggcatcacccttgatgaagtgcgtatcgacgaacacgacttcaaggccatcgacaaaatcatcgtcgtggcctgcggcaccgccagctacgccggccaggtagccaagtacgccatcgaacactgggtgcgtatccccgtggaaatcgaactcgcgcacgaattccgttaccgtgacccgattctgaccccgcgtacgctcgtggtggccatttctcagtccggcgaaaccatggatactctgatggccctgcgccacgcgcgcgaacaggggtccaaggtgctggccatctgcaacacgcagggtgcctccattccgcgcgaatccgacgccgtgctctacacacacgccggcccggaagttgccgtggcatccaccaaggcgtttgtggcgcagatcaccgccgcctacctgctgggcctgtatctggcgcaggtcaagggcgcgatgttccgcgatgagattcatcaggtgcttgactccctgaaagacatgccgcgcaagattcagtgggtgctcgacacccagcccaagaccatccaggcggccgccgagcgcatggtgaacgccaactccttcttgttcctcggccgtcacgtgggctacccggtggcgcttgagggtgcactgaagctcaaggagatcgcctacacgttcaccgagggcttcgcggccggcgagctcaagcatggaccgatcgcgctggtggacgagggtgagcccgtggtgttcatcgtgccgccgcagcgcggccgcaatgtgttgcacgccaaggtgatctctggtatcgaggaggtcaaggctcgtggcgcgtacatcatcgccgtggccgagcagggcgacccggatgtggaacggtacgctgacgtggtgttctggcgccccgcctgcccaacgctgatgagcccgctggttgacgtggtgccgctgcagctgttcgccatggacatggcaaagctcaagggctacgacgtggacaagccccgcaacctcgccaagtccgtgaccgttgagtaagccacatcggtatgtgattgacgagcctcatattccgtttgagatggacgtgctgtatgaggacgagcggatcatcgtggtggacaagccgcattttctggccaccatgccgcgcggcatgtggtatcggcagaccgcgctgatccgattgcgtgagcggctgggggagccggacatcacgccagcgcaccgattggaccgcatgaccgccggcgtattggtgttcgtgcgggatccggcctgccgcggcgcgtatcagatgctgttccagaaccggcagaccgtcaaggtctatgaatgcctggcgccctgccggccgatcagccgcccgcgattcggcacgatcatgcaggtcgagccgccacgcccgttcccattgctgcgccgatcgcacatcaccaaggaacacggcacgatggccgcattcgaggaaccgggtttggccaacgccgaaaccctcatcgagcgcggcgacctctgtttccctcccgctgacgggaggtggcgcgaagcgccggagggtggtccccatccggggaatcaccccatctgccgctacacactccacccgcgcaccggcaaaacccaccaattgcgcgtccacatgaattcgctcggcctgcccatcgtgggcgacgacttctacccgcgcatccagacgcgcccctacgacgatttcagccaaccattgcagttggtagcacgcatgctgcgattcaccgatccaataacaggcgagaagcgcgaattcgtttcccgtgtgccgcttaagatctgatttcttatgcattgagagtgttttcgctcatggtgtcaccattcatagagttcggcgggctgcggggttttgcggacatccagcgacaagccaagctcagtcagggcgctgagaatggtggagaattcgggattggggactcgggcgtgttcaaattcgatcagccagcgacgtgacacgcccagccgttgggccatgtcggtctgactaatgccctggcgttgcctatgaatcactggcaggtggatcactggcaggtaccagtggatgccagcgcatgccgctcgtcagctgatgtcgagcacggaaccgcgttcaatcagttccggcgggattacggttttgacgccgaccggtatcttctcgccttcgcattgacggcggaccatggagaaggcggtggcgccaatgtcgtcaaagcgcagcttcatggtcgtcaggttcaagcgcgggaccatatcgaccagcgaatcatcgacgcccacgatgctgacatcctcgggcacacgcttgcccactgactgcaacccgagcattgcgccgtacgccatctggtcgttggcggcgtagatggccgtgcagtcggggtcgtgggccaacgccacgccggcctggtagcctgaatccgcgcaccaatcgccgatatacatgctcggtacgcgtgctcccatttgttccaacgcttctcgccaaccgcgggcgcggctttcggcggcacgcgaggtggacggtccggcaatgtggtagacggtcttgtgtcccttgctcatcaggtaatcgacgatagcggtcgagcagccatactggtcggcgtcaacagtggggcagtggtcggcggcggattcgcagatgagcacgactggaagttctcgcggaggcttgtatccgacgaaatcggagatgcgttcctccagcactacgatgacaccatccaccggctgacgctgcatgtgatcgatggcggcggaaagcgtgcgttccgcaccgtgacgcatggtctggatggtgactgaataatcgtcatcggccgcgttggccacaatagaatcaaggatgcgggcgttgccgaacgtggcggtgttgaacatcaccacgccgatatcctggaagcggccgtgctttagggctcgggccgcataattcggacgatatccaaggcgctccattgcagcttcgacacgctggcgtgtttcgggtttcaccgcatcgctgccattcgccacgcgggacactgtctgtggcgaaacgtcggcggctttcgctacgtcttgcatggacacctgtgttggcctcgacatttcaccctcgcttgactcattaatgtcggtgtttcgtttgcagcgcttatcttaggccgcttacgttaacgataacatcgttgttttcgtgaccattgtagcagagtgactgaggaacccttaattcaacacggtactcaacacgattggacaatgttacagatagtgttatgatgataacgcaaacattttggtcaaccttcgaaggagaggggttggaaatggcttcagccgatatcgcagctgcgcccgtgcattcgggcaaggctcgtgtgaataagcacaaggccgattggcgtggatggaagttcatgtggccttttgcggtggtgttcgtgttcgtgttcatcgtgccgatcgtgtatgccgtctatatttcgttcttcaagaagcagatgatcggcggcaccaagttcgtgggcttcgagaactacgtgcgcctgttgggcgatggccagttctggagcagtgttggtcgtgtggctttgttcacgtgcgtgcaggtgccgatcatgctgtgcctgtcggctttgatggcgttggcgctggattcgatgaagttgcatggcacgaagttcttccgcatctccaccttcctgccctacgcggtgccagctgtggtgtcgactttgatctggggtttcgtgtacggcgcgaagtacggcctggtgggttcgttgaacgatttcctgggcacggacatcgacgtgctcgccccttccgtgttgttggccagcatcgggaacatcgtgacgtgggagttcacgggctacaacatgctcatcttctacagctcgctgtcgaccatcccgcattccctgtatgaggcggcgagcatcgacggcgcgtcggagtggcagatcgtgaagagcatcaagcttcccgaattgcgcggcagcctggctatcacggtgatcttcagcatcatcggctcgttccagttgttcaacgagccgagcattttgcagaacatggttcctggtaatgcgatcacgacgtattacacgccgaacatgtacgcgtacaacctgagcttcagcggcaaccagtcgaattatgcggccgcgttggcgatcgtgatggccgtgatcaccatggccatcgcctacatcgtccagttgaacagcctgaaggagcagatgaagtgacgatgaccgctgttcgtgttgaggaatcgatgatgatcgtgaaggagcgtatgtgatgagtgcagcaacgacttcggccgccggtcgcctgaccgacgccgagctcaaggcccaggagaaggccgccaggaaggcggagaaggcccgccagaagaggatcgccgccgacgaggccgccgaacgcaagcgcagcgcgaaggccgggttcgcgaacgtgaacaacccgaggcgttccacgttgttgaccgtcctgtgcgcggtcttcgccgtgtactgcctgttcccgttcgtgtacctgctgatcaacgcgacgaagacacaggccgacttcacgagcacgttcggcctggggttcggcaagacgttcgctttgttcgacaacatcgcgaccgtgttctcctatcaggacgggatcttcgcgcgctggctgttcaacacgatcctgtacgtggtggtcggcgccggcggcgcgaccctcctggcgatcatgggcggctacgctctggccaagttccgcttcccgggccgcaacgcggtgttcgtggtcatcatcggcgcgatcagcgtgccgggcatcgctttggcggtcccccagttcctcctgttcgccaaattgggtttgacgaacaccccgtgggccatgattataccgagtttgatcagcccgttcggcctgtacctgatgtggatcttcagcgagcaggccgtgccccaggagctgctggaggccgcccgcgtggacggtgcctccgagttccgcacgttctggcagatcagcctcccgttgttggctccgggcatcgtgacgacggccctgttcacgatcgtggcgacgtggaacaactacttcctgccgttgatcatgctcaaggacgcggactggtacccgctgaccatcggcctgaaccagtggaaggaccaggcgagcacggccggcggccaggcgatccagaacctggtgatcacgggctccctgatcacgatcatccccttggtcatcgcgttcttgtgcctgcagaagtactggcagtccggcctggccgcaggcgccgtcaaggagtgagcgtactttggctcccttctggtggagggagccgagataaaggcataaccactaacagaaggaggcacctatgcagatattcgcattgttgagaattgtgcaggtgcctccttgtgtgtctgtgcaacgtgaggaatttattcccgtagacgcagattatcgataaaattcaataaaggaactgaatcatcatggaacgtaaagagttcaagtggccgcagcctcttgcgggcaacgagccccgcatctggtacggcggcgactacaaccccgaccagtggccggaggaagtctgggacgaagacatcgagcttatgcagcaggccggcgtcaacctcgtctccgtagccatcttctcctgggccaagcttgagcccgaagaaggcgtgtacgacttcgattggctcgatcgcgtcatcgacaagctcggcaaggccggcatcgccgtcgatctcgcctccggcaccgcatccccgccgatgtggatgacccaggcccacccggagatcctctgggtcgactaccgcggcgacgtctgccagcccggtgcccgccagcactggcgcgccaccagcccggtcttccttgactacgcgctcaacctgtgccgcaagatggccgagcactacaaggacaacccctatgtggtctcttggcatgtgagcaacgagtacggctgccacaaccgcttcgactattccgaagacgccgagcgcgccttccagaagtggtgcgagaagaagtacggcaccatcgacgctgtcaacgacgcctggggcaccgccttctgggcgcagcgcatgaacaatttctccgagatcatcccgccgcgcttcatcggcgatggcaacttcatgaatccgggcaaactgcttgactggaagcgcttcagctccgacgccctgctcgacttttacaaggccgagcgcgacgccctgctcgagatcgcccccaagccgcagaccaccaacttcatggtctccgccggcggtgccggcatcgattacgacaagtggggttacgacgtggacttcgtgtccaacgatcactacttcacgcctggcgaagctcacttcgacgagctggcttactcggcctccctatgtgacggcatcgcccgcaagaatccgtggttcctcatggagcactccagctccgccgtcaattggcgcccgatcaactatcgcgtcgagcccggcgaattggtgcgcgactccctggcccacttggccatgggctccgacgccatctgctacttccagtggcgccagtccaaggccggtgccgagaagtggcactcttcgatggttcctcacgcgggccccgactcccagatcttccgcgatgtgtgcgagctgggtgccgacctcaacaagcttgctgacgagggcctgctgagcaccaagctggtcaagtccaaggtcgccgtcgtcttcgattacgagtcccagtgggctacggaacacaccgccacgcctactcaggaggtacgccattggaccgagccgctcgcgtggttccgcgcgctggcggacaacggtctgaccgcagacgtggtgccggttcgcggcccttgggacgagtacgaagccgtcgtgctgccgagcctgaccatcctgtccgaagagaccacgcgccgcgtgcgcgagtatgtggcgaacggcggcaagctgttcgtgacctactacaccggtctggtggacgacaaggatcacgtctggctgggtggctaccccggttccatccgtgacgtggtgggtgtgcgcgttgaggaattcgccccgatgggcaacgacttccccggtgccatggaccaccttgacttggacaacggaaccgtggcgcacgatttcgccgacgtgatcacctccgtggccgataccgctcacgtggtcgcctccttcaaggcagataagtggaccggtttcgacggcgctcccgccatcaccgtcaacgacttcggcgacggcaaggccgcatacgtcggtgcccgtctcggccgtgagggtttggccaagagcctgcccgtgctgctggaggaactcggcatcgagacttcggctgaggacgatcgcggtgaagtgctgcgcgtcgagcgtgcggacgaaactggcgagaaccacttcgtgttcctgttcaaccgcacccacgatgttgcggtcgtggacgtggaaggcgaaccgctggtcgcctcgctggcccaggtcaacgagtccgagcacacggccgccatccagcccaacggcgtacttgtcgtcaagctgtaaaaccgcgcatagcgcctaattacccaacggctcccttgctgctcatcgtagcaggggagtcgttttcgtatctccagcaaagtcgggtagggtggtcaccgtgcgaggcaaaaacagagtgacgatggcggacgtggcccatgaggccggtgtttcggtagcctcggtgtctaattttctgaacaaacagccatatatgagcgaggcgatggccgcgcgtattgcggaagccatcgacaggctcggatacaaagtcaactcgtcggccagaaacctgcgttccgggcgtacccggttgctcaagctggttattcccgatctgcggcaggtgtacttctccgaactcgccgaggatattctggccgaggcccggcaacatggctacggcgtcatcgtggaatccaccactaacaatcgtgcccgcgagctggaaagcatcgcatcgatgggcacgcacagcgcggacgggctcatcttaagccctctgatgatgacggttgacgatatcgcggctttggatggcgattacccgcttgtactgttgggtgaacgtttgttcggcgtcaacgcgccgcacgtagtgattcgcaatcgcgaaggggccgccgccgcgacttatcacctgcttgatgccggttgccgccgcatcgccgtagtcggtgccgtgccccaccccgagcacgatttctcgtcgggctccatccgcacccacggatatcgtgaggcgctggccgcgcgcggcatcccctgtgatgacagtctgcttatcgaaacccaaggctgggggagcgccgacggtttggtcgcggtggacaccatgctggagagtggcctgcaattcgatgccgtgttcgctttgaatgacttgctggcgtggggcgtgctgcgtgaactgcgcgaacgcggcgttgccgtgccggatgatgttcgcgttatcggcttcgatgacgtggaggaatcggcctacatggtgccgtctctttccaccgttaaccccggcagggaagccatcgcccgactggccgtcgaatccatcatccaacaggtcgaatccggcagccgtgcccccgcccaaaccatcgaggccccctatagcctctccctgcgcgagtcctcaccggcgttggcgcgcgcctgatgaatccgtggttcgaaatatccgaagtgaatgacaaggcccgtcaatcgtatggtgattgacgggccctggtcgtattggacttgactgtacttggtacgggcgtgactctccgtcttttagccgtggaattccacgctgatccaggagatggcgggaagcgttgccgtgcaggtgccggtggcgttcattgcaatgtcgagcggttgcggcgtgacggcttcgggcgcttcggcggtgttggtgcggtacggatcgtcctcatgcaacagttgcgccttgctgagcgcgagcgtgccgagaccgggcaggccgggcagcccggaaaggtcgatggtgagcgtgtgcggggtgttggcgtcgcggttgacggcaagcagcagaccggtgcgggcctgttcatcccacgtgactaccgcgtcgatggccggcacgtcgtcatatgcctcggtatggatggtgggggagctgatggccggagcgtaggcctggccgcgcgcgtgaagggcggcttcggcgaacgggtagaacgtggtctgccgccatgccgggccgtgttcctcggccatgatgggggcgatgacgttgaccagctgggcgcgcgaggcggaacgcacgcgatcgcagtgcttgagcagggtgatcatcagggaaccttcgaccaccgcgtcggccgcggtgtagatgtcttccagcaaatgcggagacttaggccatggctcgtggtgcaaaccctgcgcggcctccgccttccactggtcttcctgctcgttccacttgtccgaataccatacgccccattcgtcgaaggacagggcgatgtctttggtgccgttgttggcttctcgcgcctgatcggccgcgtccgagacggtggcgatgaacttggtcatgtcttcggaagaggccaggaagtcctgcatggaggcggcggtccgggttttatggccgcggtcgaagtagtaggcatggcaggagacgaagtcgagattctcgtaagccttggtgagcacggtcttctcccacgtgccgaaggtcggcatataggcacccgaggaaccgcaggccacgagttcgagaccggactcggcgagcttcatggcgtgggccaccttatccaccgcgccggcatattcttccgggctcatgtggcccacctgccacgggccgtccatttcgttgccgatgcaccacatcttgatatccatcggctcctcgatgccgttggccacgcgctgatccgcccaagcggtgccgggcgcgccgttgacatactcgagctcgtcgagcgcggctttcagcccccgggtgcccatgttgacggcaagcatgatttcggtgccggctttctggctccagcggtagaagtcgtcgatgcccatctcgttggtttcggtgcaatgccaggccaggtcgcggcgcacggggcgattctcgcgtggaccgatgccgtcttcccagttgtagttggatacgaaattgccgccggggtagcgcacgcaggtgacgcccagctccttgaccaggtcaagcacgtcttggcggaagccgttttcgtcggcggtgggatggctgggctcgtagatgccgccgtagacgcagcggcccagatgttctacgaatgagccgaacagacgcgggggaacgtcggctaccggagtggcgtcggcgttgagggcgatgctggcgtccggcgtagttgcgttgccggttgtggagacgttactggccgtggtgccggcggcggtcggcgccgggctgctttcctgcttgtcgggatgggtggtttcggcggaatactggctgttgtgagtggtcatgagcgggatgcatctccttcggtttgcggttaatcaccatggtgcgacgtgtcgtgtttgcgtaaacataaaacatgtggtactgtttcttaaaacgatacaatacttggaacaaaacgccaagtcccgtcgtttcccataacaaggaaggaaagaacgatgaagttcggcaagaagacaattgccctgatcggtgctgtggccatgctctcctctgtagctgcctgcggttccacctctgccggggatagcggaagcaccggatcctctgataagaagatcgagctgaccgtgtggtcctgggattccacactgcctcgtacggtcaagggattcgaggccaagaacccgaacattaaggtgaaggtgaccaatgccggcaccaacaaggacgagtacaacgcactgtccaacgccatcgaggccggctccggtgctccggacatcgcccagatcgaatactacgcactgcccgaatacgtgattcgcggccacctcgagaacctttccgatctcggtgcctccgatttcaaggacttctacaccccgggcacgtggtcctcggtgaacatcaatgacggcgtctacgccctgccgatggattccggcccgatggcctggttctacaacaagggcgtcttcgacaaggccggcgtcgatccgacccaggtgcgcacgtgggacgacttctacgaggccgccaagaagattcgcgccgtggactcctacatcacctccgattccggtgacgccggcttcttcgactccatgacctggctggccggcgcgaccccgttcgagacctccaaggacggcgggaccgtgaccatcaacctgaccggtgacaagaacgtcaagaccttcaccgacttctggcagaagatgatcgacgaagatctcatcgacaccaagaccgtcggctggaccgacgattggaacaagggtctggatgacggctccatcgcatccctgctgaccggcgcttggatgccgtacaacctgctttccggcgctccgaacggtgacggcaagtggcgcatcgcccagatgccgaccgcagacggctccgagaccaactccgagaacggtggttcctcgctggccatcgtgaagtccgacgacaaggacaaggtcgccgccgcctacaagttcatggaatacgcctgccacgacgccgagggcatcaagacccgtgttgacggcggcgccttcccggccgacaacgacaccctcaagtccgacgacttcctcaacatgacctccctgaccgactccgacggcaaggcccacgagtacttcggcgggcagaagttcaacgaggagctggccaaggccgcagccaatgtgtccaccggctacaagttcctgcccttcgaggtctacgctcgcggcaagttcggcgactacgccggcgatgcctacaccggcaagaccacgctctccgatgccgtggcttcctggcagaaggacctgcaggattacgccaagcagcagggctaccaggtgaagtaacggcaatcacagcagacttcctcctgtggtttctgtagcgggaggttgcgataacaggatcgggcactcttcggagcgcccgattttcttatgccatgggagcagtggcgcgcggattgcgataccaagatggcgtgttgccgaagaatgtgtataataaaagatgttatcgcaaccatagctacaaagtggcgaaacaaagccgttttgtgactactgaaccatagagtgatggttcacgatagcatgacgacgaggagagttgccatgctgttgtggtgacaatcactgcagaccgccgaaaggcgatccaaggaaggagaacagaacgatgaagttcaccgttgctaagaaggccattgcacttaccggtgcggttgccatgctgggttccgttgccgcctgcggttccgacaccgccagtggcaagccggctcaagataaggacgttaccgaaatcaccgtgtgggcttgggagcccacgctgacccaggttgccaaggacttcaccaagaagaccggcatcaaggtcgatctcaagaacgtcggcaccaacaccaaggaatacacccagcttgataacgccatcgaggctggctccggtgctccggacgtcgctcaggttgagtactacgccatcccgcagtacgccatcaagggcaacctgctggacatcaccgacaagacctccggctactccgacttctacacccctggcccgtgggcttccgtgcagttcgccggcaaggtctacggcctgccgatggattccggcccaatggccttcttctacaacaaggaggtcttcgacaaggccggtgttgacgccgagcagatcaagacctgggatcagtactacgacgccgccaagaagattcacgctctgggcgacaactactacatcacctccgacaccggtgacgccggcttcttcgactccatgacctggctggccggtgcaaagccgttccagacctcttccgatggttccgaagtcaccgtcaacctgaccgaggacaagggcgtcaagaccttcaccgacttctggcagaagctgctggacgagggcctgctcgacaccaagaccgctggctggtctgaggactggttcaagggcatggtcgacggcaccatcgcctccctgttcactggcgcttggatgcctgccaacctggccaactccgctgctgacggcgctggcaagtggcgtgtgacccagatgccgaccgctgacggctccaccaccaactccgagaacggtggttcttcgctggctgtgctcgcctccaccaagaaggctgacgctgcttaccagttcatcgagtacgccaaccacggcgacggcgtggccacccgtgtggccggcggtgcattcccggctgacaaggcctccatggagtccgactccttcaagaacaccaccactgtgaagaacgccgatggcgaggacgttgactacttcggtggtcagaagtacaacgaggttctggctcaggctgctgagaacgtgtcctccgactaccagttcctgccctacgaggtcaaggcccgcaccatcttcggcgactactttggcaagtcctacaccggcgaccagaagctgactgacggtatcgccgcttggcagaaggcactgcaggattacggcaaggatcagggcttcaccgtgaagtaagccttgaaccctcgctgagactgcctagctaatctcacctgatacacaaagccccgtgacgaatcccgtcacggggcttttaccgttttaagccccgcctagtacactcgtcaccatgcgagtgatcggacagcgaatcaaaagaatggcaaccatagcagtgactgccatcctttccgtatccttggcctcgtgcgggcagtccaccaccgataaccgcacggaaatcagcgtatggagctgggaaccgagcatgggcgaggtcatccgccgtttcgaaaaagccaatccggacatccgcgtgaaatggaccaacatctccggctatggcaatctcaacaccgccattcaggacggttacggcacgccggacgtggctcaaatcgaatactatgcactgttgcagtacgcggtctccggccaattgcttgatctgaccgacaaaatcggctcggattattccaacttctttaccctcggcacatggtcgtccgtgcagctcgccggccgtacctacgggctgcccatggattcgggcccgatgggcttcttctacaacgaagacgtgttccgccaagccggcgtggacgccaccaagatcaagacttgggatgactactatgaggctgccaaaaagctcaaggagattggcgtgtacatcgccgccgactcgggcgatggcagcttttacgatgccatggtctggctcgccggcggccagccgttccacacgtcggccgacggcaaaaccgtgaccatcgatttggatgaggacgccggcacccaacggttcaccgaattctggcagaaaatgatcgatgaggggcttgttgacaccacctccgccacatggtccgaccgatggaagcgccgtgtgggcaccggtaccatcgcctccgtgttctctggggcctggatgccgtcgctgctgctgtccaatgtgccgggcgcggccggtctgtggcgcgtggctcccatgcccacctatgatggccagcccaccaacgccgaaagcggcgggtcggcactgaccgtactgcaattgacccgtaagccggatgcggcctatcgtttcgtggactttgtggcgcatgacgcccaaggcattagcgcgcgtgtagacggcggtgcctttccggccgattacgccaccctgaattccgctgattttctggataaaaccacgattaccaatgaccgtggcattgaaatcccgtatttcggcgggcagaagttcaaccgggtactgtcggaggccgccgaggatgtgtcggtcggataccagtatctgccattcgaagtgtatgcgcgcagtgacttcaaatcgacggtgggccaggcatacgagtggtccggcagtttccacgcctatcagcagcgacaggaagccattgagatgggcatgaaggacgaggaaggcaacccgctcgaaccgttggagaagcccggcaagaaagtcagtctctccgacggcctggcccaatggcagaaagacctccgagaatacggcttcaatcagggctttacgattaagtagggattcggggttgggtcggaatcgaccgcgctatacgcggccgattcctgcatactacgtcacttcacattgcgcgagtagatgtgcgccatgcccttgaaaatcaaatccgggtcatacacgtcaatcagctcggtgtcattctcaaacactcgaccgaggccaccggtggtgatcaccttgaaatcctcgcctccgagctctctgcggaactgacgaatcgtgcgctccacaccgcccaagaacgtgtaatacaaaccggcctgcatgcaggtcttggtgttggtgcccagaatcgtatccggtcgcgtaatttccacttccggcagctgggccgtatctccccacagagcggccgcaccggcacggatgccggtggtgatgacgccggaatcgaccacgcccttgtcgctcacgtgcgtgaacgtggtggcggtgccgaaatcagccaccagcactgggccgccatactcgtaataggcaccggcgcagtcggccagaatatccgcacccagcgatttcggatcgtcaacgcgcacgttcataccggtcttgatgcccggtcccaccaccatcggatcaatgtcgaggaatttgacgatggacgaacggaaggagtgcatcactttcggcaccaccgaacagatgatcacatcgtccacatcggatggctgaaaaccgctcattctcaggaattcagtcagaaacagcccatactcatcagacgtatggttggctttggtggtgatgcggtaggtgccggcgatggcatcgccatccaaaaagcccagcacgatgttcgtattgccgatatcaacggcgaccagcatgataaccctccagattcaagatggatttcatgcgcaattctacagtcccatggctatgatggcctgcggtggtcgacccagcgtggcggccaaccgtagaacacaacatatacagaggaagaaccatgtctcaagacaatggtgcgcacgtcgaagacggcgcaaccacagatgcgagccttgcctcgcgcgcaaagaatccgaaaaaaagcggcccgaagtggtggctgatctcactgattgccgtcatcgtggcagtggcggtcgtcatcggcgtcacgctcgctttcggcggtaagaaagatgacaagtcggcttcgtccagcaaccaatatgccgacaccgtgaccatcggcctcaaactggcccccaccaatctggacatccgcaacaccgccggctccgcgcttgaccagatcctgatcggcaacgtatacgaaggcatcgtggcacgtgactccaagaaccaggtcgctcccgccatcgcctccagctgggagacgtccaaggacggcctgacctacaccttccacctcaataagaacatgaccttcttcaatggcgacaaacttgacgccgaggacgtggcctggtccatcaacgagctgatcgctaagggctaccacgacgccgacgcgctcgccgccgtcagcaaggtggaggccaaggacgccgacaccgcggtgatcacgctcaagacgccgaactccaacctgttgtggaccctgaccggtcgcgcagggctcgtgttcgacaaggacgccaagtatgacctgaagacgcaggccgtcggctccggcccctacaccgttgccaagttcgtggaaaacagctcgatcacgctgaaggccaatgagaagtactggggcaagaacaaggccaagacgcccaccgtggtcgtcaagtatctggccgacgacaacgccgcggtcaatgcgctgaagtccggtgacgtgcaggtgctcgccccgattaccgagaacctcgccgaaccgttcaagtccgattccgccaagtacacggtcaaagccggcaacggcaccgacaagttcgtgctcggcttcaacaacgcttccggttccaaactggctgacaagcgcattcgccaggccatccgttacgccatcaaccacaaggagctcatcgcctctcgcggcggtgcggacaaggcgctcggcggcccgatcccgtctctcgaccccggctacgaggatctgacgaatctgtacccgtatgatcagaacaaggccaagtcgctcatggctgaagccggctattccaccgacaagccgcttcaacttacgctgacctacgccaacatctacggcaccgagctcggagaccagctgcgctcccagctcaagcccatcggcatcgacctgaaggtgaatgtggtggagttctccacgtggctgcaggatgtgtacaccaaccacaccttcgatatttcgctggtggaccacaacgaaagccacgacttcgcatcgtggaccgatccgacatactatttcggttacgacaacaagaatgtgaccaagctgtacaacgagggtgttgccgccacctccgacaaggagcgtgatgccaagttcgccgcggccgccaagcttgtctccgaggatgcgccggccgactggctgttcaactaccgcatcaccaccgccacggccaagggcgttgaaggattccccttcgacctcaaccagaccgttctgcccctctacaacgtgacctacacgaagtagttcgttacagcaatgagctccctcagtgagggggctcattgttaatccaagtaaagtaggcattatgcgattcgtgttgaaacggctggcgttattcgtggtggcgttgttcggcctgtccgtggtggtttttgcagcattgcgcattctgcctggcgatgtggcctccgtgatggccggcgtcaactcgccgcctgagcgtgtgacccagctacgcgaacaactcggtctgaatcggccattgattgcacaatacttcgattggatgagtgcgctggcccgtggtgacttcggcacttcaatcctgactggtcgctccgtaacctccttggtaggcgcacgtgcgtccatcacctttcccctgattattcttgccctgctcatcgccttggtcatcggcttgccgctgggctgtgcggcggtactggcccgcagcgcaacggtgcgtgcggtgtttcatgtactggctattgtcggcggtgccgtacctgcgttgtggggcggtctgctgctgattctgttgttcgggcgcggcgtaggattgcttgatgtgtttccctcgcaagggttcccgctggatggttggggcgcacccggttcggcgatatcagcgttggtattgccggctgtatcggtcggcatcatcgtgggagcatcgcttatgcgatacacgcgcgcggccttaggggatttagccagttccggctacatcgatatggcacgctcgtgtggcatgacgcgcactcaggcggtgttgcgtgtgggattgcggttggcaaccccgcagctggtgtctgttatcgggctgaccttcgcttcgatggtcactggcgtgatggtcatcgaaaacctgtttgcgttaccgggcatcggcaacggtcttgtgaccgacgtgggcaaccgcgacctgattgccgtgcaaagcgagctgttcctgctggccgcgttctttttgactgtcggcctcgtggtcgatttgttccaccgcgtgctcgacccgcgtctgaaaaccgctaccgccattacggaggtgaccgcatgagcaatgttcgtcgtgcgacgactggtggtcgacgggctgccttcgtcatcgtcctgcactctatgtggcgtcgtgccgagggcaaattcgcacttatcgtgctcgctctgtggttgctcattgccatcgtttccctgttctggaccccgcaatcgctgtgggccactgatggctaccatgtatgggccaagccgtccgccgagcactggctcggcactgacggcaccggcgcggacgtgttcagctggctgctggccggctcacataccaatcttgtgatcgtgctgctgaccgtagtggcatctatggcttgggggctgctgctcatcgcggccatggtggcacgcaatgcggcgctcgccagttcttcggtagtggtagttgatgcgttgatttccgttcccaccgtgttgattgcgttgattctggctgtgccgttgagagcgtcaatcgcggtgattgtgatcgcctgcggcttcggatatgggttgaatctggctcgtgtggctcgccccgcagcgttgctggcggcccgctcgtcgtatgtggaatcggccttggccaatggtgccagcgggtggcgtgtgctcataagccatgttatgccgaatattctgccggtattggctgtgcaactgtcattgtcggcgggcacggcggtgttggctgagtcggggcttacttatctcggtatcggtgtgccgtccggtgtgccgagctgggggcattctctggccacttcggtcaaactcatcaacgtgttcccattaaccgtggtgtggcccggcctgatcgtcacggttgtggttgtggcgctgaatatttttggtgatgtgctgcgcgatgccatcgatccggtcaccaaccccgcattacgtgaaataggaggcgaacgatgagcgtcgatgttcgcgggttgaaaatcacgattggcggcaaaccaatcgtctctgatgcggatatgaccattgccgacggtgaacgagtcggcttgatcggttcttcaggctccggaaaatctatgattgccaaggcgatgctggggttgctgcccctgaccgctgtgactaatgggtcgattgatatgggcagcacggaaattatcggagcttccgaacgtgcgcttgccgacctgcgcggccggtatgtgggtgcggtgttccagaatccggctgcctcgctgaacccggtgatgaccgtggcgcagcagatcgccttgccattgcggttgcactatgatctgaccaaggtcgaacgagccgaccgagtgaatgccttgttgagcaaggtcgggctggatctcgatatggccggcaaatacccgcacgaactgtccggcggccaacagcagcgcgtgggcatcgccacggcgctgatcacctcaccgcgattcatcatcgcggacgaacccaccaccgcactcgactccatcacgcaacgccagatcgtggacctgctgacctcgctggtggacgacgccggtgcctccatgctgttcatcacccacgatttctccgtactcgcgcgtgccaccacccgctgctacgtgctggacgccggccgcatcgtcgaatccggacccaccgccgacctgctcgccgcgccgaccacaccacaagcccagcgcctggtcgccgccgcccaaaccctcaccctccacacccccaaggaggattcgcatgagtaacagcagtgtgccgctcctctccgcccactccatcaccaaatccttcggcccgcgcaccgcacgccaccaagtcctcttcgacgtctccgccgacgtccacgccggcgaatgtctggccgtgatcggcggctccggatccggcaaatccacgctgacccgcattatgctgggcttggaatccgcggactccggcagcgtggaatacgagagccaatccattgtcggcggccgaaaatcgccgggattcgcggccctgcgccgcgaatcgggactggtgttccaggacccgttctcctcgctcgacccacgttggcgagtcgccaaatcagtggctgaaccgctgagtctgcaacggcgtgacctgaacaacaccgatatcgacgagcgagtggccgcggctctgaccatggcaggccttgaaccggcagacttcctgaaccggtacccaatcgacctgtccggcggccaggcgcagcgcgtggtcatcgcccgcgctatcatcaacgagcccaaagtgatcctcgccgatgagccgatgagcgccatcgacgtggccgcgcgcattcagatcctcgacaccttcgccgccatccgcgcggcccggccgagcaccgccatcatcatggtctcccacgatctcggcgtggtacagcacatcgccgaccgcatcctcgtgctccatgacgggcgtctcgaagagacgggttccaccgctgaagtgctcggcaacccccaatccgattacacccgtcagctcatcgaggcagcctcgttatagaccttttttggctccctctctgaggggagctgtcgaacgcagtgaggctgaggggagttacgggtgccgtcgtattcccctcagtccgcttcgcggccagctcccctcagggaggggagccggccgccggcgacacgcgcttgtcgcgggttgtgctatggtgtgaggcatgcagattatctcatgttgttgtcgctaaccgacgcccctgggcgagcggtcagtgacgcataacttgagatagagcattcgaatcgcggcaaatctgtcgcatgaattttcatgaaatcgatggcacgagcgtaaccgtgtaacgcgcgagtcgtggttaacatgaaaaaccgattcactttccggcttcaccgtacagtgagcggggatactcgatttcaaactaaagccacagtccattcgtctgggaacgtcggttcacgaacgcaacgcagcaaaaccccacaaccccagcaacgaaggacttcacatgaccatccacaacagcctcgcagaactcatcggcaacaccccgctcgtcaagctcaaccacattccgcaggcggccggcgtcaaagccaccatcgccgtcaaagtcgaatacttcaaccccggtggatcttccaaggaccgcattgccgaacgcatcatcgacgccgccgaacagtccggccaactgaagcccggcggcgtgatcgtcgaacccacctccggcaacaccggcgtcggcctggccctggtcgcccagcagcgcggctaccgcacgattttcaccctgccggacaaggtctccgaatccaagcgcgcggtgctgcgcgcctacggtgccgaagtcatcgtcacgccaaccgacgccggcccggacgacccgcgctcctactatcaggtcgccgaacgactggccaatacgattcccggcggcttccgcccgaaccagtacgacaatccgaacggcccgctgagccactactacaccaccggacctgagatctgggaggccacggaccacaaggtcacgcacttcgtggccggcatcggcaccggcggcaccatctccggcaccggcaagtacctcaaggaagcctccaacggcgcggtcaaggtcatcggctccgacccggaaggctccatctactccgcttcctcacgcgacgaagtccaccagtacgatatcgagggcgtaggggaggacttctatcccaaggccttcgaccggaacatcaccgacgacatcgtgcgcgtgtccgacgccgaagcctttgaaatgacccgccgtctggccggcgaggaggcgctgctggtcggcggctcgtccggcatggccgtggccagcgccatcaagtacgcgcttgccaatgatttggacgagaaccaggtcgtggtggtgctcgcccctgattccggccgcagctacttggagaagatcttcaacgacgactggatgcgtgccaacggctacggcgacatcgtggagcgcaccagcaagccctccctcgccgagcagtaccttaacggagctccctctgatgagggagctggggacggactccataactagctatcaaaagaatcaataccaacatccgcactaaccaaccgcacctgttctaccttcgaatacggaacgattccgaaaggaacccaatatcatgtccgctgaatacaacgccaagttcgccaataccgacatcgccactcgcgccatccacgccggccaggagcccgacccgaccaccggtgcggtcgtcacgccgatcttcgccacctccactttcaagcaggatggcgtgttgggcctcaggggaggccacgactactcccgctccatcaaccccactcgcaccagcttcgacgagcagctcgccgccgtggaaggcggcaagtacgcgctgagcttctcctcgggcttggccgccatcgacgtgctgctgcgctccaccatcaagcccggcgacaacatcctgctcggcaacgatgtgtacggcggcacctaccgcctgctctccaaggtgttcgtgccgtggggtgtgggcctcgacgtggtgaacatcaccgatctgaaagccgtggaaaccgcattggcctccaagcactaccagtatgtgtgggtcgagaccccgtccaacccgctgctcaacatcaccgacatcgcggccaccgccgaagtcgcccacaagtacggcaccaaggtcgcggtcgacaacaccttcgcctcgcccgcccttcagcacccgctggccgatggcgccgatgtggtggtctactccaccaccaagtacatcggcggccactccgacgtggtcggcggtgccgtggtggtcaacgacgaggagacccgtgagaaggtcgccttcctgcagaacgccgccggcgcagtgccctccccgttcgactcctggctggacatccgcggcctgaagaccctggatctgcgcgtcaagcgccacagtgccaacgccctgaaggtggccgaatggctcgaatcccagccctctgatgtgattgagcgcgtctggtacccgggcctcgagtcccacccgggtcatgaaatcgccgcccgccagatgcacggcggcttcggcggcatcgtctccgtgcagctcgcggccggtgccgaggcggccaagcacttcgtggaccacacgcagatcttcacactggccgaatcgctcggcggtgtggaaagcctcatcgaggtgcccgccgccatgacccacgcctccgtggccggcaccaccctgcaggtgcccgccaatctggtgcgtatttcggtcggtatcgagaacgccgacgaccttatcgccgatctcaagcaggcgttggatcgtatctgaccgtactgacggtactggtggcaccgtattgacggtgccaccacgcttatcggcggactcgctatcgattggtacctacaaaaaatccccggcccacaagggtcggggattttccgttatcgattaaacatattgaatcagctggcgttgccgccctgccatccagtggcatccgcaccagccgggcgcaacgtctgaccggaagtcggtgtggtgccatcaacgaccacacgagtgccgatggtggcaaagtcgtacatccacttggcatcggccacctgcatgttgatgcagccgtgcgagcctgggataccctgctgcacatagatggggtgctcgccccacatgtatgcaggaacaccgtgcagggcctcgccgccgttatagtaggaaatccacggcgtgcctggctggttgtagccttcgccaaccatggtctgcgattcgtacttgagatacacgtagaacgtgccggtatcggacagcatggaaccatcggcggtgggcttgccagaagcgatgttgaacttcttgaccaccgtggttccctgatatgcagtggcagtctggttcgtcagatcaacatgaacccacttatcgccatttgccgtatcgaagttatgaggcacctcgacctgcttgacatcatatgggctgtctttcacagccacagtggaatcagtggactggttctgctcgatggcggtagccagacgttcgggggcgtccccggcaccagtcacttcaataccatccacaccgagtgtcttatcggcaccaatttccacgccgccttcgtctttcggcgtgatgtagacctcgcgtgtcaccttgggaacagtcagttctttggttacgctgtcactggtgacgtacttggtgatggcatcgcggtcgactaccagactcatggtgccacccgccttattcaccgtgggcttgaggaatgaggcaatggtatcggccgggatggtgacgctcttgttcacgccgttgtccacggtcagtttgaggccaagcttggcattggcgtcaaactgtgtttgctgtgcgctcgcgtcatcaatcggattctttgcagtctgtagcttgaccggcaccgtcgcattttcgcccggggtcgcgacggcctccttgactgcagcattgacaacattgatatccggacccttgccatcctgacccgcggtgtaatcgaactgcttggtgctcttgttgtagacaacggtggcaatctgcgctcggtcggcctcatcgaccaggccggcggtgacgaattgttcggcagtctctttgtccctggtggcggtcagagcgatatgcggctgatcgaaaatattgagcttggccacgtcgccggtcttcgcgttcaacagcgcatctacggttttatccgtgtcgacggtgacgccaaggtccttcagcgaggctttgacgctgttgccttcggcggtgaacgtcactgtggtgttattcagctgctgcttcacagtattcgcaagttcttcgcgggtctggcccatgacagagacattgcccaaatgaacaccgggcgcagccttgtcttggaagtaccaacgtccgacgaagaaataggctattaatgcggcaagcaacactgcaaatatggttatgatggcaatccgtgcggccttgccatgtgatttagcggtggtagatgccataacatgttcacccacataggctgtattatcggcatggttattggtgccattgtcactttgctgtggtgtggcggtacctgaatccgcggctgcgaacagcccatcggtggccacaggctgcagcaccgccgtctcctgatcgtcaggagaggagaaggaaaatgtatcgttggccatcaaaatgccccgtcttagttctctcaaagcggcatatcgtgcgatatgccgggaataacgttccttgacgcataataatacggaagggctacgtacatcgttgcgaggtattccgttatacgctgaaatccagccgcggtcggcctacactggtcgtttatgacagcacatcaggcggcgctggaggcgctcacacgatacttcggctatgactcgtttaggcccggacagcaaggaattgtcgaggctttgcttgccggacgcgatgtcttgggcgtgatgcccaccggcgcaggcaagtccgtgtgctaccagattcccgccgcgctcagcccgggtgcgactttggtcatatctcccttgatttccctgatgcgcgaccaggtcgatgcgctgaacgacctcggtatgccggccgcgttcatcaacaccactcaaactcccgacgagcaggcgatggtgttcgcccaagccgccgccggacagatcaaactgctgtacgtggccccggaacgcttggaaaccgggcgattccgcgactttgccgcccgtacgccgatctcgctgatcgccgtggacgaagcccactgcgtctcccagtggggtcaggacttccgctcgtcgtacttaggtatcggcgatttcatcgccgggctgccgcagcgtccaccggtgggtgcgttcaccgccaccgccaccgaacgggtgcgtcgggacatcgtgggactgctgggattgcggaatccggccgtcaccgtcaccggattcgaccggccgaacctgtattttgatgtggtcaaactggagaccaaatacaaggccgcatgggtggcgcggtatgtggccgaccatccggacgaatccggcatcgtctactgcgccacccgcaagaccaccgaagcgctcgccgacacgctgaaccagatggggcatccggccgtcgcctaccatggcggcatgtcgccggacgcgcgtgaggtggcccagcgcgacttcatcaccgacaaggtgccggtggtcgtagccaccaacgccttcggcatgggcatcgataagtccaacgtgcgttacgtcatccaccacaatctacccgaatccattgaagcctactatcaggaggccggccgcgcgggccgtgacggcgagcccagccgatgcacgctgctgtggaatgagtcagacatcgtcacccggcgtcggttgctggataacgattatgagaacgagcgattgactcccgaagagcaggagatcgttcgccagtccaagcgccggctgctggacggtatggtcggctactgccgcaccaccgactgcctgcaccggtatatgacccggtatttcggtcaggaattgtcgccgaatgctggttccgcggcgggtgaagacattgcggcggactcttcgcagtccggcagatgcggtgcctgctcgaactgcgaaagcacgttcgagaccatcgacgtgacccgcgtggcgcaggcgatcagccgttgcgtgcatgacgtggggcagcgcgtcggttccggcaaaatcgtcaagattctacgcggctcgcgggcacaggatctggcatggctgaacccggagcggatgcccaccttcggcatgctcaaggacgtgaacgaggctcgcgtgcgcgacgtgttgagccagatggccacggacgggtacctgtcaatcgccgaagggcgtatgccaatcgtcatgttcggtgcgcgggcggccgaaaccgccgctcccgacttccactatgagatcaaacgggtggaacgcaagtcggaggcggccggttccggtcggagcgggggagtggctgatactgccgattccgccaatgttcccggcgatgcgctgggctcgtatatcccggacgatgacgaggaatcgctgttccagaagctacgcgaactgcgacgcaccatcgcccaggaaatcggcaagccgccgtacatcgtgttctccgacaagaccttgcgcgacatggcccgcatcaagccggttaccaatgcgcaatttctggcggtcaacggcgtcggtcaacacaagctcgacctctacggccagcgcttcatgcaagccatcgcctcgttcaatgccgggagtgcgtcataacaatctcctatagcgaactgcggagtatttgcgggcgttcttgggctggctcgactacgatgactgttcgatgcttcatgaccgaacactcggcaagtagaaaggcaacagcatggcagaagaaacggccgaaaagcccgtcgtcgaatcattccagcttgatcacaccaaggtcaaggcgccgtacgtgcgttacatcgacaccgaaacgggccctcacggcgacgtgatctccaactatgatctgcgcctgacccagccgaacaagcaggccatccccaccggcggcctgcacaccatcgaacacaccatcgccgtgctgctgcgcgaacgtatcccgggctacatcgactgctcgccgttcggctgccgcaccggcttccacctgctgacctggggcacccaccccaccgaggaagtggccaaggccctgaaggaatcgttggagttcatcgcgtacaaggccacgtgggatgacgtgcccgccaccaccgagaagagctgcggcaactatcgcgaccacagcctgttcaccgccaaggaatgggccaagcagatccttgaggaaggcatcagctccgacccgttcgagcgcaaggtcgtctgatcgcaagccaatcggcatggaagaaccccgcccccgcataccacgcggacggggtttctttgtgcctatgtttgtgcctatggcatggtaggtttgccgtcagttaatcgttggccgctgcacatcggtagcttggcatgttggagaggtggaagtgactcagtcgaacgctgcaaacaaggcgacaggccgccgtttccgccacgccaccatgcgcgatctgccgcagatgcagaaaatctacgcacgcgcacgcgcgttgatggccgccaacggcaaccccacccagtggggcaacgaatttccgcgtgaatcgatgattgaggacgacatcgccaaccagcgtacgatgctgctggtcgacacctgcaatggccacgaacgcattctggcccagttcgccctgtgcccgggcgaggatccgacctacgccaaaatcgacggcgcctggctggacaacgacgcctatgtgaccatccaccgcatcgccgcatccggtctggtgcgccacgcggcccgcgactgtatcaggtgggccctgaagcactacggcaacgtgcgcgccgacacccaccccaataacaaggccatgcagcacgtgctcgaaagctccggcttcgcccgttgcggcctgatccagctgctcgaccggccggtcgacaccaccagaatcgcctatcagcgccacgagtggtgagtgtggctgccggctgatgtgctcgtttctgcaccgtcatcggtttctgacggtagaatcagtgtgtgagaagaacacgttgggtcgggggcgtcgtgacggtgcttgcggctgtcatgctgtcgtcgtgcggcggcgtccagtcgaatcccgggtaacacaccgttgccaatccattcaccgcgcaggtgaatggagaagacatggcgatgcctgtcggccgatggagccccatcggccgacaggcatcgaggaagtcaccgtggccggcggaacgcgcggtcgccgattggggcgaatggcttgtgtggttcgctttggtaccagtaggcgaccgtggccacgtcgtcctgtcgttcgaagttgccggcttcctcggtgccgatctgctgccattcgacgcgcaggtctcgctcgaagtagatcgggtcggggatgtgccaacggtataggccgcgggtcacgggggtggcagtgtcccagtaggcgctttcgcgtccggcgaggttctgcgagtagaacgggaagccgaggtatgggccggtgaaggtgcgctcgtgcatgcggccgtgttcgtcgaattcggcgaagctccaggcaccgccgaagtagtcctcggcgccggtgctgcaccaggtggggtatttgccgtcgccgtcgatgtagaacttgaattcgccttcgccccaccagcggctttcgagcgcggtgagcgccaggtaggtgccgacgtaggtgccgtgtccttcgacgccatcgagcaccacgtagtcgtgggcgagttcggtgacgcgttggcggcgccactgcgcgtggaagcgcatcgtgtcggccggcagccggtcgtattcggtgtagtcgatttggtagaagaacgcgggcacgtcctcgttgtggtcgttgcgcagcacgatgcgcgcgtgttcgaacggcatggcgaagtagcagttgaagccccggttcgggttgaccatgacgggaattgagttgatggtgcaggactgggcgtgtccgcagcagaagaagtcgccgatcgggcattgcaccgagggggagtcctcgccgtcccagtagaattccaggatcaggttgcgtagcacgtcggggccggtgggggaggtgcggtcggttaccgtcatccagatgtgacgaatcacgccggggccctcgacgtccatcaatgtcaccgattccccggacctcaccgtgctgatgcaggggcttcccttgcgggaggggcccaacgcgctggccgccatggccgcgcggcccttgccgccgtccgggttttcggcgttgatgcagcgggtgcggccgggggtcctcatggccacggcatccaaggcgccttgtccgagccccggcgcggggttcgctgtggtgaatgcgtcgagcatgatgcttacttcctttcctgtcgcaggcccgtcccgccacggcgttttgtctggggtgagccgggctgctgggggggggagtatttcacggcaccggcggtgatgccctgggagagcttgcgctggggtagtgcccgatatcttgcgcactttggtcttcgcccgtccctgtggcgatgatcggttcgcttcccgtacagtctcaccgagtcttgacatgtcgaggtagcggcgcgtcgaccactcgttcgacgtgacatagcgcacgcgtgcgcagacgagcatcaacgcgctgcgttcgtcggggaagctgccgaccatgcgcgtgcgccgtctgacctcgcggttgcgggggtgaccctggcgaggacgttgcgttcgaagtgcaccatgcaccgctggtagcgggcatcgcgttcaaggtctccttgacgctcttgcggaccatacggtccagggtggtctccgacatggcctcatatcgcaaaaaccgtacgctgaaagtaactcagcgtacggttttcacgaaagcagccatcggctatcggtcagccgatagacctcagtcctcagtcctcagtcgcagcgaccttggcgtcagccccggccttctgctcaaggccgagcttggagcgcttgcggctgtagccgaagtacacgatcaggcccagaccgaaccagacggcgaaacgcacccaggtctcccagttgagaccggcgatgagcacgaagcagaatacgatggccagaatcggggtgaccggcacgcccggcgcgcggaagccgcggggcgcattcggctgggtcttgcgcatccatagaataccggccgacacgatgatgaacgcggacagcgtaccgatgttcaccagctcgaacagcacgttgatgttgatgaagccgccggcgaacgcggtcagcagaccgaagaaccaggtgcccttgaacggggtacggtacttctcgtgcacgtggccgaagaacttcgggaacaggccgtcacggctcatggcgtagcagatacgggattggccgtacagctgcacgagcatcaccgtggtcatgccgatgagggcgcccaggttcacgatcaccgcgagccagttcatgccggtctccagaatcacgccggccaccggggcgtcgatgtacttggcgaactccttgtagggcaccacgccggtcatgatcagggtcatgatgacgtagagcacggtggaaacggccagggacagcagaatgccgcgcggcagcgtcttgttcgggttgatggtctcctcagcggaagaggacacggcatcgaagccgatgaagctgaagaacacgatggaagcggccggcacgatgccgtacggctgggtggagccgggctggaaagtgtagatgccgtacggggagaacggctgccagttggacggcttgacataccacacggcgcacacgatgaacagcacgatgatggcgagcttgatgagcaccatcacgtcattggtgcgcttggtctggttgatgccgatggagagcacccacgtgatgatgagcacgatgacgaaaccgggcaggttgaagtaggtggtgacgtccgggttggtgccgtaggcggcggtcagctcgaccggcaggtgcaggccgaagccttccagcagtttgttgaagtagcccgaccagccggcggacactgtggccgcctgcagggcgtactccagaatcagatcccagccgatcacgaaggcgatgagctcgccgaacgccagataggcataggagtaggccgagccggacaccggggccatggcggcgaactcggcgtagcacagaccggcaaaaccgcagcagacggcggccagcaggaacgatacggacagggccgggccggcggtcagcgcgcccttgccagtgagcacgaagataccggtgccgatgatcgcgccgatgccgagcatcgtcagatcgaaggtgcgcatcgtgcgcttgaggggagtggattcggcgacaagctgatccacgcttttcttacgaaacagatccatgttcttctctcatgaaatctaggattatggggctgaaccggacggatttccgggatcccggcacgcctcaacgccgggaatcaaaggcggcttccgagaaaccgcatatcggtcattagtgtacgactgccgggcgaaaacagacgattgcgactacacgtcacattctcgcgcaacaataggtgtctatgagcatgaacgcagcacctgaaatcgcattctcgtccgagcagggcaaggccaactatgcggccgcccgccgccaataccccgcacaggccatcgtggacctcaaaaccatgcgcgacaacatggcccacctggtctccgtggtcggcgggcccgcttccggcacggcggtgatgggtgtggtcaaggccgacgcctacggccacggactgctgcccgccgccctggccgcgctcgccggcggcgccacatggctcggcaccgcgcagtcgcacgaagcgttgctgctgcgcaagctcggcatcggccccgaccgctgccatattttgacttgggtatacaacggcaccgaagtcccgttcgacgagctgatcgccgccgacatcgacgtatcggtcggctccctgcccggcatcgatgccgtggccgccgccgcacgcaagctcggcaagcccgcccgcgtacacgtcaaggtcgattccggcttcggtcgcaacggtttcacgccggccggattcgacgccgcgctcgccaaactcgtgccgctcgccaaagagggcgtgttgcatattgtgggtcagtggagccatctcgccgtggccgattcgcccgatgtgcccgaattcgtgtcctccaccgaccgccagatcgaaacattcaaggacttcacgcgccgcatggaacaggccggcattccgccggagatccgtcacctggccaacacggcggccactttggaccgcccggagattcacttcgaacttacccgccccggcatcggcctgtacggctacgagcccgatcccgcgatgggcaccccgcgcgactggcatctgaccccggccatgcgcctgcaggcgcagctcggcacggtcaaggatgtggaggccggccatggcatctcttatggccgcacctacctgaccccggacaacacctcgaccgctattgtgccgctgggctacgccgatggcatccaccgctccgcttccggtttcgatatggaaggtgccaagcacgtggagaagccgggcggcccggtgcgcatcatgaccactgaaggtccgaagctctaccgcgtgtgcggccgcgtgtgcatggaccagttcatcgtggacctgcacggatccgccgccgaactcggcgttcacgagggcgacacggtcgaactgttcggcccgggccgcggcgaggattacgttgagcctaccgccgacgattgggcccgcgccgccgacaccatcagctacgagatcttcacctgcctgcgcaaccgcatcccgcgcctttacgagcatgccgccgaagtactgcccgccgccgacctcgccaagctcgaccccgccacgctgctataaggtgcattaccgccatacggtggcaccccgtaatcccttcttcccgaatatgtgccgttgacatgtgctgagcgtcacatattcgggaaatcggccccaatctcccgaatatgtgctgttgagttgacgtcagtggcacatattcgggaagtcgggattactgcggccgatatgtgtgcctatgcttggaatatggaaacgactttggatggggaacaggtgctgagcgatgagggctacagcgccttcgacgaggagcggtgggcacccgagccgcccaaatccaagtcgcgcacggctttcgaacgcgatcgcgcgcgactgattcattcgtccgctttgcggcgtttgggcgcgaaaagccagattctgattgccggtaccgacgatttcgcccgcactcgactgacgcatacgctggaagtcgcccagatcggtcgccaaatcggcgcattgctcggctgtgatccggacgtggtcgactgcgcctgtctggcccacgaccttggtcacccgccgttcgggcacaacggggagcgtgcgctcgccgacatcgccagcaatatcggcggcttcgagggcaacgcacagaccatgcgtatcctgacccggctcgaacccaagatctttcacccggacgggcgttcggccggcgtgaacctgacccgtgcggccttggatgcggccgtcaaatacccgtggaccttggccgaagccgaccgacacccgaagggggagcggtcgaagaaattctgcgtctacccggatgacgaaccggtgttccgctggctcaaaatcggcgcgccccaggccgccaaacccatggaatgccagatcatggacctttcggacgatatcgcctactccgtgcatgacgtcgaggattccatcgccaccggcgcgttcgatccgattgtgctcgccgatccgaagatgctggaccacatcatcgagcagacgcgcgcatggtatggggcgaagtgggatgccgacaagctgctggccgcgttcatgcgattgcgccgagagcatttgttccctgcacatttcaatggttcgcgcgaatcgttggcgcagcttaagaacattacgtccgatttgatcggccgcttctgctggtcggtggagaccgccacgcgcgacacgtatgggcccgggccgttgacccggtattcctcgaacatcgtgattcccgagaacacgaattacgagatcgtggcactgaagggcatcgccgtgtacttcgtcatggcgcctcgcgagcgcgagccattccatcaggaggagctcaagatcgtatcggatttggtcgatgtacttatggctgattcgccgctcccatccgacgctttggaaagccagttcctggccgattggaacgaatccaccaacgacgacgaacgcctgcgcgtcgccatcgatcaggtcgcgagcctgaccgacaactccgccctggccctgcactccatcttgtgctgagggcgtgttgggcgggcgcttccctcagtctcgctgcgcgagccagctcccctcgggtgaggggagctgtcgctgtagacgactgaagggagtttcgcggaagaaatgataaccgacggtaaaaatttaccgtgtctcaggtgaggcggtactctagagacttatggtcggaatgattaagaaagaagatgtcgagaaggtgcgcgccgccgcggacctgtatgacattgtatctgcgaccgtaacgcttaagccctccggcaccggcaccttcgtgggcctgtgcccgttccacgacgagaaaaccggcagcttcaacgtgcgtccctcgctcggcgtgtggcactgcttcggctgcggcttgggtggcgacgtattcaaatacgtcgaacaatccgaaaacatcgacttccgcgaagccgtggaactgctcgccgacaagtaccatatcgagctgcactacgagaacagcggcaacggcccggcgcgcgagaacaccggctccaagcgcacgcgactgctggaagcctgcgaggaagcccagcgcttcttcgtctcccagatcttgaccaaggaagcactgcccgcccgcaagctgcttggcggccgcaacttctcccaagctgattgcgaacgtttcggctgcggctacgcgccgcaaggctgggataatctcgtgcgccacttggcctccaaggggtttacgcagaaggaaatcctcgacgcgggcttggcccgtcaaggccagcgcggcatctatgactatttccgcggccgagtgacctggcccatccgcgattcgaccggccgcacgctcggcttcggcgcgcgcaagctgtatgaggacgaccagatcgccgccaaatacatcaacacgccggatacgcagctctaccgcaaaacccaggtgctttacggcatcgatttggccaaatccgccatcgtcaagaagcggcaggtggtgatcgtcgaaggctatacggacgtgatggccatgcacttggccggcatcgacaccgccatcgccacgtgcggcacggcgttcggcgccgagcacgccaagattgtgcgccgcctgatcgccgacgattcgctgggtgcggtccagctggtcgggccgttgaaggtcaaggaccagccgttgagctcgcgcatcgtgttcacgttcgatggtgacgccgccggccagaaagccgcgctgcacgctttcggcctcgattcggccttcctctcccaaaccttcgtggccgtggccgacgacaatctcgacccgtgcgacctgcgcatcgagcgaggcaacgaggcagtgcgctcgctgatcgcccgggccaaaccgttgtatgatttcgtgatcgacgccgccatcagccggttcgatctgacctacacgcccggccaagtgggtgcgatgaaagccgtggccccgctggtggcgcagattcgcgaccgctccctgtgggacgcttacgtgcgcaagtccgcgggccgtatcggtgtggaccttgaggtgatgcgccgcgaggtgatgaacgcacgccggcagatgcatgtacgcgatgaggacgcctacgcgcccaaacgtcgattcgagcgtgacgagccgcgtgtggaacccggcaccaacccgtacgccaatccggccacgcgcaaggccttggagcgccgtgacgccgccgaacaggcatatttcaagatcgacgacgccgtattcatcgccgaacagcagttcatggccgtgctgattcaggtgccgcgcgccatcgaccgcaccatgttcgggcagctgaccatcgaccatttcatgacttcggtgttccgcaccctgttccaggcgatcgcggccgccggcggactgccatccgacgataccccgcaggggctgtggatgcacaacctcaccaaggccggcgggccgatgctcaatcaggtgatcaacgagctggctgtcatgccgctgcctctgcctggcgacgacagtggcaacggtgcgcagccggtgcaggccaacgtgtcgggaggaggtgttggcgtgaatggcggtgccgccgcagtacagctgcgtcctgccacgccggaggagcagcgctacgccactgagcttctcacccgattgttggacatgggcttcatgcgccagatcggtttggccaaacgccgcatggcccaactgcccgacggcgaagagaagataaccctcctcggccaaatcgcccgcatggaaaccgcccgcaaagacctccaagcccaaatctacggcaacaccatcggctaataccccccccactgattgcgcgcatcctcgaatacgtgccggatgcataagtccatacaaccggttgccggattggatgggtgcagaagttgcggattggccccatccaaattggactggtttgggtgggccaatccaatccgttcaataatgaagcgcgataccaagcagcgtcgaaacgaagggaaactcatgacgcagaatcgtgcggaactcaaccgtaatctggcccagatgctcaagggtggcgtgatcatggacgtcaccacgcccgaacaggcgaaaatcgcgcaggatgccggcgcatgcgcggtgatggcgctggagcgcatccccgctgacattcgtgccgccggcggcgtctcccgtatgagcgatccggccatgatcaagggcattcaggaagctgtctccattccggtcatggccaaggtgcgtatcggccacatcgccgaggcccgcattctgcaggccatcgaaatcgactacatcgacgaatccgaagtgctttccccggccgacgacgtgtaccacatcgacaagaaccagttcgacgtgccgttcgtgtgcggcgcgaagaacctgggcgaggcactgcgccgcatcgccgagggtgctgccatgattcgtaccaagggcgagcccggcaccggcgacgtgattcaggccgtgcgccacatgcgcaccatgaacaagcagattcgcgagctcgtggccttgcgcgacgacgaggtctacgaggccgccaagcagctggccgtgccctacgacctggccaagtacgtgcacgacaacggccgtctgcccgtcgtgaacttcgccgccggtggcgtggccaccccggccgacgccgccctgatgatggagctcggtgccgaaggcgtgttcgtgggctccggcatcttcaagtccggcgacccggccaagcgcgccgccgccatcgtcaaggctaccgccaactggcaggacgccgatctgctcgccaagctgtccgaaaacctcggcgaagccatggtcggcatcaatgaggacgagattcagaccatcatggccgctcgcggcgagtgagtgcattaccttggctcccctctttgaggggagctaggaaagggtgacgctcccgccagcgggagtcaaggcccaaggagacaacatggttgtagctgttgaatatatttccaaagaagaatccgcggacgccaaaaacgccaagcacggcgtgaccggcatcctggccgtacaaggcgcattcgccgaacatgcggcggtgctggacaagctcggtgcgccgtggaaactgctgcgcgcagccgaggatttcgatgaatccatcgaccgcgtgattctgcccggcggcgaatccactacacagggcaagctcctgcattcgaccggactgttcgagccgatcgccgcccacatcaaggcaggcaaaccggtgtttggcacttgcgccggcatgattctgctggctaaaaagctcgacaatgacgacaacgtctactttggcgcgctcgacgccgtcgtacgccgcaacgcctatggtcgtcagctcggtagtttccaggctactgccgattttggtgcagcggatgatccgcagcgtatcacggacttcccactggtattcatccgcggaccgtacgtggtgtcggtcggacccgaagccacggtcgaaaccgaagtcgatggccacgtggtgggcttgcgtcaaggcaatatcctggccaccgccttccacccggaactcacggacgatacccgcatccacgagctcttcctgtcgctgtagtcgattcgtctgccgttagactggtatccgattgacgaatcaaggagacgatctgccatgcagcttgagctgaatcgacgcagcaaggtgccgatgtaccggcagctggccgccgagctgcgtgaacagatcgtctccggcgcgatggccgagggctaccgcctgcctcccgaacgcgagctgtcctcacgtctcgaagtcaatcgcaccacggtgttgcaggcgtatcagcagctcaaggacgaaggtcttatcgcctccaaagtcggcaaaggcacgttcgtgctgccggctgcctccgcaagccgaacatcgcacacgtcaaacagtgacttcgggaatgcaataacgcgaacaacacgatcgtcggcagaaatgggaacatcgcaagcctcctcttccggcgacgtagaacgtgctacctccactgatttcttgacgacagaccagggcagcagctctgcggcggtccatacgattcgtgaaagccgttcggttcagggcccggaaccaaccgtcgtgcgtccgccatggtcggtgttgttctctgattattccaaccggtttacctaccatgacatcgcctcggccgagcgggcgcagcgcggcgacaccattattgacttcgccaccggttcgccgaacccggcggatatcccggacgatctgctgcgcaaggtcagcatcgaagcattcgaatcgcgggaattcgacggccaaccggaatcacctatcgagggattcgaagagttgcgtgcgctgcttgccgaacatatgcgcgcacgaggcgtacaatgcggcgtccgcaacgtgatggtgctctccggctccgagcagggcattgacctcatcgtgcgcgcgttcatcaaccccggcgactgcgtgctggtcgaacaatccacgttcttcccggcattgcagaccttccgctcggcggatgcgcgcatcatcggcgttccagtggacgagcacggtatgcgtacagacctgttggacggctattgcgcgcgattccggcccaagctcatctacaccgtcccgacgttccaaaaccccaccggtaccacgctgccgcccgaacgacgcagcgaactcatcgacgtggcgcggcgctatcagtgtctgatcgtggaagacgatgcttacggcgatttgtggtacggcggggaatcgtccgacgcacatcgccccataccgcttaagggcatggagaatgcgggatacgtgatgtatttgtcgacgttctcgaaaaccgtcacttcgggcctgcgcacgggatgggttgtggccgacccgcatgtgattaaccggctggcggctctgcggcgcatggtcgaccagcatacgagcacgtcatcgcagcgcatctgtctggaactgcttaaagaaggccgcatcgccgaacatttgcgcggtttgatcaagacttaccgcattcgacgagatgcagcaatcgcagcattggagcggtatgcgccggatgaagtgtattggaccgtgcctgcaggcggctactatatttgggtttctttgccggacggcgtgcgctctctggatgtattggaatcctgccgttcccaaggcgtcacgttcatgccgggcagcgtgttcgacgttgacgaaatggatgattcccacatccgtctcaactttgtgcgcccggatgctgctgacattgataccggcattcgaatcattggcgagacgatagcacagatgtagccaagtgactggctcattgcggttgtcgagtttttttgatggctgcatacccacatcgatgggtgcattcgacgaatgaataagcgaggaagccatcatcagttcgctgtggcatgcgcatagcgttgtcgggcgaacggggcagaccacgtggtcgttgcgtgacctggccgatcgagccggcatcgcattgcccctggcgtagtggcgaggtggcgcagtaacgagtcacgccatcgcgagccgatgatgcgaaatgcggaaccggtcgcggccatcaacggctatcatacatgcggaagcaacgatacgttggcgtcagcacatccatctgactccagaaagggacacgatatgaccacatcctccgtttcgccggtgaccactgaactggcgggcagcgaaaccggcatcacgcttgtcattcacgccggagcgggcagtcgtggcaagcacagcacgcctgaacgcatcgcccaggtcgaacttgatctgcagcgcgccctcgatgccggataccagttgttggaatccggagcaccggcgcatgaggctgtggtcgccgccatccacgtcatggaagacgctcccgaattcaacgccggccgtggtgccgccctgaccagcgatggcatcgcccagatggacgcctgcctgatgaccggcgatggcgaggtcggtgcggtcaccggcgtaagcaccgtgaagaacccgatcgatgcggcgcgtgccgtcaaagagcagaccaagcatgtgctgttcgcggacccgaccgatgccgagatcgccgattggggcgtcgcgaccgaaagcaacgagtacttcatcaccgaacagcgtcgtcagtccttggccgaggctcagtccggtggcgatgagtgggagaagcatggcaccatcggtgccgtggcgcgcgatgccgagggcaatatcgccgctggcacgtccactggcggcatcaccaaccagatgcacggtcgtgtgggtgattcgccgctgcctggttgcggcacgttcgccaaccagtccacggtggcggtgtcctgcaccggcatcggcgaggcgttcatcaaggtggtcgccgcccatcaggtgtcggatcgtgtgcgtttctccggcgagaacgtcgaggatgccgcgacggccactttggacgaagtcgccgcgcatcatggcgatggcggcatgatcgttctgccggcggtcggccgtggcgtggtcgcctacaacagcgagatgatgaacttcggataccgtagcgcgcaaggaggtaaggtgcagggctgattgccccctgtattgcggcatatatcataatggccggtgtgctgcggattcttggtaaggaatccgcagcacaccggccattcatgtatgcggcaagtgccgccgatcagtgcggcagtgcgcgctacttggtgatcgtgttgtacgtgggcatgttcgtgtaatcgaactgcacgttcttcacgttctgtgcagacacggcggcgaaacgtttgaccgggaatactggggtaatacgcaacttcatcgctcctcttcctcgaatgaaactatgttccattggtatgagccagccacgtacggtattcgtgtctggcctgccacacaatgatgcagccgtatatacgggcacagcattgcgcggcagttcattgtatggaagacatgcaaactcaatgtttccttgtccaaataaaaaaacgagcgcggctgatgtgcggcaccggtccaaaaactcatgtccgccagcgcaacgcgactacgtaccttatgctggtctgcgcgtaaaatagaatggttgcgatattgggttattcacggaggaatggatgcgacgctggctgatcaatgtagccaaaaatgagacgattctcatcgtcgccgcaatactcgccctgatttcgtgtttcattgtgccgccggacgccgattacaaaagctacattcacgccagcaccatcagccagctcatctgcctgatgattgtggtgtgcggattccagcgtatcggcgtgttccgcatcatcggttcgcgattgctggagaaggtcagcaccatgcgcggactggtcattacgcttgtcgctttgacgttcttttccgcgatgttcatcaccaatgacgttgcgctggtcacgtttgtgccgttcgcggtggccgtgctcatcatggctgggcaagaggataagaccatcctcgtggtcacgctgatgaccattggcgcgaacgtgggcagtatgctcaccccgatcggcaacgcgcacaacctgtatctcaaagccctgaccggcatgccgaccatggaattcctcggcatcatggcaccgtattccggcacggcggccgtgttgctggtcatcgtgatttccgtggtgtttggcggcaaaccggtcggcgacctgggcgacctcgaaaccggcgtgctggctcccgagcgcaacaaacaccagcccgacgagattcgtatcaccggctacggcgccggttatggcggctggcgcaccatcgtctactcgctgctgttcatcgtctgcctactggccgtctccgacgtgattcccctgtgggtgatgtgcgtgatcgtggtcgtcgtgttcctgttcaccgatcggcgcgtattcaaatacgtggattggggactgccgctcaccttctgcatgttcttcatcttcatcggcaacatgaagcgcgtgcccgaattctacgaactggcgcgctcgctggtcggcggccatccgctggaggtggcggtcggctccagccaggtcatcagcaatgtgcccaccacgattctgctttccggcttctgcgaccaatggcgcgatctgatcattggcaccaatttgggcggcatgggtacgctcatcgcctcgatggcctcgcttatttcttacaagaacgtcgtgcgccaatacccgcacaagaaaggccggtatctggccgtctactccgccgtcaacgttctgtttttggccgtattgctgaccttgagctggatcatcgagccgagtctctgagccgccgttgtgggttgggccggtctaccgcgcgtatacggtgggggagccggtcagtcggctcatggccgactgcgggatgtcgtggatgcggccgatggtggcatccagcgtggatacgccggatacgccgtctgtgttggctgtgttggctgcagaggtgatgctggatacgccgactgcggacgatgatacggccgcaaccatcggctgacgataggcgttggagttgcgggccagccgggcgagcgcagggcgctgcctgcggaacagattgataaacataccgcatactccttcatcgttggccggcggtcttctggccgccgtggtttccatcctgccctcccgtgcttgtattcgctatgggggatagcccctattattccctgaatctgcacgattccccctcatccttgagggtgattctaacggcaaaggaatcggcctaatggccgatgtcgatcagcgcgaagccaccagcgtgacgctgtacggcttgatcttcatcgccagcaatgaagacggcgacggcaatgtgtaagcccgacgttccggcacaatcgcccccgaagcctcgccgcggtatccgatagtggtcttcgccgtcggattggcgcttaacgtcgtcacctccaaacgcaccggtcgcgatggcgaggcgcccagcccggccagtccgcgcgcgatttccaacgtcacatccaccggggaatcggaggtattgacgattttgatgtaacggcaggcgtcatccccgtcatgcccggtggcactgacatacagatgtttggcggggcgtgacgcggtctgctcgatggacacggcatatgtcgtgtcgcccagatgcgtggaaaacagccgctccacctcataattcaccgtggggttcacatgcgccgaattgagttcgataagattctgcgcccaccccttagccgggatatgcgcgagcagcggtgcataggaggtcatgcgcaccacgtcggaattgcgctcgcaaccggtcaggaacgcggcctcgccgagtgccgacttccacgtgttcgcgccctgttcggtctgcggttggccggcaaaatagccgttggctgaatattcgccgaaatagacgccggcgccgcaacgcgggtaagcgtcgaatcgtgacgcttggtatgcaaaccattcgggggagtgataagaatgttcgtcgacgataatcgcgtcaccggtggcggaatcatgtgccccggaatcggttgcggccaacgctcgcgcatggtcccagctgcgtttcatcgtcggctggaaggggaacagtccggcgctcatcacacacagcatatccgggtatcgttcgtgaatggcctcgctgatcatgtcaaacttggccacgtagtcagccccgaaattttcgttgcccacgccgatcatgtccaggccgaacggttctggatggcccatatcacgccggaccgcggcccacgagctggactccggatcgccattcgcgaattcgatgaggtccaggtagtcctgaatcacattgttgcggaaagtggccgaattgatatccatgtggtgcggatcgcggccgggcgactggcatgcgatgccggcgaacagagtgggcagcggcttggccttgaggtcctcgcacaggcagaaatactcgtagaagccgatctgatagctctgcgaatagctggaaccatccggcatcttgaacgaccacatcgaatactgttggcgtcgcgcggccagggagccgacggtatccttccagcgatattcattgccgggcgtcacaccttcgacgatgcagccgccggggaatcgcagaaacgctggatgcaacgcctgaatggtttccaccagatcgcggcgcagcttgccgtaacgccatttcgggtcgcccgcgccccaatagtccgcatccatgaactgcaccagatccagatcgaacgtggtgcgttcgccggcgtcaatggtgatacgcagcttgccgtaatcggtgttcaggccggttacgtcggcgttgaaccggtaccagccgtcacggccgatggcgatggcaccatccgacgaatccggactgatcgaaacgccggaatcctgcgcattggcaccatcgtcctgcctcagaccggtctcttccgtatcgtcaagcggatctgcgtccacgatatacgacaatcgagtggtgctggtgagcggcagaccgtacctatcgaccacgccgacggacagcttggcccgcccatgaaccggacgtaccgcgagactgacggaataggtgtggtcggcgacgatggagaacgcgggctcgcccccgttgtcgccgcctccgttatagccgaggttttccagatatgcagggccggtttcggaaggaacatcggacgtgatgcgagcgtatcggctatgtgcgtgaattggcggggcggggcagtcggtggtcacccgctgaccgtgaatcccgcgtatctcactgccgaggctggcggcggaacagttgatgaaatcccagaaacgcagggaatcggcctgtgtacgccatcgttcggcgccggccatacgccacgtgtgatggtcgagatagacgccgtcaaaactgtagttgttcaccatgttggcgttcagcccgccatccgcaccatggttgatgtcctcgaagaacacgccgtacagccgcccgcttgtgtgatgggtggggcttcccacgctaatccgcaccatggttttgattgtagagggaatggagcggaaaggtaaacggaagagttcgctcaccgttcatgttgcggtcaatccaagtcgactgttcgccggtatacagccggtaccctcgaaacaggaatggaaaatacggacgactaggagcgcggctgtgcaatcctcggtgggaatacgtgagcgcatcgaccacgtgtatccgtcgctgcgtccggcggagcgcgccgtggcccagtatattcgggatcatatcgaggaggcggccgacctgaccgtcggccagatggccgacatcgcccacgtcagccagccgacggtgattcgtttcgcccgcaagctcggtttcggcggttaccgtgaactgcggtacgtgttgcgccatccggccgccgagcacaaagtgaccttcaatccgttggctggattcgatctgaatccgtgggatggcgaagatgagattcccggcaaagcggcctatggcgcgaaggcgctgatcgatgagctgcacagtgcgttggaccccaaggcctatcgcaaggcggtcgccctactcgccgaatcggagttcatcgatattttcggcgtggagaactcgttgacaccggcgatggatctgttcaccaagctcggctacctgggactgacatgccgtctcaataccgacgcttacctgcagcagatcggtgccgggcacctgccccacggcgctgtggccgtcgccttctcccattcgggcagttcggcggatacggtcaaagcgttgcgattggcgaaatcgcatggcgcgaaaaccatcgccataaccaatgccatcggcgcgccgctggccagctgggccgacgtgacgttgctgacgggtcgtgactcgcacacgatctatggcaatgcgattttctcgcgcgtggccgataccgcgctcgtggacatgctgtacatgggcgtgattctgtccgactacggccgtttctccaccgcgctcgacgaatccggtcgcatgattcgcgatcgcgtattcgagaactgagctgctgctttatcgtgccttgggctgtattgctctggtcgttgctgcttgggttgttgacgatttggtcgttgtcgccctggtcgctaccgtcctgaggcatgtgccagcgaatacgtagtggacttggcgtgcgtatgacgttcgatcttgccgctcaactccagctggtccaagagctgcgtcatctgatccttgttcaggccaagcgctttctgcatggttttacggctgagcttcacaccgcggaacgcgaggaaattgagcgtgaactgttccaacgtttgaggcgacggttccagcgtcgctgtatcgagcgggcgggtactggcctgatcgtcaccgtccgggcgttcgccgaatccactgccgagaatcagcgtctgcagtggcgcgcagccgatgatgcgtgcgccggccaaagcatctgcggcgttatccgtcatgcgctgaatcgtggggaatgagtacattttggcatgctgtgcttcgtcagtggtgctgggcgcggcggaagcatcggcatcggtccgatgcgaggacgcggcctcggccgatacagggataggcagtaccattgccaccgaagtggggcccacgcgcagttgcggactgaccgcgctctgcgcgtaggcgtccataatgcgttgaatgccggtaccgcagttctcgcagaggcccaaatcggcgaacaattcagccaaacgcggggtgcgtggctggcatacgccgttgagtagatcgttgatttccaaaccatcggtcaggccgccgagcgacacgatttccaagcgggaatcgaagatattgatcagtgtggggccggagtacgtgtaatcgcgatgttccagtgcgttgaccaatgcttcgcgcagggctatggccgggtattggccggattcgttgatgccgttcagcagggcgctggcttggtcgagctggcgcagcaccgagccggtgaatgtgtgacgttcgcgaatggcgtttttgccattgccctcgaaaatggtggccttgataacgaacgggcattggttggacagcagggtggcaagcgacgattcggtggtgctggtgaaggtgttgttggtgccggtgttggtgatgctgccggcggggacattaccggcatcggcagagacggatgcagccatgttggtcacaaccgggctttcccaatccttgccttcactggcaaaacgaccctgtgcgtatgtgaaagtgagctcaccgctatcgcctgcgacggtctggcccgatgcggcgtgatctacgttgctctccgttgtccccatatcgccgatggtaccggtgcaagccgacgttacgccgaggtgttttacacccctacggctagacttacacgagtttggccccgtagctcagctggatagagcatgtgacttctaatctcaaggtcgacggttcgagcccgtccggggtcacgatgtaataagcccttggtccctcatcgtttgtgaggggcaggggcttttgaatattatgccggtctgggtccgtctggagcctgaactgtcgaccttgagattagaagtcacatgctcatcaccaccatccgggaacacccttaaggggtgcgtctcctgcataatggttatactctgacttgagatgtgctgaataataaccagctatcgcgcgtccgccaatggcgacgaacgagggaagaaggcccgtgccacgagcaatcatcgaggtaagaaacctacgcaaggaataccccgtcgaggatgagacggtggtggcgcttgaccgtgtcaatctcagtatcccgcaaggccagatctgctgcattttcggcgaatccggctccggcaaatccacgctgctcaaccagttggccggcatggaaaaaccgacgcgcggcggcgtgagaatcggcggcgtacccgtcagcaaactcgacgagcgtgagctggcggccttccgccagaagcatcttggcttcgtattccagtcgtacaacctgctgcccaatctgaccgcgctcgaaaacgtggcaatgccgctgatgttccgcggcgtgcccaaggaacagcgcgaacgtgcggcgcgtggcgtgctcacaagggtcggtctgggacatcgtctcagccattacccgcgccagatgtcgggcggccaacagcagcgcgtcggcatcgcccgggcgtttgtgaccaagcccgaggtggtgttcgccgatgagccgaccggcaaccttgactccaaaaccaaaaccgaggtcatgacgatgatctgcgcattcgcccatgacttcaaccagaccatcgtgctggtcacacacgatccgcagatggcctcatacgccgaccgcattgtcaccttgctcgatggccgcatcaccagcgatcggctcaacaccgacctttcccgcccaactgttccgtccacgccgtccgcccaaagaacccaaggagttgaccgatgaagcacctctcccaccgcaccatcgccatcatcgtcgcgttgctctccacgctgtcactggcacttgccgtcatctcccttccgcaccaggcgtacgcggtcgacggcacagacggcacaagcggcacgaacagtacgtctcagggaagcgacggcgattccgcgccaatcgccggcccggtgccgaacatcatcgtcaccaacttcacctatggcggcgattccgtggccgccggcgccgatttcaacctcgacttcaccttccagaacatgggtcaggtggcggtgacgaacatggtcatcaccgtggacggcggcgagagcttcgccatcgcgggaggcacgaacacgttctacgtcgacgcgctgtggggcggttacgccatgacgcaaagcgtgccgatgcaggcgctcgcctccgcgaaaagcggtgcccagcccgtgaccgtgaacttccgatacgagtatgtggacgccagcgcccgctcctcaagccagtccgatgtcaagatttccgtgccgatcagtcagcctgaccggttcgaaatcagtgatcccgtagtgcccgaccaggtgatcgccggtcaggaaaacacggtcacgatggaatatgtgaacaagggcaaaggcgatatcgccaacgtcgaggccacgatggagggcgaaggtttcgatgccacgatgaaaacccagtacgtgggcaatgtggcttccggcgccaccggcacgattggttacgcctttacgccgcacgcgtcaggcgagctgaagaccacgctcaaagtcacgtacgaggattccgacgggcagaccaaaaccaaggaattcccgctcgccatacccgtaaccgatatgcagccggtggatgattccgacatggccgatccgaacatggaccagagcgccaatcagggattgccggtgctggtgtatgtggtcatcgtcgtgatcgccgtggtcattatcgtggtgattgtgctgctggtgcgtcgccggcgcaagcagaaggccaagaagaacgatattgatgaggactgggatgattggtccgaaggcaaggatgataagaccgataccggcgtgacggatggtgctgcggcagacaccgctcctatcacaccagtcaccccagcctcatcagtcgcaccagccggctcatcccacaaggcctgaaaggcccgaccatgcgattcggcgacatactgcggctctgcagacaaaacctatggcggcgtaaatcccgtacgattctgaccgtgctgggcgttatcgtcggctgctgctcgattgtgctcatggtctctttgggccagggcattaacgagcagaacgagaagatgctcaaatcgatgggcgatctgtccatcgtcaccgtgtacaccaacggttatgccggtccgatgggcggtggcggttcgtccgagatgggcgataccaagctcgacgacaaggccgtggaatccttccgcgcgatgagcggcgtatccggcgtgacgccgatgatgaacttcccttataacgtgacggccagagccggcgcgggcggccgttacctctacgattacgtgcagatcatgggcatcgacatgacccagttcgaccagatgggctacaagctcgtcggtggcgagaagccggtcaaaaaggatcaggtgcttgccggcgaatggttcgcctatggtttcatggacaccctgaagaacggcgaacaacgcaccagcacacgcggcggtcagtattcctcatgcacgtttgaccagaccaccggccagtgcgaggaagaccaggacgaggatccgttcttcgatccgctcgccacgcaaatcagtctgaccaccggcaccaattatcagggcgaccagtacaccatgaacatgtacggcggcggtggcggcacaggcggtgcgggtggcaacaccgcgggtcagtcggaaaacgtcaccctcgatgtgctggcttccggcattgtggcgggcgactacaacaagggctatgccacctccgacggtctggtcatggatttgcaggcgttgaaggaactggccgccaaagtcgatccagccgccgccaaaaaagccaccgcctatgatcaagtgctggtcaaggccgccgacctcaagtccgtgcccgaagtcgaatcacagatcaaagcgttgggctacgagacctcctcctatgaagacatgcgtaagtcgttggaagaacagtcgcgcgcgattcagctgattctgggcggtatcggtgcggtttcgctgttggttgcggccatcggcatcgccaacacaatggttatgtccgtaaccgagcgcacgcgcgagatcggcattatgaaggcgcttggctgctacgttcgtgacattcgcgtcatgtttcttgcggaggccggcgcgatcggattcttcggcggatcgatcggctgcgtgctgagcggactgatatcgctgggcatcaacgttgtcggcgcgttgtatgcgggcggcatgagcggcggcatgtctggcggtatggtcagcggtgccggcgggggctccggcgacggtaccggtggcggaacatctatctggaccatactctggcaggcgatagttggtggcgagaatgtgacccgttattcggtgattccgtggtggctgttcctgttcgccgtgctgttttccacgctgatcggcttgctattcggcttcggcccggccaataaagccgttaaaatcccggccctagacgccatcaaaaacaacgagtgatcgcctctgtcacctgctccaccgttagtccataacgttcgttcagttcgcccagcgacacgcggtcggtaaattccttggctgcgccgaagttcagcacacgaggattacggctgccgtccgagacatgatgattcgcatagtatgcggtcactttctcgccccagccgccttcaagctgcccgtcttcaagggtgatgacctgctggtggccatcacgcaacgactccagtacgtctgaatccagcgacgtgcactggcgcgggtcgataaccgttgccgtgatgccataatcgtcagacaatgcggcggccgtctgctccgccaacggatacgcattgcccagtccgatgatcgcgacttgcgagcccgtctgattgacccgccaatccagcatgtgacgcgcaccggcatgctgagccgttacgctaacggtcccgcggactgttgcggcagatatgcccccgctggcggagctggcggaggctggcagcgaagctgactgggggcggtcagcaatctgcccacccgtcaccggcagcagcgtcgcatcccgctccgccgccaaaatcgcctcgcccggcacccgaatcaccgccggaccagcaggggcgtccgccgaaccggccggcgcggtagcccatgccaaatcagccagatagtcgcgagccgaagtcggcaccagcatcgtaacccctggaatattggagaacatcgtcacgtcatatgcgccggaatgcgtattgtccgaaccggacaagccgcccagaaaatcaagtaccgtgactcgcgaacggttcaggctcatctcctggaagaactggtcgtaggcgcgctggaagaaggacgccgtggtggccaccaccggcgtgccacccgcccgtgcgatgccggcagcgtacgccacggcatgcgattcggtgatgcccgtgtctacataatgtgcgcccgcgcgctctcggaactcatgggtgatgccgttcgagcccggcgtggcgggggagatgaccacgagtcctggctcggcggcgaaacgcggttcgagcgcggccatcgccattttgccgtaatgcttgcgcggatcgtccggcttgccgattgcggcatccggattctgccaatgcgaggcctcgcactggccttcatgtggttcatggtcggacaggttgcagtgatccgaatgccacggttcgctgtgcagcacgttgctcgtggggcgcacgccggtgtcggagactgccggatccagctcatggacgttaccggccgaggccgaggatgcgccggccacgtgaccggcgccgtcatatcccgcgcccttcagcgtatgaatatggaccaccaccggatgatcgatatcgcgcacttcctcgaaagctgcgaccagcgcggaaacatcgttgccggcctccacataccgataatccaagccaaacgcgttgaacagattcggctgggcggtgccaccggacgcgcgcaggcgggcgagcggaccgtacatgccaccgaaatcgccggcaatcgacatctcattgtcgttgaacacaatgatgagattgccgccctgctcagccgcgttgttcagtccttcaaacgccacgcccgaactcagcgaaccatcgccgatcacggcgatcacattgccgatgccgctgttcgggccttccatatcgcgggttttcgccaaaccgcaagccaatgaaatcgaggtaccggtgtgaccgagcacgaactggtcgtgtttgctttcgtccggattggtgaagccggtcacctcgctgaaacggtccgggtccagataggcggcggcgcggcccgtgagcattttatgcacgtagctttggtgggatacatcgaacacgatgcggtcacgcggcgaatcgaatacgcggtgcagggccaccgtggcctccaccatgcccagattggagccgatatgaccgccgtgttggtggccatatgccagcagcgtggcgcgaatctcgcggcacagttcggcgagctcgtcgggggcaagggccttgacatcggccgggctggcaatgcggctcagcagatgggagtcgtcgccatgggaaggggtaatgctcggggggatgtcgtgaaggcgcacggccccctcggcggcaccggagacggcgaaggaatcgcttgaatcaaatccgtttcctgacgcgttgcgcataccctcgaatctcccttcgctagtctttccgaagttgaatgctaacgcccggcattgtccgaggtccacatgacgaatcaatgcccccaacatctccgtaaatgggtgattcgttcgctgcgcgatgtgggacaatgaatgcggtaattccttttgataccaaggagcgcgcaatgaaggccgtatacgcatccaccgtcaaccatgacgatccgcttgccgcgttggcggtgggcgagcagcccgaaccccaggcccgcccgttctggtcgaccgtttcggtgcgcgcggtgaccgtaaaccatcacgacgtctggtcgctacagggtgtgggtctcgccgccgaacagacgccgatgatcctgggcaccgatgccgtgggcgttctggacgaggacatccccggcaagcatgggctcaaggctggcagcgaagtggtgctgtacacgttcgtcggcaccgatggggcgggcgtggccccgggcgagcgccgtacgatcctctccgagaaataccccggcacgatggccgagaagacttccgtgccgtccgccaacgtgttcgccaagcccgcaaacctcaccacggccgaggcggccgcactcggcaccagctggctgaccgcctactcgctgctgttcgaggccgccggcatcaagccgggcgactccgtgctcatccagggcgcgggcggcggcgtgtccactgcggccatccaactcgcccatgccgccggtctggaggtgttcgtcacctcgcgtgacgcggacaagcgctccaaggcgctgaaacttggcgcgaacgccgcgctggagaccggtgcgcggttgccgcgcaaggtcgatgcggtgatcgagtccgtgggggcggccacatggggccattcggtgcggtcggtgcgtcccggcggcaccatcgccatctgcggcgccaccaccggcgaccagcccggtgccgaactgacccggttgttcttccaggacattcgcgtgcagggctgcaccatgggttcgcgcgaggatttcgcacgattgctgcgcttcgtggagcacgccgacctgcatccggtgatcgattccgtggtcgacggattggactgcgcccccgaggcgttcgccaggatgatcgccggcgacatgttcggcaagatcgttattgagctgtaagcctcacagaattatgtattgagaacgattcgctgcgtggcttaactccgctatcaggagtacagtgggccttattctcaataactagggagtaaatgataatggcaaatgaatccaagcccgaagtcgcagtggtcatgggatcctccagcgactgggagaccatgaagcgcgcctgcgatattctcgaccagttcggcgtcgcctaccacaagcaggtcatctccgcgcaccgcacgcccgagctcatggccgagttcgcgcacaacgcccgcgccaatggcctgaaggtcattatcgccggtgccggcggtgccgcccacctgccgggcatgatcgccgcgcagaccacactgcccgtaatcggcgtgcccgtgcgctcccacgccctgtccggctgggattcgctgctgtccatcgtgcagatgcccggcggcattccggtggccaccaccgccgtcggcaactccggtgccaccaacgccggcctgctcgccgtgcagatgctctccgccttcgagcccgaactggccgacaagcttgaggattaccgtaacgaactgaaagaaaaggtagctgaatccaatgcccagcttgtctgaggaaacaggcggtcgtgtttcgatgctgatgccgggatcgaccatcggcatcatcggcggcggccagctcggccgcatgatggctttgtccgcccgctacatgggcttccgcgtcggcgtgcttgacccgacgccgaactgcccgaccggtcaggtggccgacttccagatcaccgccgaatacgatgacagaaccgccatccacgatctggccgtgcagtccgacgtgctcacctacgagttcgagaacgtggacgccgacgccatcgacgaggtgcgaggcatcaccgccaccccgcagggcaccgacctgctgcgcgtgacccagcaccgcgtgcatgagaagcggttcatcaacgaccacggcaccgccaccgcaccgtggcgcgccgtcaacaacttcgatgagcttgacgccgcattggatgatattcattatccggccgtgctgaagaccgtgtccggcggctacgacggccacggtcagctcgtgctgcgttccgacgccgacttggagaagatccgctcccgctccgaccgtggtggtggcttcccgccgagcatcctggaaggcttcgtcgacttcgcattcgaggcttcgattctggtctccggcaacggcaaggacttcgtcaccttcccgattgtgcgtaacgagcaccgcaacaacatcctgcatatgaccatcgcccccgccgaggtgtccgaacatgtggctcgcgaagcgcatgaactggcgattcgcctggccaagggcttcgaactggctggcacgctggccatcgaactgttcatcaccaaggacgatcaggtcatcgtcaacgagctcgccccgcgcccgcacaactccggccactacaccatcgaggcctgctcgatggaccagttcgacgcccacatccgcggcatcgccggctggcctctgcccaagcccaagctgctctcgccggccgtgatggtcaacgtacttggccagcatgtggaaccgacgcgcgcgctgatcgccacccacccggagtggaatgtgcacgactacggcaaggccgaagtgcgccacgaccgcaagatgggccacatcaccgtgctcaccgacgacccggccaagacggtcgctgaccttgaggccaccggctgctgggacgacctgaaaaagaaggcgtgaccttaccgatggttgaacatatcgaacgccagaccaagcagaaggacgcgattcgcgccgccttggccgactgcgaggagttcatctccgctcaggacctgcaccgcaggctggaggacgaaggctcgaaaatcggcttggccaccgtataccgccagctcaacgccttggccgatgccggtgccgccgacacgatccgcctggacggccagcagctgttccgcctatgcggcgacgacggacatcaccaccacttggtgtgcaggcggtgcggcaaaaccgtggaaatcgacccgcccagcgaggcttggctgcgcaaagtggccgacggccacggcttcaccgttgaatcccacaccttggaggtcttcggactgtgctctgattgccaaaaggagcagaaagcgcagaaggctcagaaagcagtgagcgaataacaaatgggatcggcttcaaagccgatcccatttgttattccgctgctattccactgacttcagcgcgccgagcatgctgtttctttgaggtcgtgttctgcacgatgcctttcacgccgtccagcttcatgagcttggcgctgcgcgactccacattggaggtctcgtggttcttgagccgcaccatataggcgttcgactggtgctgctcgccgaacacgtgcttatagccacccgaagtcatgaacatgaaatgcccgaagtagggaagccggcttgtcacgcagcttgcgtttggccgctacccaggccggtaccacggtgctcgcccaggccagcaggaacgccgccagggtgatggcagggtggaacgccagcatgacacgccgatgtaaatgcaaatgataataattctcaatatatgttattctgtcgtgttggtggctgggcgatgatgcagcaacagcagcatcgcccagccgttcggctaattagagaggaaaacccaatcatgtccatcatgtccaacgccaagcgcgcgctcgccatcgcggccgccgcggcgaccctgctctcgatggccgcctgcggttccagcaacgccgccagcggcaagtccgattccagcggcgccgcgtcttccggcaagatcgaggtcgtcgcctccatcaaccagtggggttccgtggccgaagacctcggcggcagcaacgtcgaagtcaccaacatcatgaccaagaccaacgtcgaggcgcacgattacgagcccaccagccaggatgtcgccaagttcggcaccgccaaggtagccgtagtcaacggcgccgattacgacccgtgggccaccaaggccgcccagccgaccaaggccacgctggtcaccgccgccgaaaccgccggcatcaaggaaggcgacaacccgcacgtctggttctccgccaaggtgcgttccaacaccgccgacgccatcaccgccgcctaccagaaggccgacccgagccacaaggacgactacgccaagctcaacaaagaatggcacgccaaggaagaccagcttgagtccaagatcaaggagacttccgccaagaccgagggcctgccgtacgccgccaccgaatccgtggcctggtacctggccgacgacctcaagatgaccgacgccactccgaagggctacgcccaggcctccgccaacgagagcgagccgaccccggccgacatcaaggacttccaggacaccctgaaggccggcttcatcaagatgttcgtcttcaacagccaggaagcaaactccactattgaccagatcaccggtgccgccaaggacgccaacgtgccgatcgtggagctcgccgagcagatgccgaagcagtacaccaacctgctcgactggatgagcgcactggtcgaccagttcgccgccgccgtgaagtaatgcggcagtagccgtcaatccgcaacagcgataaggggaataatcaagtcagatagcgaggcgttgtctaggggagaacagaacacttcgctatcagggataggctccttatatatcagggtgcttcggggatgtcccgaggcaccctttgcgttagggtgaatagttaggaaacggtaagaaaaatagtggaactatggattttccaaggttcagcggcaacaatatgcccttgaaaagtcacatacggaaacaggcgaatgagcgagaacactagtaataccaccacagtgaaaccccatttcaagctttgggccaaaaaggtcgaagccaatgaagtcacgccccaacacccccacaagcccttccccggctgggtgtacggcgtgctcttcgttatcttcgacatcattgtcgtgacggcgctcgaagtgggcgtttcgtccagctccacccgtgtgcagctgtccagtccgatcgtcggattcggcttcgtgagcaagatgtggaccgacggcaatttcgtattcgtgctcaacgtgatacttgtcgcgttgctgtacctcatgttgctgatgctgttcaaccggttctggacggcaagcatcgtgattctcgcggtcggaatcatcgtggccgccatcgaacatttcaaggtcgagatccgttacgaggccattctgcccgccgatctaggcttccttggctcgaacaccggcaacatgctcaccttcattccggccggtgcgcatgtgaccatcctcgtggcactcggcgcgttcgccgtactgctcgcgctgattctggtgctgcgtcatttcgatgggcgcaaaggtcgcatgattcgtacggataacctgagcctgaacctcacctcccgtctgattcttctgctgctgccgattctggtgttcgcgttgtactgcattcatgtgagcaccaccgattcgctggccaacaagttctcccgcgccttgggagacacgccatccatgtgggattccgtgtatgacgcgcagcgcaatggtccgctcgtggccttcacccgccagctcaacccgaagatcatggacaagccgagcaactactccgaggagaccatgaagaaggtcgccgctcgctatcagaaggaagcggagacaatcaacgcctcccgcaccaacaacctcactgattcgacagtggtgtacgtgttgtccgaatccttctctgacccgagccgcgtgccgggactgaagaccaataaggattcgatgcccaacatccgcaagatcaaggcgggcaccacctccggcctgatgctctcctccggctacggcggaggtacggccaatctcgaatacatgggactttccggcctgagcatggccaatttcgagtcctccctgtccagcccgtaccagcagctggtcccgagccagcattggactcccaccatcaaccagctgtggggcgcgcccgtcaactcgctcggctaccacccgtacgaatccagcatgtactcgcgtgccacgaactacaagaagttcggcttctcgcacttctacacgttgaccggtccggacgtgatcaagtatcaggacaagatcgacgagtcgccgtacgtctctgataagtcttcctatgattctgcgttggaaggcatcaagtccggcaagacgaacaagttcattcagatcattaccatgcagaatcacatgccctaccacgagtggtatgagaataacgactacaccgccgaatccaccacgggtacgccgctgggtgatgatgaacagcagtcgattgagacctatcaaaagggtgtggagattaccgatcaggccactcaggagttcctgaatgaactggatgcgctggataagcccgtcaccgtggtgttctatggcgaccacttgccgggcatctactcgtccgccagcgaggatgacaacaactccttggccctgcacctgaccgattacttcatctggtcgaataaggcttccagctcccaaggcaataaggcaagcgatgcagcctactcctcgccgaacttcttcgtggcgcaggccgccgatcacatgaacgccaaggtcagcccgtatctggcgttcctgaccgaaatgcattccaagatcgccgccatggaaccgcctgtggtcaacaagatccaaggctgggatcgtatccccgaaggccagaacatctatcttgatcagaacggcaacccgatgtccaccgatgacttcgacaaggaaaccaagcagttgcttgccgactacaagctcatccaatacgacatcaccgccggcaaaaactacctcaaagacacggactttatgacgctgccgtaaagcagacagcctagtaggctgtctgtaggcagcgtgcgagccgacagacgagccagcaaggcgcggggcgtagcccgtccaaaattgcagtagcgctgccgtaaagcagggggtgctttcatgacgaaccagactttcgaacaactgaagaagacttacgaatccggtcgtacccggccgctggcatggcgccgcgcgcagctgaacgcactacgccgtctggttacggagaaccgtgatgcctttgtctcctcggctatggctgacttgggcaagcccgcggctgaaaccgtgctcatggaactgaacctggtggctggcgaagcacagttcgtgcgcaatcgtctgagcctttggaccgcccggcatcccaaagcgatgcattggatgttgcagccggctgccggatggacaattgccgagcccaaaggcgtggtgctcatcatttcaccgtggaattatccggtgctgctggccttggaaccaatggctgatgcgctcgctgccggtaacgccgtctgcttgaaaccgtccgagctttcaccgaatacgtccaagctccttgctgagttggtgccgcaataccttgactccgaggccgtgcgcgtggtcgaaggcgggcccaaggaaaccggcgaactgctgaaatgcccgttcaaccacatcttctataccggtggcggccacgtcggcaaaatcgtcatgcgcgcggcggccgagcatctgacgccggtcacgctggaactcggcggcaagtcgccatgctttgtggatcgcactgcggacatcaatgtggctgcacgccgcattgcgtggggcaaattcaccaatgccgggcagacttgcgtggcacccgactatgtgctcgccacgccggatgtggccgaggctctggccgagcgcatcgccgtagccatcaccgaattctatggcgaagatccgaaggcctcgcctgattttggtcgtattatcaacgatcgtcattttgaacgactgtgcaagctattgccggtcggcaccgtgccgcctgaggagccgagctcgccgctggtgcaggtggcatcggcggtaggcgcggccatggatatggttgggcggcgcttcaatgccgtgactactgggcgcggtggcgcgggggagatggccggcagcgcgaacaatgcggcgaagccgacggccggttcgaatatggcagccgctgatgatggtgcgactgcctcggccgctgttgagccgagcgagattcacaaggtgcccggcgtgttcgacctggccggtcgaatcgtttgcggcggcaaggtcgatcgtgccgcccggtatatcgcgcctaccgtgctgtacggtacgtcgccagatgcgccagtaatgaaggaggagattttcgggccgattctgccgattctggtggtcgaggatgccgagtccgcaatccgattcatcaacaagcggtcccggccgttggctgcatatgtgttctcgcgcgatcacgaggttcggctgactttcgaacgtcagaccagctccggagccttgggatattcgctgccgttgggccatctgctgtccagccggttgccgttcggtggcgtgggcgcgtccggcatcggcacctaccacggcaaagcaggcttcctcaccttcagccacgtcaaaaccgtggttaccaagccgcagttccccgacactctgcgcctcgtgtacccgcccttcaatgaagccaaggccaaactgttcgacatcatcgccaaattcagctagcgtgatatcgctcgctgatattgggtgatggcgttgtcatagtgacgttcgctgtcccggtaattacgtcaatcgattgattcgtgtaccgggccagatttttctgtcctagtatttgatttcgggtcatttttgcttaccgggacaaaactgacgccggaagtatcgtccgcgtattacgaaaatggcggaatagtgcggtttcgtatggaagggaatttcaaatattcctatattcgaggggttcagctgtcctggtttgcgaaaaagagccgaaatcggctaccgggacagaaaaatctggcccggtagccacgtcaatcgattgacatgtctgccaggccaaaaatatgcagcagatgcgccgcttctgttacttcagggctttgaagccgatgtcgtggcggtaaaacagtccgcgcagctcgagcttgtcgatgattgcgtagaccttgtcctgggcggacttgatgtccggagcggaggtttcgacgagcagcacgcggccagagttggccacaaggttaccgtgctcgtcagaggcgacgccggcgtagtagacgtgcgaatcctcgtcgacttcgatttcgggcacacgggcacccttgatgacgttctccgggtagccgttggaggcgatgaccacgccgagggtggcgttggactcatcccaggtgaattcgggggtttcgccgtcgagaatggcggagatgccggcaccgaggtcggaggtgagcttcgggagcacgacttcggtttccgggtcgccgaagcgggcgttgaattcgatgaccttcgggccgtcggcggtggcgatcagaccggcgtacaggataccggtgaatggcgtaccttcctcggccatgccttcgacggtggggcgcacgattttctcgatggcctcgtcgaccacggactgcggaatctgcggcaccgggctgtaggcacccatgccaccggtgttcggaccctcgtcgccatcgtgggcgcgcttgtgatcctgggagatgggcatcggccagaaatcggtgccgttgacaaagctcatcagggagaattcctggccgtccaggaagtcctcgataacgaccttggcaccggcggagccgaagcgatggtcgatgaagatgtcttcgagtgcgcgctgggcggtgtgctcgtccatggccacggtcacgcccttgcctgccgccagaccgtcggccttgatgacaatcggggcaccgtgctcgtgtacgtagtcctgcgccatctcgagatcgctgaaggtcttgtattgggcggtcgggatgttgtgtcggtccatgagctgcttggcgaagtccttggagccttcaatctgggcggcggccttggacgggccgaacgccttgatgccggcggcggcgaaatcgtccacgatgccttcgatcagcgggacttccgggcctacgaacacccagtcataaccattgttcttcacgaattcgataagtgcggcgtgattcgactggctcagctgcgtggtgtggatgccgtccttgagcatgcccgggttgccgggagccacggtgacttcgtcgatgctcggtgccttgagcagcgtgtaggcaatggtgtgctcgcgcgcgccggagccgataaccaatactttctgacccatgttgttcctttcctgcggaaagcgagttacttcagtacgatttgcgtgccggtggtgtcggctgcgatctggccgagcacgtaggcgggctcgttgttgtcggcgagcagcttcagcgcctcgtccttgcgagcgaggtcgatggccagcaccatgccgatgcccatgttgaagatgttgtacatctccttatgatcgatgttgccagccttctccagcacgtcgaagatcgggagcacgggccaggtgccgagctcgatttcggcggccaagccgtccggaatcatgcgcgggatgttctcgatgaagccgccgccggtgatgtgggccacgcctttgaccacgcccgccttgaacaggggagagagggccttgacgtagatcttggtgggggtgagcagcacgtcgccgagcttttcgccgcccagctcgtcgagttcggtgtccacggtgtagccggcctgctcgaacagggccttgcgcaccagggagaagccattggagtgtacgccggtggagggcaggccgatgagcacgtcgccttcagcgatggtggaaccgtccacgatggcggacttttcggcaacgccgaccgagaatccggcgagatcgtattcgtcttcgtcgtacatgcccggcatttcggcggtttcgccgccgaccagcgcggaaccggcctgtacacagccgtcggccacaccggccacgacctgctcaagcagtgccgggtcgttcttgccgcaggcgatgtagtcaaggaagaacaacggctcggcgccctgggcggcgatgtcgttgacgcacatggccacgcagtcgatgccgatggtgtcgtgcttattggccagcttggcgaccatgagcttggtgcccacgccgtcggtgccggagatgagaaccggctccttgtagcccaaggaggccagatcgaacaggccgccgaagccgccgatgccgccgaccacgccggggcggttcgtgcgggccacgtgcgacttgatgcgcttgacgacttcgtacccggcttcgacgctcacgccggcgttctcatatgcttttggcatttggttggcctttctacttattttggctcccctctggaggggagctgtcggcaaagccgactgaggggaggcaagcgcctctggttcaaagaattgttattgagtggattggtggtgagctattcggcatccggctgcacggtgttgtactcgttgccgatgtacttgctcttgtacagcgcgaattcaggcagacgcacacggtcctcgggcgtgagggacttcaggaagtcggcctcgtagtcgtcgagcgcagtggggtagtcgccgttgaagtaggcgacgcacaggccaccgtatggggcgtcggcgttcagtccgatggattcgaccagaccgtcgagcgaaaggtaggccaaggaatccgcgccgatgtattcacggatttcctccacgctcatcttggctgcgatgagttccttggtggtggagatatcaatgccatagaagcaggggtacttcagcggcggggagctgatgcgcatatgcacttcagcggcgccggcttccttgagcagctgcacgatgcgcttggacgtggtgccgcgcacgatggaatcatcgatgacgataacgcgcttgcctttaaccacgctgcgcacagcagagagcttcatacgcacaccctgctcgcgcagttcttgcgtgggctgaatgaaggtgcgggccacatactggtttttgattagacccatttcgttgggcaggcctgctgcttccgcatagccggatgcggcggacaatgaggagttcggcacgccgataaccatatcggcctccaccggggattcggcggcgagacgtgcgcccatgcgcttgcgggcggagtgcacgttgacgccatagatatcggaatccgggcgggcgaagtagatgtactccatcgagcagatggccagctgcgtgttgttggtgtactgcacgatcttgtagccgtgatcgttgaccaccacgatttcacccgggcgaatgttgcgcaccagctcggcgccgacgacatccagtgcgcaggtttcggaggcgagcacgtaggcgccgttcttcatcttgccgagggagagcgggcggaagccgttcgggtcgagtgcgccgatcatggcgtcttcggtcatcagcaggtaggcgaaaccgccatgcaccgtgttgagcgcttccttgagcttgtccataaaggtgcgctgcatcgaacggcgaatcaagtgcatcagcacttcggtgtcggagttcgaatggaagatggcgccttcgtcttcaagcttgcggcgcagtgacgggcagttcgtcaggttgccgttatggcacagagccacgtcgccgtcatggaagcggaagatgaacggctggatgttgtctgtggtgcccgagccggccgttgcgtaacgcacgtggccgatggcgcaattgcccttcagtcgttcgatttcgcgctcatcgccgaacacctgggtgagcaggccgagtccgcgatgaccgatgagatgaccgttatcgttggagacgatgccggcaccttcctgaccgcgatgctgcagcgcgtgcaggccaaaataggtgagtcgtgaggcgtcggggtggccccatacgccgaagatgccacattcctcgtgaatgtcttcgagttcagccgacaagccaaagctcctttttcaaacaggggattaactatctatcaaccctaccaatcggcggctacatcgcgtgttgtggggtggtggaacttgttggggtttgcggacgcggtttaagcaccagatcagtcaagtatgaatagtggcttaggattttggcctttcgctgtttgtggtgggtggttgtggtgtggggtgatgccgacgggtaggttggaagcatggatacctcttacctgttcaccgccgcattacctggtgctccactttgtgctcaagcgtgataccgaattgtcggtgtgacgtgatcggttgactttcgtcaacgcaatttgaaaggctccgacggtattatccgtcggagcctttcgtcgtatgaatccggtgcttgtttttcggcttcgtctcagtgcctgaaatggctgaagaactcgatggtctcgggatcctgcgactcgtccatcacctcagcgggtgtgccgttctcggcgatgacgccgtgacggagcagtacgatgcggtcggccgcttcgtgggcgaagctcatttcgtgcgtggccatgaggattgtggtgccttgggcctttaactcggcaaccatgttgagcacttcgccgaccagcatcggatcaagagcggatgtgatctcgtcaagcagcagcagttccgggtcggtcatcagtgcgcgcgcaatcgccacgcgctgctgctggccgccagagagctgatcggggtaggcactggctttatcgcgcatgccgatgcgttcaagcagttccatagcgcgggtttcggcgcgatccttgctccagtggtgaaccttgattgcggcaagggtcacgttcctgagcaccgacatgtgggggaagaggttgaactgctggaacaccacgccgatacgtgcgcgaatcttgtcctggtcggcacgcgggtcggtgatatcggtattgcccagccaaatctggccgtcatcgacctgttcaagcaggttgacgcatttcatcaatgtggatttgcctgaaccggaaggccccagcaaagccaccacctcatgttggtgaatgtcaaaggaaatgccacgcagcacctgcgtgtttccaaaggatttgcgcacgtcatcaagacgcagcaccgtcttgttgctcacgggggagtcactcgcctcggtggtgatattggtcatttcgctcataccgttcctccgctgagttcgcgcttacgcagacgttccgtgtaccagtcgttcagcaggatgaacggcacgctcatcaggatgaacagcaggctggcgaccacatacggcgtgaagttgtaggtgctggccacgtcgatctgtgcggcgcgcacggcatccaccgcacccagcacggaaatcaggccgacgtccttttgcatggagatgaagtcattcatcagtgcgggcgccactttgcgcaatgcctgaggaatgacgatcagtcgggtcgtctggccggaggtcaggcccaacgagcgggccgaggctcgctgagaaggatgtacgtcgttaaaaccggcacgcagcacctcggagacgtaggcgctgtatcccattaccactgcaatggtgccgagtaccgagggatcgatacggccgaacaagcctaggccgggaatgccgaaaccgattagatacagcacgacgataataggcacgccgcgcatcacagtcgtgtagatcaatgccaggatacgcagcgggaacagaataggggagcggctggtgcgcaccagcgcgatcagcgtgctcagaatcgccacgccgaccactgcgacgagcagaacgcggatgttgagccataggccgtcaagcacatggggaaacgatttgacgaagtattcgccggagaagaaggtctccttgactcgtggccagccgggggagagcttcaagccgatgacgatgaccaccacgaacacaatggtgctgatcagactggtaatcgtcgattgaatttgctgatgaacacgatattggcgtcgttcgagctcgacctgacttacctcgtgtccgtcaggggcattgtgctgcctggtttcggttggtgctgcggtcatgtgatgaatgtcgctcgcttcctgaatgccgggatggccgggtgccacaggaaaattcccgcagcgcccggccaaggtgttgtgaccttatgatgtaagcctacttcacttacttcttcagttcggtcaggtcggtggtgtactcggccagccacttgtcctgaagcttcttgatggtgccgtcggcgttcaggtcatccactgccttggtcacggctgcagtcagcttggaatccttcggcagcacgatgcccatgccgctcttgtcttcggagtcaggcagacggccgagcaccttggcgtccttgacctgctcggactgcaccatgtacacgcattccacggtgctggtgaccagtgcgtcgatctgaccggcgtcaagtgcctgagccagtgcggcatcatcattgaacgtctggatgtcgtccttgatgttcgccttggcgtagtcgtaggcaagggtgccgaccatgacgcccacggtcgcatccttcagatcggataccttggtggcgttggcgaacttgctgtctttcttgaccacgacggactggctgtcgttgtagtagctggacgagaagtcaacggccttcttgcgctcgtcggtgatgccgaactgctggatgttgaaatcccagtccttggcgccgggagcgatggcggtgtcgaatgcggtgcgggtccacaccacgtcgctcttcttgaaaccgagcttgtcggccactgcgtaggcgacggccgcctcgtagccctcaccgctttccggcttgtcgttcataacccacggctcgtaggccggctgtccggtggcgatggtcagcttgcccggcttgtacgtctgctgggtgatgtcgtccgaatcggtggaattggatgcggtggactggccggaaccgcaggctgcggtgaacgacagagccaggatgctgacggtggccgcaatggtacggacgatgtgtcgcttattgaacatgggtttcctctcctcaagtgttcgtcatgcacacggttcaaaccgtgcttgatgcattcgcgccaattgtatggctattgggttacaaaacatcgatattttcggatgctggctatcgccattgcttatggccgactagagccgcgcaatctggcgcgtaagcggacggatatctcatattggcgcagagcgaaatggcgttcactgttcgagtgtgaagccgtcgaatacgaatcccggactgaccacacaggagaccagcgcatcgccctggcctggcactgtgcgctgccagacgccagccggtacgaccgcatgtcccgatacggttacgtcggcctgatcggtggtgatgccggaacccaaggtgattacggttcgcttggattcgtcggattccggagtctcgtcgctgccgccgagctccagtttgaccgatgccgggccatgccacagccagacctcatccgcatcgaccttatgccaggcgctggcatctccctcgggcagcaggaagtaaatcagtgacgatagcggtcggcttgaggcctcatccgtgtgcggggattgccagtcacgcgtgtaccagccgccttcggggtgggtttccagtccaaggcgttccactatggaccgggcgtatggactcatgtcttgcaaagcgacgctcataatgagatctcctgttcttggcgggtttgctggtttttggcttcttgatatcaggtcaggtcagcggtgtcaccaggcgttgttgtaggcttcgcgcccggatatcaccgtggctcggttcgtgcctgcgccgtgcctcaccagtgtttccagcgtttcttcgatgccggccggagatgatgtgtcgacggggatgtcgaagaacgcgaaatcagccaatgcgcccgcgttgatttgtccaatgcggttgcggcccacgtgcatgcccatggaggcggcgccgcccagcgtcatcatacgaatcaggcgatgtgtcagatcgtcgctggcatagccttgttcgcgggccaggtcgtaaagcatcgacacatcatcaagcagatcgagggtcggcgtgctggagagcgaatcggtgcccacgcttaccagattgccttcctcgaggtattcgcgcaccggtgcatctttgccggtgttggtaatgcgattcgatcgggggcacaaggccacgcccacgccgcgctgacgtagaatacgccgatcctcgccattggcccacacgccgtgtgcaatgtgcacatccggtccaagcgagccaagctgatcgacgaactggatggcggaggcgcctttgcccacttccttgagctgccggtagctttcccaatcgtggtcactccagtcggccgccgaataagtggtgagcaccggcggataagtgccggcctcgagcggggtctccgccagatggatatgcagtcgcatgttcagctgacgagcaatgtctggaagatcaacgaacggttcggactccagcgtatacggagcatgcgggctgatgccgaggtttggcagctgctcctcgttcatccggcgcaactgccggatgagctcagtgcggcccttttccatccattcggcgttgtgccagcccattacctcccaataagcgatgccgtgcatgccctgcgaagccagcgcgccggcggcgtccaaatcggtgacgatgtctgcggcggccgtcgttcccgattcgaccatctggcgagcgccgtcctcggcccactgcttccatggctgggtcttctgcgcctcggcgtacacctcgttgaatgccagttcccaggcgcggaaccgatcgtaggtgccttgcccgacctgcaccatgccgctgtactgcagatgagtgtgcgcgttgatcaatccgggggtgagcaccccatcccaatgccgttcatggatggtgccgtgagccgtcatttcctgcttcagtgccttcagcacccagcggcgtttacctacatgaaccacgcggtcgccatgtatggcaactgcgccatcgatgatgacggggcccgtcacggggatgatgagtttggcggaatacagtgtcacatcatcgataagctcggtatcgacggtcggccaggtgttgtcggtcatattctcctcgctgcgttgtgttcggtgccgtgtctatggctatcggtcggcgttctctcggtcgttttccgcgaatctggtcagtcgccaattgtagccgttgtcctccacggcatggctggctcggtatccgcgcgccttgagcgcgctggcggcgatgcgctggtcggtcgctgcgtcaagtctgataagcgtgtgatccagtgtgcctcgatgttccagaagatatgcgacggcgctggcctgtacggcgaagctcagatccatgatctcgattggattgccgcctcccaccgtgtagttcacgccatcgccgtcggcgattagcgtgagcgttggtccgtcgggaacattgagttgcacggtgtccctgttgacctgtggggtgaagtcgcttacctcgtccaaggcgatttcgttggcgatgccgccgatcactgcgagcgccgcgccctcgtgcattgcgcgcatgtgctcaagtgtgaccgtatgtctcacgccagtggcggacaccaccatatccgcgcaagggagtgcctcgtcaatgtcttgtgcggcgaagccgtcgaacaccgctttgagtgaagccactggatcgatatcgcagatggtgacttcggcgccaagcgcgcgaatgcgccgtgcgaagccttggccgaccgggccgtagccgatgacggtgacgttcttaccgtcgaatgcatgctcgccgagaatgcgctgcatggtggtcacgcatgtctccccagtgccgtgggcgttgtcgaatccggttttcagcacactgtcgttaacggctacgaccgggtaggtgagggctcccgcttcctgcatctgctggaacgcgcgtacgccgctggtcgtttcctcggccactccaatgaggttcgccgtgagttcggggcgttcgagcgaagcgagacgggcgaagctggcaccatcgtcgatgatgatgtccggctgtatttcgtccagcaggtgcagggccgcctcgtgcgcctgttccgcggtccagtctcggctagattcgaccgtgattccttcccggcgcagctgttccgccactcggggatccgtggaatccgggccgcaatatacgccgacgattgcgccggcggccttaagcttgcgcagcagaatcgcggtctttggctccagtatcagacagacggcaatacgaatgcctgagaaatcgacgcgagtggtgaggctatccatggtgtcgcgtaataccggcatgtgctgttccgcgtactccattgcctccagtccgcttgccttgcgcatatcggtgatggaatcgatgctttgtgtgccgtcgcataggaattcctcgttgtgctcgtcggtcatcgtggcatcttcgacggtcatgccccattgctgggcctgagacttgatttcggcatgcttctgtggctccggaatcgcgagtcgggctcctgccagtgatcgattcgtcttctgggatcgggctgccgcccacgctgcaaaatcgctgtctgctgtaatgcttttcttcatattccccatggtacgcatgcatgccgctgctccgccgctgcgcgtgtggcgtgggtgaagagcgtgcttgggcgcgttgcgtgcgtcgacttcggcagcttcgaacaggcatgttgcatcgaacaaatgttcgactgtgttgatatgctggtcgggccagcggtggtaaggaggtgatggcgatgggcagcggaacggtatcgacgcaacgcgagcatacctatattgccattgatctcaagtccttctatgcctcggtggagtgcgtggctcgtgggctcgacccgttgaccacgcatctggtggtggccgatgaaacccgcaccgataagacaatatgtttggcggtctcaccctcgctgaagaactatggcattcctggccgtgcgcggctgtttgaggtaaaacagcgcctgaatggagtcaacatcgagcgcgcggtccatgctcccggcggccgattaatcggggagtcctgcgatgcgtgcgacctggaacgctcgccggggctcaaagcctcgatggtcatcgccaagccgcgcatggcgcactatctggaaatcagcgggcaaatatatggcatctacctcaaatacgccgcacccgagcacatccatgtctactcgattgacgaggtgttcatcgacgccacgccatatctgcgctcgctgggtatggggccgcatgcgatggcgcgaaccatcgtgcgcgaaatcctcaccaaaaccggcatcaccgccactgccggcatcggctccaacatgtatctggccaaagtcgccatggatatcgtcgccaagcacatgcccgccgacaaggacggcgtgcgcgtggccgaactgaatgaaatgtcatatcgtcggctgctttgggatcatcgtccgctcaccgatttttggcgggttgggcgcggctatgccaagaagctcgagcatgccggactgatgaccatgggcgatatcgcccgatgctcggtgggtcgtgcttcggattactacaacgaagacctgctgtatcgcatgttcggtgtcaatgccgaactgctcatcgaccatgcgtggggctgggagccgtgcgaaatcgcggatatccgatcctatgagccaggtgcgcacagcattagcagtgggcaggtgctcaccggccccgccgactatgccacggcccggctgatcaccaaggagatggccgatgcgctggccctcgatctggtcgataaaagcgtgctgacgaaccgactgacgctcgccgtcggctatgacatcggcagtcttgattcgtcaaagctcgattcgtgcgctgattatgcgatgaaacgtgccgctgagcgagcagcgaaaagctatcaagggccggtgaccatcgaccgatttgggcgcaaggtgcccaagagcgcggtcgggtcgattggtttgggtgatttcacctcgtcgtcggcacgtattcgtgaggccatgacgatgttgtacgagcgcattgtggattcacgcttgcttgtgaggcggttgaccgtcatcgccgatgatgtggccactccggaggagctggccgccggcaaacgctatgaacagctcgacttgttcggtgatgacgaggcccaatcgtatggatccgattccaccagcgaaaaagatggagagcatgatatccagcgtgcgctgctggatgtgaaacgtaaattcggccgcaacgccgtcatcaaagccatggatatggaagacggcgccaccggtcaggaccgcaaccgtcagatcggaggccatcgcgcatgaccctgcaagagacccatgcatacgacgacatcatcaacctgccacaccatcagtcgcgcaagcatccgcacatgtcccgccaccagcgggccgcgcagttcatgccgttcgcggccctgaccggctacaaccaagtcatcgagcaaacagcaaaaaacgccgaaaccgccatcgctcaggccgaagcccaaggcgataccgatttcggcgcttgacaatcgctcccgttggaggaagtctcagattcgtcagcctacgtgacgttcgaagcggtggaagccggtgatcttgtcgatttcggccatcgcgtcagccggaatcacaaagcccgcggccttcatgttgttctccagttggctgggcttggaggcgccggcgatcacacagctgatctccgggtgctgcaggatccatgccatggaaagcaccggcaggttcgtgccgagctcgtcggccaccttgcgcagctgctcgaccttgtcgaggttctcatcggtcagcagatcgttgatctggtggtcggactgccaggtggcgcgcgagccggccggcagcggctggcccttgcggtacttgccggtcagcagaccctgcgcgagcggggagaacgtggtgatgccgatgccgagcttgcggcaggtgcccatgatctcatgctcgatgtaacggtcgtttaggttgtactgcggctgaaccacggtgatcgggtacaggttgtagcggtcgatgatgcgctgggcctcttcaaggcgagccgaaccccactcctcggaaacgccatagtacagcaccttgccttgggcgaccaggtcgctcatcgcgcgcaaggtctcggtaaggtcggtggtctcgtcaaaacggtggcagaagtacatgtccagataatcggtctgcatgttcttcagcgtctggtcgatgctctcgaaaatgtgcttgcgggacaggccgcggtcgttcacgccttcgccggtggggaagtagaccttgctggaaatgaccagttccttacgcgggtactgcttcagcgtcttgccgaggaagcgttcggccgcgccgccagaataggcgtccgcgcagtcgaagaagttgacgccggaatcgtaggcgagcttcacggtctccttggccacgtcctcagccgccgtgcccttgagatccgtgacccagctgcccagtgcgacctcgctgatcttcagtcccgacttgccaacgctgcgatacttcatgtgtgctccttgataatcaatcgtcaccgtcgtctcttcatggccggccgtgaacgctaacaattcttattgaaacagttcaaccccacttgaacgcaagttggcggctattgcgacacgccggtggtgacttcgcgggcgcaacgaatgaaatcatcaatgacgctccaccgatacgatgtggccggaacgccgaactgaatggcatatgcggtatccgggccgcaatccagcacgcgcaaagtacgcaaccgttcgccgtcaagcagcgctggcaggaaccgctccgggcataggcaggcacccatgccgtaatggcacagttccagcagagtcagtacgttatccgaacgggctgtgactttcggctcaaaaccggcacggcggaacagcagatcggcaatgcgtccgtcaatatcttgtgggctgcctaggagaaacgggcaatgctccagtgaggaaaggtcacctgcggcaatggcgcgctcgtccggcgcggttctgacggcatcgacttggccattcgccgcgccaccggtagcggccaaatccatccacagtgattgtgcgaggaccagcaccatgcgctcgttatagaaatccataagttcgatgccggccggtttcccggcgaagtccgccaccgccagatcaagatcgccgttcgccagccattgttgaatctgatcgttgcggccctcaatgagttcaacgatgatattcgggcagtcacgttgcatcgccttcacaatcggcggcatgatcgcccggctacgcgtgtaggcaacacccacgcgcagcacgccggcctgatcgccggcgatgtcgcgcatttcttggccaagtgcatcgcgatcgcggcggaatcgctgcgcatatcgcgcgaacaccgtgccggcataggtcaattcgagcggcacatggcgtacgaaaagcgtgcatccgagctcccgctctagggcggcgatgttcgcactcagcgtctgctgcgtgatccccaaccgtttcgccgccttgctgaagctatgttccgaggccacggcggcgaagtattcgatgctgagaaagttcatggcgatactcccgtgtgtatggcgtttgcgtggtgtgtgtatgacgtgtcgtggcgcgaatcaatgccacagtattaaacctgtaatagatatcagtttagtctgtatttctcctgttatcttaggtcatggctcgtgcgaatagcgttgatgtttgcgactgcgggtcatgagatggaatctgagatgaggctgtagccggaagaggagaggatcgcatgctggaagcgggcacgatgttgctgttctgtgcggtgctgtttgccagcgtcgccctcggctggtcgattattcccgcgctgttcgttggtgtgctgctgttcatggggtatgggctggttcgccggtgctcgttgcgcgcgatggcgagccgtgcggccggcagcgtacggtccgcggggaccgtggtggtggccttcgtgctcatcggcgtactgacctcgctgtggcgggccagcgggaccatcgccttcatcgtggcccattcgaccgcggtgattcacgccgccacggtgattccgctgtcgtttctactgtgctcggcgatgtcggtgctggtcgggtcgtcgttcgccagtgcggcgactatgggcaccatctgcatgtcgttgggattgtcgatgcaggcgaacccggtgatgctcggtggcgcgattcttgcgggcgtctatgtgggcgatcgttgttcgccggtttccaccagtgccttgctggtcaaacagcttacgcatacgaacctgttcaatactattgcccgcatgctgcgcacgggtgcggtgccgtttgtgctgagttgtgtggtatacgttgcggctgcggtggtggagtggctgtgcgcgagcggtggttccggatttggtgcggctagtgcggctgctacggctggctcggctggctcggctagagcggctgtttcaaccaacgcaagcagcataaccgatatcggcggattgttctcatcggccttcgatttgcattggcttaccctagttccagcattactggtcatcgtgttggcgttgctgcgtgtggatgttcggctgcttatgctcgccagcattgccgcctcggtcgcggtatgcgtgggcgtgcagcacatggaatgggcagaactgttgcggctgcttattttcggttaccatgcgcaaaatccgcaggtggccgcactcctggacggcggcggcatcctctccatgctcactgtgatggccactgtctgtatctcctccgcctacgccggcatttttgccgagacgcggatgcttgctcggctgcagcaggtcatcgagatgctcggtcatcgcatcggcgcatgtggtgccaccatgattaccgcgacttgcgcggcggcgctcgcctgcaaccaaaccctcaccatcatgctcactcaccagttgtgcggtgggctgtacggcgacgacgaatccgaacgctccgcacaagctatcgatttggaagacagtgccgtggtgatcgctccgctgattccttggtcgatcgccggtgccgtgccgcttgccaccatcaacgcgcccacactcagcctggccgccgcgaccttcctctacctgctgccgctctcgcggatgctcgcctcggctgtacgccgccgctcgggatttcggactcggcatcgatcccaaaatcaaaacccgggactcgccatcccacaccggcccaaacccatgctccacatgttcgctcatggtttccatcctaagtcgggcgattgagcgcacgaggcaatcaggccgagaactgtttgccgaattccgagaagagctgacggcgggcgaagacgagcaggccgagcagcaccagcagggagaccagcccgctgaccatcaccagtacatcccacggagcccagccgagcggaatgaacgtcagaggcatcagaccagcgacgatgtcgaacgccagatacttggcgtactcgtcaatggccttggcccgcagcacgataagcagcaccacgtcaaagaccagcgaaaccagacacgtgatcggtatgacgaacatggtgacgacatgattcatcgtcgccacaaaccagaccagcgcaatcgccagcatgatatagaaatatcgaaacatgaggcgaagcggccgcggcacgtgcagaatcgcactattgatgaacagcacgctgatgatcagcgcggccgccgatgcactggcaatcggtatcggccacgaaaacagatagctgaagaagccatgcagcagcaaaatcgcgccggttacaaacgtgatgatttccaccgccaaacgcctcggacgcagatagatctgctgcgcggggaatgcggcgggggaggcctcgccgcgcaattcgttctggcagagcgggcaacgggccatatcgccggtgaaatcgacggtgcaggcatcgcaatgcttcatgccgacgctcctttctccacatgcacgccagcgatgttcatacggccgctgatgccctgcgcggcgagaatccgacacaggttcttgatgacgttcagatcatggtagatggtggagatgccgatgctcaggtcgtcgccgaacgagcagaccgtgaaattcaggctggccggtgtggtgaggaagctcaccgaacgtacatggcgcgcgagtcgttcgtccaaggtgactcggccaaggttcgagacggtggtcgtggtctcgcggtcggcgatgaaccgggccagctccagcacccagtccttggcaggggagggcgcaagacgcagcaccggattcttttccagcgcaatcatgcggttcatatgcgattcgacgcgctcgcgactggtggcatggccgagctgctcctgcacatggcgggcgatgtcggccaacggctcatcggtcagcaatccacccataccgttgccgtgcgcggtgcgggcggcggactgctggccgtcgccggctgcgtctgggcttgttgcggaagttttcgcggagtcctcatcggcttcgatttcggccggcgtgtacgccacgtaagtcatgccgtagaagttgcgcacggtctccgacctgaagaaggcgcgcaagtcgaccggaatatccacgcgaatcgcgcgattgcgggcgcgcgagggcatgacgtcgcgaatcgcgcacagtatcgcggcgatgaggtaggaggtgagactcactccgcactgatgcgctgcaccaagcaccttgctggcgctgacgtggtattccatgaacgtaggcgcggcccggtcgatggggccggccagccggtagatcttcgtgcctggcgcagcgccggccttgtctttctcgtagtatttgtcgaagctgttttcggctttgtcgctatccgaaccgtcgtaatccgaaggcacgcccggcacgtcgtatcgctcggcgatgtaggcgtgcagcagcgacttgaacaggttgatggcgccgcgaccgtccgaaatgatgtgcgagacctcgagattgacacgattgcggaaatagcttacgcggaacagcatgcttttgggcccgtaatgcagtcgcgagcatatcggcagatgttccggctccaccagcggccggccgtctgactgttcgaggtaatgccagaacatgccgttgagcaggtgcacgttgaagctcgggaactgggcgatggcatggtcgagcgcgtgctgcaggatgtccggatcgatgccgtccgccagctcggccgaatagcggaacacggtctgcgaggagcggccagcctgggaggagtagaacttgccgatgttgtctagtcggtaccaagtacgtcttgccacgcgtcgcctccctccggtgcgttggcggtggtgccggtgccgggagctggttccagcggtgtgccgtcgaggaaatgctcgatgattcggtaggtggtggccaccagtcccacggccgacgtattgagcaggtagccgtggatgccatcgtgaattcggtaacaggagacgttgtcgttcaccaattgcaggcgacgggcgtacgcttcgtcctcgtctctgagcgggcagtattcggcggacaacaccagcgtgcgcggctgattgctcaggtcgtgcgcggtgagcggcgcgaaatacggattggtcagatcggccacggacgaacggtacatgtcgatgtagtcggccatgtcctgtgcggtgaggatgtagtcggtgccgttggtccgcaccgattcgaacgggctggtctcgggattgtaatcgttgccgactaccgggtaaagcagcatctgcgtgcgcggcatgaactcgccgcggtcgcgggccatgagcgagacggcggccgcaagattgccgcccgcgctgtcgccaaacagcacgatgctgtcgggatccggtgctgggattgtcgcagatatatcgcccccgccggcgggggctgtcggcgcagccgactgggggtgatcaacatcaacagaaccacccaccccagaaatcggcaattccccagcaaacagctgccgggctacctcatagcaatcctcaacagcagtagggaagcggtattcaggagccagccggtactcgactgagatcacacggcgttgcagacgtacggccatatgcgcgcaagcctgcgtgtacaggttgatgccgcctgtggtccaaccgccaccgtggaaaaacaggatcgtgccacgcggcgtgactgagggaagttccgtgttggcattgccggaaataccgtcggcgttgccgctcgacgtgctttccttgatgagtattttgggtaggactttgggtaatacggcgggcagaatcgcggatattgccgaggccacgggcgtgccattggcggaagattcctccagggcttcgggcaggggcgctccataggcgaccagcggcgtgaacactcgcaatggtacggcatatccatccgccataggcgcgaaggcgtcctcgacacggcatttcggattgtcgggtgcctgcttggcgataagctcttccgccacgcgctgcaatttgtacgacttgcccgcgttgggcttgatgtagctggcggccttcatcgcggcgaacaatgcctcgttgatcggcatgacgacaggtcctttcagcggcggattcggtagtgcgaacaccccaaccttagcccatgaccggcatgaacaaaaaagggaaggaacccgagagttccttccctgtgtgccgtatcagacgcgatacgcgccgattatcaggcggtgaagtattccacgccggcctcgaagatcggctggtacttgttgccgggcacgttgacgtacaggccgttgccggaacgctccgagtgacccatcttgccaaacacgcggccgtccgggctggtgatgccctcgatggcgagcagcgagccgttcgggttcacatccaggtccatgccgggggtgccggtctcgtccacgtactgcgtggcgatctggccgttggccctgagctgggcgagcacctcgtcggaggccacgaagcggccctcgccgtgggagatggccacggtgtgaatgtcgccgaccgaagtcttggacagccacggggagaggtcggaggccacgcgcgtgcggaccagtcggctctggtggcggccgatggtgttgaaggtcagcgtcgggcaggcgtcggtcatcggcacgatgtcgccgtacggcaccagacccagcttgacgagcgcctggaagccgttgcagatgccgagcatcagaccatcgcggttcttcagcaggtcacgcacggcctcggtgacggccggcgcacggaagaacgcggtgatgaacttggcggaaccgtccggctcgtcgccgccggagaagccgcctgggatcatcacgatctggctcttgttgatctcgtcgaccaacgcctgcgtggattcggcgacggcggccggcgtcaggttgttgacgatcagtgtggtcacatcggcgccggcacgctcgaaggcggcggcggaatcgtactcgcagttgttgcccgggaacaccgggatcaccacatgcggcttggccacggaagagccgacgtacacggtcttcttcggcgcgtggaagtcgatggtctcgacggtcgcgcccttgtcctcgcccttggaacggtacgggaacacggattcgatgccggactcccaagcttcctgcacagcgtccaggtccagcgtctcgccggcggccttgaacacgtactcggaggtggtggtgccgatttcgccgatctcgaccaaattggagacggccggaagcttggcatcgtccgccagctcgacgatgaacgaaccgtatgccggggtgaacaggtcgtccacggcgatgctgttgttcagggtcacgccgatgcggttgccgagcgtcatcttgaacagggcttcggcggtggcgccatagcccggcgtagagacggccagggcatcgtggaagtcggtgagctcctcgatcacggagaacacctcaagcagcgcatccttgtccggggtcagaccgtcggccaggtagcgcggcgcgatgcgtacgatacggtgatcggcgtccttgaattcaggggaggtggcgcgcttcatgttgcccacggccacggcgaaggagatcagcgtcggcggcacgtcgagatcctcgaacgaaccggacatggagtccttgccgccgatggcgccggcgcccaggtccacctgggccatcagcgcgccgagtacggcggccgccggcttgccccagcgttccggctcgtcgcgcagcttctcgaagtactcctggaagctcaggtaggccttctcatgctcgaagccggccgcgaccagcttggccagcgactcgaccacggacaggtaggcgccggtgaactggttcttggacatgatgtacgggttgaagccccacgccatcgccgaagcggtggtggtctcgccgaacaccggcagcttggcgaccatggccatgttcggggtgagctgacgcttgccgccgaacggcatgagcacggtgcccgcgccgatggtggagtcgaagcgctccgaaaggcccttgttggaggccacgttgatgtcggtgaccagcttgttcatgcgttcggccagcgtgccctcgccccacggggtctcgtaggactgctgttcctcgacatgcacggtctggtgcttggaagcgccgttggaggccaggaactcacgggacagattcacgatcttgtcgccgttccaggtcatcaccatgcgcgggtcctcggtcacggtggcaatcaccgtggcttcgaggttctcttcgcgggcgtaggccaggaactcgtccacgtcctcggcggccacgtccacggccatgcgctcctgggattcggagatggccagctcggtgccgtccaggccctcgtatttcttgggcacggtgttgaggtccacgaacaggccgtcggccaactcgccgaccgccacggacacgccacccgcgccgaagtcgttgcagcgcttgatcagacggcaggcatcgccgcggcggaacagacgctgcagcttgcgctccaccggagcgttacccttctgcacttcggcgccgtcgagttcgagcgattccacgttatgcgccttggacgaaccggtggcaccgccgatgccgtcacggccggtgcggccgcccagcaggatgattttgtcgccaggggccggggtttcgcggcgcacatggtcggccggggtggcggccacgaccgcacccacctccatgcgcttggccacgtagccggggtggtagatctcgtcgacctgaccggtggccagaccgatctggttgccgtaggagctgtagccggcggcggcggtggtcacgagcttgcgctgggggagcttgccttccagcgtctcggagaccggcacggtcgggtccgcggcgccggtgacgcgcatcgcctgatacacgtaggagcggccggacagaggatcgcggatgcagccgccgatgcaggtggccgcgccaccgaacggttcgatttcggtggggtggttgtgggtctcgttcttgaacaggaacagccagtcctcgtcgtggccgttcacgtcaaccttgaccttgacggtgcaggcgttgatttcctcggactcgtcaaggccggtcaggacaccgttcttcttgagccacttggcgccgatggtgcccatgtccatgaggcagacgggcttggcgtcacggccgagctcgtggcgcatcgccaggtaacgctcgaaggcggccttgacggtggcgtcatcgatggtcacttcgtccagctcggtgccgaacgtggtgtgacggcagtggtcggaccagtaggtgtcgatcaccttgatttcggtgatggtgggctcgcggctctcctcgctgaagtacttctggcagaattcgaggtcggccagatccatggccagaccgcgctcgtcgatgaacttctggccggcttcggcgtccatctcgttgaaaccggcgatggtctcgaccttgccgggcaccggcacctgggtcttcagggtttccttggtctccaggctggcctcgcgggcctcgaccgggttgatcacgtaatgcttgatggtgtccacgtcggcgtcggtcaggtcgccttccagcgcgtacagcttggcggagcggacggtcgggcgctcgccctgggagatgagctggatgcattcggcggcggagtcggcgcgctggtcgaactggccgggcaggaactcggtggcgaagaccttggcgccggcgaagtcgggcaggtcgtaggccacattgtccacctgaggctcgctgaacacggtgggcacggtctggtcgaacagctcctgggagatgccttcgacgtcatagcggttcacgatgcgcagggccttgaggccggtcagtccgaggatcgtgcgcagttcgcccgcaagctgctgggcttcgacatcaaagccgggcttcttttccacgtacacgcgaaaaaccatggaaatcctttcttgaaattaaagacaattggctcccctcgagaggggagccagataatgcattactcggcgacttcgatgccttcggacttggcgagttcggcgaggcgctcctcgatctcttcgtaggccgggatgatgctgccgagaccacggcggaacaggtccttgtcaaggtgctcgaccttgccggagtggtccttctggtcccacagacggcaggaatccggggtgatctcgtcggccaacagcagcgtgccgtcggtggcgcggcccatttcgatcttgaagtcgaccagcttgacgtcgatcttggcgaagatctcgatcagggcctcgttaatcttgcgggccagcggggcgatctcggcgagatcctcgcgagtgcatacgccgagggccaccaggtcatcgtcgttgacgaacggatcgtgcagatcatcgttcttcaggaagtactcaagtaccggctccttgagcggcaggccttcctccacgcccagacgggagcagaagtggccggcggccacgttgcgcagcacgatctccaacgggaacatgttcaccttgcgcaccagctggccggtgtcgtccactcgcttgataaggtggctgtcgatgccgcgcttcttgagcaggtcgaagatgatggtggtgatgaggttgttcagacggcccttgccggtgaagtcttccttcttttcaccatcgccagcggtggcggtgttcttgtattcgacccacagaacctcgggatcgtcggttgcgtacagttgcttggccttgccctcgtagagcttttccagcttctccatgactcacctttcaggagtggaatttctgggtgaactaacggtaaaagggtaccaatcgagggctacaacaacactcagcatgacgctacgatgcggccggcgcatcatacgtcgctgcatcgaacggccatacgctgttgggatggcggaggcggccgtcattggccagtacgatcagctcgtctccggtcgtgtagccttccggcatgaagatatctgcagaagcgcgtgtgaatactcagatgttcgtcaatagacgaaacatgactcttcggccatatacacacgataatgggagtgacgaaatggtacaaggaggttcgtcatgatcgttcatccacgacccggacggcaataatattgaggccatgctgagctgatcaggccgtggactactccacggtaatcgtcaacgcatcggccacgaggccggccttggcacgggcgtcggcttcggactcgccgacggccagtgccacggccatgcggcggtggccatgcacttcgggcttggcaaaaatgcgcaggtccgtgccgggttcggccagagcagcggccacatcggtgaactcgacctcaccgtcgccggccaccacaatcgcatggcttgccgccaccgagccggccggaatcgtgagcgacacatgctcgggggtgatcggcaggccgagaatcgcgcgggcgtgcagcgcgaactcgctcagacgctgggaggccattgtcaccataccggtatcgtgcggacggggggagacctcgttgaacagaatcgagccgtcggtgagcacgaacagttccacgccgaatacgccccaaccggtttcgccggccgcctgagccttggccaccaagccttcaacggcggtacgtgcgatgtcgcgcgcccgctcggcctcaccatcgggttcggtagccggctgccaggactcgcggtaatcgccggactcctgacgttggccgatcggcgcgcacgtcacaatgccggcggacgaagaaacagtcagtaccgtcagctcacgctccagcggagcaagcgcctcaacgatcacgcgcgacacatcgccctcatcggcggcgcggcggccctcctgcgcttcggtccaagcggcatcgatggcgtcggcggaacgcaccaccgactggccgtgaccagacgagctcatcaccggcttgaccacgcacggatagccgacttccgaagctccggcgcgcagctcttccagcgagccggcaaaacgatacggtgtagtcggcaagcccaattcttcgtgggccagtacgcgcaggcgctcgcggtccatgcaaatcgcggcgatttcggcgctcggcaccacctgggcgcccgcggccgcggtaccggccagcacatcggtggcgatggcctctacctcgggcacgatgatgtccggcttgatttcatcgaacaatgcctgcaattcggcggcattcgccatatccaacgcgcgatattcatgcgccacctgctgggccggagcgccggcatacgagtcagcggcgcacacccacgcgcccagtcgcatgagctcgatggccacttccttgcccagctcaccagcgcccaaaaacagcacgcgggtggggtgcttgcccagcggtgtgcccagcgggcggttggctgcgcgagttgcgggggagacggcggaagtctcggcgggaattgcgggagaggaggtggaagtcacggcagtatttacggcgttctcagtcatacccacattctgccatgccgcgatgatttcgcctatgcggggctcggattcggcgacgtgcgctgcggagcgcgtgattcaatattgggcaaaatgcggcagcccataccatttcatacgcgttcaggcagcgcggccgacgccattgcagcgcggtggtttaggatggggcaatgcgcgaaaacgggattgaagagagcattgatcgtcctctgactatcgctcttgtggtcgatacggtgggcaatcagggcaacggcacctccaattcggccttgcaatgggctgcagaattggagcggcaaggccatcatgtgaggcttgtcggtataggggcgcccgaatatccggcgcgcgtgaatagggtgccgctcgtctcgtgggtggccgccaagcagctcatgcaattcgccgaacccagcgacacgttgttccgcaccgcctttcaaggcgtggatgtggtgcatatctatatgccgttcaaattcggccgtcgtgccgctaaagtcgcccaccaaatgggcattcccgtgactgccggattccacctgcagccggagaacgtgctgtattcggccggcccgctacgtcgcattcccggtatttccagcttcctgtactggctgttcaagcactggctgtacaagcacattgaccacatccatgtgcccaccgaaatgaccgcgagcctgttgcgcgcgcacgggtataaagccaagttgcacgtgatttccaatggttattcaccggtgtattcgccgaagaagccggccgatccggatgcctcggctcccgtgccgttccgcgtcatcgcttccggccgactggctagcgagaaagatcagattacgctgatcaaggcggtgtcgatgtcccggcacgccggcgatattcagctggtgatcgccggtactgggccgctcaagcagtatctcaagttccgcgccgggcgtttgctggcgcgcaaggccgatatcggattccacaagcacgccgatatgcccgatttgttgcgttcgggcgatttgttcgtgcattgttcgattgccgacatcgaatcggtgagcgtgatcgaggcgatggcgtgcggattggtgccggtgatcgccgcgtccgaactgtcggcggccagccagttcgcgctgatcgacgagtcgttgttccccgtgcgagacgcggccctgctggcccgacgcatcgattggtggatcgcacatcaggccgagcgcgccgaatggggcgagaaatacgccgaatacaccaaggcgcattattccgtggaagcctcggtccacaagttcgtggatatggaacgcaaggcgataggggaataggagccttctcgtttgcggagaggtctttccctcagtccgcctgcggtggccagctccctcatcagagggatctacgaaaaaacctccctctgatgagggaggtggcatcgcgaagcgatgacggagggagagattagcgaagggttttacaacaactcaataagttgatcgacctcttcaggcgtggtggcccagctggtgcagatgcgcatcacggtgtgcgtgtcgtcggccttttcggtaaagccgagcttgatctcgcgctccagacggtcgatggtcggctgatccatcgtcacgaaaatctggttggtgggcgcttcgaaagtgagcgtgtagcccttggcgcgcagggcctcgcgaatacgatcggccgcctcattggcgttgcgggcgatcttgaaatacaggttgtcggtgaacaaagcgtcaaactgcgcgcccagcacaaagcccttggccagcaaggcaccgtgctgcttgatgagggtcaagaagtgcttcggcgtgttgtgcttggtaaacaccacggcctcgccgaacagggcacccaccttggtaccgccgatgtagaacacgtcggcgatggtcgccagatccgcgagcgtcatgtctgagccggtggtggtcagcgcgtagccgagtcgcgctccgtccacgaacagcggcatgtcgtacttgtgcgccacatcggcgatggcctgcaactcggccttggagtagatggtgccatattcggtgctttgcgagacgtacacggagcccgggaacaccatgtgctcgtagttgccgtccgcatagaaggtcttgcagaactcgtccagttcggtcgggtccattttgccgttgtgctggggaatcgtgagcaccttgtgcccggagaactcgatggcgccggcctcgtgcacgttcggatggccggaggcgaccgcgaccacgcctgcatacgccggggtgatggtgtcgatgacgacctggttggtctgcgtgccgccgacgaggaaccacacatccgcgtccggctggccgcaggcctcgcggatcttggccttggcctgatcgctcagttcgtcggacccgtagcccgaatacagatggttgttggcttcagccacggcttcaagcaccgcgggatgggcggcgcgggagtaatcgttctcaaaagacagcatgacggaccttttgtccttatgttcggtgaattggatatgccctgagtgtacaacgcggtggttcccggcatgcctatttggcctataacccaggagcggggaattcatggagaaaaaacaaaacccttccgcgaacggaagggttttactggggtggccaacgcggctcgaacgcgcgaccttctgaaccacaatcagatgctctaccaactgagctatggccaccatagtgccgcattcagcaagctgaattcgcgcaacaggtgaatattatacacaactttgcggatgtgtgctcatcggtgtgtcgcgatggaatcaagtggtcggtttcattcttggggccaggctgtgggctgtctcagatggcgggatgtggatgagtgggtcttgtgcggcgattgatgaaaagtcaaggcacacgacggcgtgatggtacgactggggattgcagaaatgattacgtgagtgttcgcaatgtgagcattatgtttcatgtcaaccgcgaccctcctagtttcatgcgatgttacctacaccaaacaagggaagagaaacaccatggaaaaggttaaagcctttgcggattggctgaccaagtggtttacggtcatcgtcatcgtctgggccgtcttcaactacttcgtgccggccgccagcctgtggggcaaggcgtacaccggctacatgctgggcatcgtgctgttcggcatgggcctgactctgacgctggacgacttcaagcgcatcctgacccagccgctgatggtcatcatcggcaccgtagctcacttcatcatcatgccgctcatcgccgtggccctgtgcgcgatcttccacctgtccggcccgctggccgtgggcgtgattctcgtcggctgctgcccgtctggcacctcctccaacgtgatgagctacctgtcccgtggtgacgtggccctcgatgtctccatcggcatcctctccaccctgtgcgccccgttcatgattccgctgctgatgcagctgctcgcttctcagtacgtgtccgtgccgactcagtccctgttcctcaacgccgtcaaggtggtgctcttcccgatcgccctcggtgtgatctgccacatgatcttcggcaagaagatcgagaaggttacggtcgccctgcctatcgtttctcaggtggctattctgcttatcatcggcgtggtcgttgccgccaacggtccgaagctgttcgtggccagctccctggtggccatcccggtggtcatcctgcacaacctgtgcggctactcgctgggcttcggcttctccaagctgatgtacaagatctacccgaagggcttccgctacgcacagcagaaggccatcaccttcgaagtcggcatgcaggactccgctctgggcgcaaccctggccctgacctccttcgcaaccaacccactcgctgccgtgccgtccaccttcttctccgtgtggcacaacatctccggctctatcctgtccagctggtggcgcaaccacgatgacaagcacgagatccactgggattccgacaatggcgagaagggctctgccaagagcaccgtttcagcggcccacccgttcgacgccgataaggccgccaaggtcgctgcctgaaatcctgaaatggtgagaaaggtcgggtaaggcacgactccagtcagtcggtcatccacctttcctacctcgcataacatagccgctcccgcttactcccgattgaggtatcgggcgtttcgcgagggcggttttgctataattggtaatgcagaaagcggcaaggtaatacggcaaagaggccgggtcgctagaggttcccatcggatatggaagagcacgaggatgtgctggaaacagataacacagaagcggatgtggtgaaaagaaacataatgtaacctccttggcggtgcccccgtgtgacatagtctccgcgggggcacctgctgtgtggcgttcctttttgcgacgcattcccgggaatattgcgttgggaggagaggaaaagtacagggcgcaagaggtccccaaaccagtgagttgtggcccggcgcgtcgttgtccggaggaatcgtaatataggtattcgtgtgtgccagcagcacgccttatgtaacaggcgagcatgctgggatatccttcaaaccgctgatcgcacgcagtaatgcgccgacgggaggggcgaaggccatcgggccggtggactgggctatcttttccgattcgtcgggtgccgccaacaggcggataccaagcgagtgtgctgaaaagtgtgggtgcagtgcggcggtcacacaaaagcaagagaaaccactgaatcggagaattcaagttgcctactattgaacagctcgtccgtaagggacgtcaggcaaagccgaagaagtccaagactttggccctgaagggcagcccgctgcgtcgcggcgtgtgcacccgtgtctacaccaccaccccgaagaagccgaactcggctctgcgtaaggtcgctcgtgtgcgcctgtcctcgggcatcgaagtcaccgcctacattccgggcgaaggccacaatctgcaggagcactccatcgtgctcgtgcgcggcggccgtgtgaaggatctcccgggtgtgcgttaccacatcgtgcgtggcgcgctcgatacccagggtgtcaaggaccgtaagcagggtcgttccctgtatggagcaaagaaggcgaagtaagagatatgtcacgtaagggaccttccaagaagcacgtcgtgctgcccgatccgatctacggttccaccgtggtggcgcagctcatcaacaagattctgcttgacggcaagaagtcgatcgccgaagacatcgtctactccgcgctcgatatggtcaaggagaagtccgaccaggagccggtggctgtgctcaagcgcgccctggacaacatccgtccgtccctcgaggttcgctcccgccgtgtcggtggcgccacctaccaggtgccggtcgaggtcaagccgaaccgcgccaacaccctgtcgctgcgctggctgaccgacttctcccgcgcccgtcgtgagaagaccatggctgagcgtctcgccaatgagatcctggatgcctccaacggcctcggtgcttctgtcaagcgccgcgaggatactcataagatggcagaggctaacaaggccttcgctcattaccgctggtaatcactcgccctgagtaaaactaaggaaaaagatggctgaagagatttcggacctccacgacgtccgcaatatcggcatcatggcccacattgatgccggcaagaccaccactaccgagcgtattctgttctacaccggtaagaactacaagatcggcgagacccacgacggcgcctccaccatggacttcatggcgcaggagcaggaacgtggtatcaccatccagtccgctgctaccacctgcttctggagccgtcagtcccacgacaccaaggacaagttccagatcaacatcatcgatacccctggccacgtggacttcacggccgaggtggagcgctccctgcgtgtgctcgatggtgccgttgccgtgttcgacggcaaggaaggcgtggagccgcagtccgaaaccgtgtggcgtcaggctgacaagtacggcgttccgcgtatctgcttcatcaacaagatggacaagctgggcgcgaacttctactactccgtcgacaccatcaaggagaagctgggtgctactccgatcgtgatgcagctgccgattggttccgagaacgacttcactggcgttgtcgacctggttgagatgcaggcttacgtgtggaacggcaccgaggagctcggcgccaagtacgacaccactgaaatcccggacgacctcaaggacaaggctcaggagtaccacgagaagctcgtggaagccgctgccgaagccgacgacgacctcatgaacaagttcttcgaggacggcgacctgtccaaggaagacatccgcgctggcgtgcgtaagctcaccatcgccaaggaagccttcccgatcttctgcggttccgccttcaaggacaagggcgttcagccgatgctggacggcgttgtcgattacctgccgtctcctgaagacgtgccggccatcaagggctacaagcctggcgatgagtccgtcgagatcgaccgtcacccggtcaagtccgatccgttcgcggctctggtcttcaagatctccacccacccgttctacggcaagctcgtgttcgtgcgcgtctactccggctccgttgtgccgggcgactccgtgctcgactccacccgcgagaagaaggaacgtatcggcaagatcttccagatgcacgccgataaggaaaacccgatggaccgcgctgacgccggtaacatctacaccttcgtgggcctgaagaacgtgaccaccggtgacaccctgtgcgccatcgacgatccgatcaccctcgactccatgaccttcccggatcctgtgatccaggtggccgtcgaaccgaagaccaaggccgaccaggagaagatgggcatcgccctgtccaagctggccgaagaggatccgaccttccaggtcacgaccgacgaagagtccggccagaccctgatcgccggcatgggcgagctccagctcgacatcatcgtcgaccgtatgcgccgcgagttcaaggttgagtgcaaccagggcaagccgcaggtcgcctaccgcgagaccatccgcaaggccgtcatggaccagggctacacccacaagaagcagaccggtggttccggccagttcgcaaaggtcctgatgaacttcgagccgctcgacaccaccgagggcaagaccttcgagttcgagaataaggtcaccggcggccacatctccgccgaattcatcggccccatcgaggccggtgtcaaggaggccatggagtccggtgttctcgccggcttcccggtcgtgggcgtcaaggccaccgtcactgacggccagatgcacccggtcgattcctccgaaatggccttcaagctcgcaggttccatgtgcttcaaggaagctgccccgaaggccaagccggtcattctcgaaccgatcatgaaggtcgaagtccgtacgccggaagagtacatgggcgaagtcatcggcgatctgaaccagcgccgtggcaacatccagtccatgaccgacggtgtcggcgtcaaggtcatcgacgccaaggtcccgctgtccgagatgttcggctacatcggcgacctgcgttccaagacccagggtcgtgccatgttcaccatggagatggactcctacgacgaggtgccgaagagcgtctccgaggagatcatcaaggcccagcgcggcgagtgacacgcgccactgcatgaagtagccagtgtcttcagtcagcggtaatatcgtataccgctgactgggttctggctcttcaaagtggcacataacccagaaacccagtagaataagcgagttcctgtgcgaaagggtgcaggaaactcacgagacgtccaggaggacaaaagtaatggcaaaggaaaagtacgagcgtactaagccgcacgttaacatcggtaccatcggccacgtcgaccacggtaagactaccctgactgccgccatctccaaggtgctgcacgaggagttcccggatgtcaacccggagtacgacttcaaccagatcgattccgctccggaagaggccgcccgcggtatcaccatcaacatcgcccacatcgagtaccagaccgagaagcgtcactacgctcacgtcgactgcccgggccacgccgacttcgtgaagaacatgattaccggtgctgcccagatggatggcgctatcctcgttgtggccgccaccgacggcccgatggcccagactcgcgagcacgtgctgctcgcccgtcaggttggcgttccgaagatcctcgtcgccctgaacaagtgcgacatggtcgacgatgaagagctcatcgagctcgtcgaagaagaggtccgcgacctcctcgacgagaacggcttcgaccgtgactgcccggtcatccacacctccgcttacggtgctctgcacgacgacgctccggaccacgagaagtgggtccagtccgttaaggacctcatggacgctgtcgacgactacatcccgaccccggttcacgacctggacaagccgttcctgatgccgatcgaggacgtcttcaccatctccggccgtggtaccgttgtcaccggtcgtgtcgagcgtggccagctggccgtcaacaccccggtcgagatcgttggtatccgtccgacccagcagaccaccgtcacctccatcgagaccttccacaagaccatggacgcctgcgaggctggcgacaacaccggtctgcttctgcgtggtctcggccgtgacgatgtcgagcgtggccaggttgtggccaagccgggctccgtcaccccgcacaccaagttcgagggcgaagtctacgtgctgaccaaggacgaaggcggccgtcactcgccgttcttctccaactaccgtccgcagttctacttccgcaccaccgacgtcaccggcgtcatcgagctgccggaaggcgtcgagatggttcagccgggcgaccacgctaccttcaccgttgagctgattcagcccatcgctatggaggaaggcctgaccttcgctgtgcgtgaaggtggccacaccgtcggctccggtcgtgtgaccaagatcctcgcctgattttcatcagacaagaatcttcgcttgaactagcgttataggaaatccccttcgaggaaactcggaggggattttctataaccgcagcaggatatggatatgtaccacgacttccggcctggatgcgctagtgttgcttttcaatagataaacggactgctgcactgcgaggatatgacactgatggcaggccgggaaagaaggtcgatgatgactggtgcacaggccgctcactgtggttctgtatccgcaatttcgctgggactgcccgtttccacggcgattcccgaagccaaaggcacactgccgaaagccttgttcgtaggcaaagcgccgatttccggcaaactcaagcagcgattggtgaacgagatcgaatccatcaccatgctggcgttggcccggtcggccaacacggggcttgcggacggcaaactgatcccggaagtgctggtcatcggactgaagcttacggccaaagccaccggcataccgaacgaagtcatcgacctgatcgccggacagcgcaaatcgggcatcgtgttcgtgtgcgtacgcgacgtgccgttcgagggcagcacgcgtgaggaatgcgcgttcgccgtgcgccgcgccataccggggcgtgccgggcacacgccgatctatcaggtatatgccggcgactggcagccggcgggggaggcccagctggagctggccggctctactattgatgagctgtgggcatcgctgtgctcacagaccattttgggtacgccggaggtcgagaatctggatgcgcgcatcattcgccatactgaaattgctcggctcgaatccgaagtggacaagctcactcgtgaccatcagcgcgtcaagaacccggcccagcgcaacgagatctatgccaaactccacaaggccaaggcgcagctcgcaaaactgcgcgaggcatagtgatgtgaaagccattgggcttccgctggcgggagctggctcgcgaagcgagactgagggtggtccaggtccgtggcctagggctacgcccaagctaattgaaatattcgtgcatcatacagcgtacagttaaaccatgttccctctgctcgaaaccctggtcgccgtatacgaggtgggtcagttcacgctggccgccgatgagctgaaggtatcgcagtcgacggtgtcgtcgcgtatcgcccaattggagcagatggtcggcgcgccgctgttcgtgcgcaatgcgaaaagtgacgtgacgcccacacaggccgggcggatgctgtaccagactgccatcggcatcgacggattatggcgggatacgcgtgagcagatcgcccgcgtgcaggaggcgcgtgagccgctggccgtgtcgttctcgcacacgaccgcggcgattctgctgccgaaggcgttgccggtgatggctcgggacatggacggtttcgacttcgctgtacacgtgatgaactcggatgcgattctcgaacaggccagcatgaaggctgtgcagctcggcgtggtggaaaagccgatcgtgaacgattcggtggaccgcgtcaccctgtgcgaggaccggctggtgttggcgggggaacctgacggcgtgtggatggtgcgcgaacacggttccggcgtgcggtattacacggatctgtatttcaagaccgctcaggttgtgcctgcacgcacgatggaagtgtccagtaatgcggcgattgtggcggcgctgtccgccgggttcgggcagtcgttgatttcggaagccgccgtgccggcgggcgtgccggtgcagcgggagcttggcgatgagtttgtgcggcggttctatgcgctggtgccgagatccggtctgacgcacgatcagcgggagttggcggagacgattattgctgcgctgcgcgggtagtcagatagtcgactgaggggaggttgcgaacgttgtttctctccctccgtccgcctgcggcggccacctctctcatcagagggagatcaattaggtatcgacaaaatcgatgatatgtattggttgcaatgatttgaccgatgtaaacgcttgagcttcaatagacatcatgagagagttctgtacaaaatggtggaagcgcattgccaccgttgacatgctgttcattggtgttctgactctgctggcctccctgttcgcctcctggctcaagcagttccccggattcagcctgttcggcgcgctcatcatcgcgctgctcatcggtatgatcatccagttcccgatccgcagtgcctacgtcggttccaatgatggccgcaaggcaggcgtcaaggacgccgctggcctgatttccaacaagctgctgcgcctcggcatcatcctgctcggtttcaagctcaacctcgccgtgctgttcacgcagggcatcaagtgtctgccgatcgccgctgtggtcgttacgctgaccatcatcgtgtgctatgccatcgcccgcaaactcggtgtcgacccgatgctcgccatcctgaccgccggtggcaccggcatctgcggtgcggccgccgtcatgggcctggccggttccatcaaggtgcctgaggacaagcaggacgagaaggacaacgacgtgaccatggccgtggccatcgtagccattatgggtactgtgttcgcgttgctggagatcgcgctcggcccgctgaccggcatgaccaaggaccagctgggcatcaccgccggtgcttccctgcacgaaatcgcccacgcggtcgcgggcggcgacgcgttcggcgcggtggacatcgccaccatcatgaagctttcccgcgtgctcatgcttgtgttcgcggccatcatcatcgccatctggtgggagaagaagcattccgaggttcagagcaccggcaagaagaccgtggccttcccgtggttcatgctcggcttcatcggcgcttcgattatcggcaccttcgtaccgttcgtcacctccatcaccccgcagctcgtggactttgcgtacatcgtgctcggcatggccatggccgcgctcggcatcaacgtgaacttcaaggccatcgcttccaagggcaagaagccgatgctcgccagcttcctgacatcgattctgctcatgtgcttcgctgcaggtgttgcgatgctgttcttctgataagcgctccaaatacaaataggcgaaggcgaacgacagtgagcaattggaatgtgtcacctaaaaatcacgtacttgcacaacggataaccccagccgaactggcaggccatcgcaatgaacttcaccacatatggactcagcccggtcgcacccggcatccagccgatcagcagcgtgctgaacgtgaagttccagatccacagcagcacgaacagcgccacggaacgggtgaagttgctggacgatttgaatgtcacgttgcggttcatcacgaagttgtaggtcgccgaacacaccacggcgatgccgttggcgatctgtgagggtacgccgatcaagtgcagaatggcgaacgtcgcatactccacaatggtctgcgtggcggaaacacccacatacttgcccagcacggcgagtccattttgcttcggggttgccgtgcccacggtattttccgcagtattcgttgtggtcgaggtatttgtggcgcccacaccttgattcggcttcacatccgctccattgttcgccatgcccatatacctcccggatgtacctgtgacgttcgacctcgcaatgataccgctgaccgcgtcgggaatcggcgtggcggtcagacgagaaaaccgcaggccgcagcaacgaccggcacacccagcgacagcaccagataggccgctgcggtggggtagcggtgtttgcggaagagcgtcaccatttcgttgattgcggtcgagaacgtggagaagccgccgaggaaaccggtggccagcactagccgccatggttcatcaagtgtcccgccgagtgccagcgccgcgaccaaaccggctaggaatccggcgatgagattgatggtgaacgtggaaagtgggaatgcgcgctgccagtacgttttgatggtcacgtcaagcagatagcggcaggaggcgcctacgccgccgcacaggcagaccaagattggtaggaatacggtcatcacgccttacctcccttgctggtcgtagcggcattcgtatcagcggacgcttcggcggatacgttcgaggagccggccagatgcgttcctgcccacacgccggcagacgcacaaaccagacccagcgcgaacgtcaccagtagataggcaatgccggccgccacctgaccgtcgcggattgcggtaaaaccttccagcgcgagtgtcgacatcgtagacaaaccaccgcatacgcccatgccgagtccgcgactggcaagttctttggaacgtgcgccgaaccgggaagcgccggccaagtaagcggtcaaccctgcatagcagaagcaagccagcatgttggccacaaacgtgccggtatggaagctgccagccgcgggaatctgtgcgaacgcatagcggatagcggtgccgatcgcaccgccgcagaagacgaccaacacaatatcaagatgaatatcggggagcttgcgcgccgggggagtggtcgtgtgcgtaatcggccgggcacctgcggatggggattgcgaatccataatagcctttcctgaaaccgctgaatcctgctgaagacacaacgattccatgcaatatcaaatcgtgtgtaggaactatcagcagtgtgcggttcgaaacgagttcaggcgggttccatcgccggttccttagcctactcgtggcggcgacaacaaacggcagcagtatctcggatattggcctatcgcggtggatttcggcaagagacttctgcaatgccgatgaacttggttgccgtgaggcgataaagcacgtagatgaattgcttggttgcttccatacctcgtgggtatggctcaacatggtttatggctattggctaatacagatcgattgtcgtttaatggaacatgaggataacgggccctaatcgctcggtgccggaaacaaggagttgtgaatatgtctgaaaccatgaaagccgcgattttcgtggagcctggcaagatggccgtggaagaggtgccaaaggcggcacttcagcaggatgatgacatcgtgattcgcatggtgcgcacctgtgtatgcggctctgatttgtggttcttccgtgggctgagcggacaggccgcacacagtcaggtgggccacgaagccattggcgtggtcgaggagactggcgcggcggtcgaatccgttaagccaggtgatttcgtggtcgtgccattcccgtacagctgcggcaagtgcccggtatgcaaggccggcttcgaatccgtgtgcccgcacgggggctacttctccgcttgtcaggccgaatacctgcgtgtgcccgaggcggacggcaccgtggtcaaggtgcccggttcaccggaagattattccgatgaacagctcgcatcgctgctgaccatttccgatgtgatgtccaccggttatcacgcggcggtttctgccgaggtcaagcccggtgacacagccgtggtcatgggcgatggtgcagtcggcctgtgcggtgtgattgccgccaagatgcgtggtgccacgcgcattattgccatgagccgtcacgaggatcgcgcggcgctcgcccgcgaattcggtgcgactgatatcgtgcccgagcgtggccaagaggctattgacaaggtgctggagatgaccggtggctatggtgcggacgcggtgctcgaatgcgtgggctccaagcagtccttcgacacggcgattggcctgattcgccgcggtggcgtgattggtcgtgtgggtctgccgcacgacgtggagatcagcgccgaaggcacgttctacggcaacatcggcatcaagggcggcccggctcccgtgcgccactacgatattgacggtggtctgctggatgcggtgcttaaaggcgagattaaccctggccgcgtgttcaccgccgaatatgacctcgaccatattcaggacgcttatgaggccatggaccagcgcaaagttattaaggcgttgatccggttctaatcgcgtggtgtgacggggtttaccgcagtggtatttaacgtccgtatgtatgcgtcccctttgtagggccgcatacatacggacgttgtgatgtgtctgacgcggtttacgctgaacgattgtggtgacgcaaaccggtcacctgttactcggcgagcagtgccttgtactgtgcagcggactgggcgagggcctcgtcggtgatgccgaaagcgccgcacgtggcgaacggcttgagtcaggtcgcgccgatgtataagccgtgccctcgatcggaataagcagctgctcgatggggtagtggccggggtgccggtctggtaggccgattccggcgaaccggtggacactgcgcatcgcgtcgggaaccgtggccaaggcgtacaccgaactcgccgactgcggcatcatcgacaccggtgccggccgcgcggcgcgtgtaaaacgggtcaagccgattcccgaaccgctggtgcgcgcggccaagacctatgccgacgaggcccgccggcttggcgcgagcctcgatgacgccttcaacgccctgtgcgcgcagtggtaaagcgcgcaccgatgcgaagcctacacggggtgcaccgtcagcgaaaagtcgccgatggtgctgacggtcgagggtgaggccagattgcagacatctcgcaagcagtacgtggcatacagcggaagataggttgttccgccgtcctgcgcaatattggagcgggacagcaccacgccctgcgagatgcgatattcggcattggccaatacggcgtcgatggcggcgtgcgtgcggtagctgcgccccgacttgacctcgaacggcatcacagaatcggcgttcgtgtcagcgatgaaatcgacttcaccatgtttctttgccatgtagtaatacagcggaatgccttgcgccgtcagctcctgagcaatcacgttctcgtagatggcacccagattcggtgaggaatcatcaaggtatgcggcttgcgcggtcggttgcgggtatcgtgccatgagcataccggtatcagactggtacagtttgaacttcggtgattgcgccgtgcgtttcaatggtgttttcggctcggtgacgcagttggttttcaatgccacacccgcatcgacaagccaaagaaaatccttctgattgcggtcgtaccgagcaccggggctgatggaggagacggcgaatctgccgttaccgtcaatcagctgagtggggagctggtcgaagatctcctgcacctgcaatgcgcgattgcctgcgtactgcgaaatatcgtggcgatattgccggttcaactcgttctgcaccgcgcgcacagccgccaaatcacccttggtgtccagaaaacgttgcacgacttccggcatgccgccgactaccagataggtgcggaagttcgtcatcattgcatcgtgaatgtaccggtcgattggcgtgaccgaccggcaggattctcggatgttttcaagtgtcgacttctgtacgccgatggcccaacagaattcctcaaaatccatgggacgcatggttttttcgatgaccgagccaacggggtaggagcgtacgcccttgaactcagtgccgagcatggaaccggagaacacataatcgaaacggccatcggccaccagaaacttgaccatggtcatcacatccggtgcctcttgcacctcgtcgatgaaaatcaacgtatcaccgggaatgagcgttgaaggtgagaacaaggtaaggcggctgatgaactcctgcacgtcgttcgccgatgcgagcgctcgggccgcctgcttgttctcgtacaggttgatttcaaggtaatgggcgtattcgtgcttggcgaactcgcgtaccgcgtagctcttgccgatctggcgagcgccggtcagcagcagtgctttgccggtaccgctccgcttccattccagcagatcgtccgagattttgcgctcaagcatggcagctcctttccgaatcccttatgagggtagcattttctgccttgtatgtgcaaaatgccgcatttcaaaatggggctttggtgcaaaatgccgcattttaaagtagggttttggtgcaaaatgccgtgtaaatggtgaattggacgtgcttgtaaggggagctggatgatcgtgcggctggatgaccttgtaactaaatgattgaacgattgcgcggccgtcgtttgcgtggccgcaaagttgtgtgggctgttcgcgaattatgcgcggtcggccgtcatgtgcctgcgcttggggtgctcgataagtagcgctcgcttcttggcgtcctcggcggtcgaagccggtacgccgtcggaggaggcgtcgatgatgcgctgcaggtagccgtatagggtgtgcagctcgtcgtcattcagacagtccagcatagaggggcctgatcaaaaccagttcacgaggtcctttttgctttaatccccgctgagagcgcgtagcgccggaggatgatcggatgccgcgacgccgaatcaagattcagccgctcgccgaccagcccgaccagcaaggaaccggattcgcgcatcggcggcatgcgcgctgctattcgcgctgaaacagcatggcatgggtgcgctgacaccgcgccggcgcaaaggccatcagtgaaactggggaatcggattgcaggtggcggacggtgcccaagacgaaagattctcgtccggcgttcagccgccgtcgttggccgtgatgatactggagaccatgaaactcaggcggcggcagccaagggcgaagtcgagaaagaggtgacggcgtgacacttgaacagaggtcagatagcgcggcggcggagcggtgccgagcatgaccaacaatcaacggccgcaggcgatcgaagtgcgcggggcgcgcgtgcataacctgaagaacatcgacatcgacattccgctgggcgaactggtgggcgtggccggcgtctccggttcgggaaagagctcgctggcgctcggcgtgctgtatgcggaaggttcgcggcgctacttggaggcgctgtccacgtacacgcgacgccgcctgacccaggccagtcgcgcccaagtggacgaagtactgcacgtgccggccgcgctggccctgcaccagcggcccacggtgcctggcatccgttcgacgttcggcacgatgaccgaactgctcaacagtctgcggctcctgttctcccgcgtcgcctcgcacgtgtgcccgcattgcggggcgcgcaacgagtcgacgctgaacgtggcggccggactgcccatcacctgtgctggctgtggcaaggaattccacgcgcccggcgccgaatcgctcgctttcaactcggccggcgcctgcccgacctgctccggaaccggcattgtgcgcgaagtgaaccgtgcggccctggtgccggatgagtcgaaaagtatcgacgacggtgcggtgctgccatggggctcgctcatgtgggaccttatgaagcaggtgtgcggcgcgatgggcgtgcgcaccaacgtgccgttcagcgagctcacgcccgaagagcgtgacatcgtattcaacgggccggccgtcaaaaagcatattctttacaagccgaagaaaggcgacgatttcgccgaactcgatttcacctacttcaacgccgtatacacggtggagaacgcgctcgccaaagccaaggacgagaaaggtctgaagcgcgtggctcgatttctcaaggagggaccatgcgccgactgtggcggcacacgactgagcgccgcagcccgggccccgcatgtgcgcgggctgaacctggccgaagccagcgcgatgaccttggatgcggcggtggattgggtgcgcggcgtgccggaatctctgtccgccgacatgcggccgatggccaccaacatctgcgaatcattcctggacgtggcccgccgactgttggatctgggcctcggctatctggcgcttgaccgcgccggtgccacgctttcaaccggtgaacgccagcgtgtgcagctcgcccgtgccgtgcgcaaccgcaccaccggcgtgctgtatgtgctcgacgagccgtccattggcctgcacccctcgaacgtggatgggctgctcggcgtgatgcatgacttggtggcggacggcaattccgtggtggtcgtggaccatgacgtgcgcgtgctcaaggccgccgaccatcttatcgaaatgggaccggttgccggcgccgaaggagggcatgtgatcgcgcaagggacggtcggcgaggtggcggcgaatccaagtagtcgtattgcgccgttcttggccgataatgtgagcgcgcgcatccgtgagcgcgtggcggaaccgcaggtgttcgaccttggccgcatccgcatgacaaccagccagttgcatacggtcaagccgctggacgttgatattccgcgcggccggctcgtggcggtgacaggcgtctccggctccggtaaaaccacgatggtgctcgaatcgctgattcccgcgctcaaagcgcaggcggcgggggagcggttgccggaacatgtgcgtgaacttgaggccgagggcatccatcgtgcgaatctcatcgacgccacgccgattggcgcaaacgtacgctccaccgtggccacctatgccgatattcacgacgaattgcgccgcgccttcgcccgcacggacggcgccaaggcgggcggctggaaggctggcgatttctcatacaacaccggccgactgcgttgccccacatgcgacggcaccggttcaatctcgctcgatgtgcagttcctgccggacgtgaccatcgaatgcccggattgtggaggctcccgctatgcgtccgaagccgacgcgattcggcgtgcggttaaagcggctaagggcaaagcggcgaagatgaaggtcccggataaacgcaaagctgccaaggaaaaattgagtgaggcgacggatcagggtggcggcaacatttccctgagcctgcctcaactcatggcaatgagcgtggaccaggcgctgtccgtgaccggcgacctcaagaaggttcacgcacgtctgaccaccctgcacgacttgggcctcggctacttgacgctcggcgaaccgacgccggcgctttcgggcggcgaagcccagcggctgaaactcgccagtgaaatgggcaaggcccaatcggacgcggtattcgtgttcgatgagccgaccatcggtctgcacccgttcgacgtgcgcgtgctgctgggcgtgttcgaccggctcgtggcgagcggcgcaacagtcgtggtcatcgaacatgaccttgacgtgatcgccaatgcggactggatcatcgacatgggtccgggcggtggcgaaagcggcggacgcatcgtcgccaccggaacgccggaacaaatcgcggccaatccgaacagcatcaccgggcggtatctgcgctgactcgtatggcggtaacgcgcctttgcataggaccctgcgcgagtaggatagccgtccatggtgcagattcatggcattagacgcgcaagcgcggacgcgaaatatcggcagatgaccgggcagccggtcaagccgctgattctcaaactgtgtttgccggccgtcatctccaacttggtgaccaccgcctacaatctcacggacacgttctttattggtcagctcggcaccgcgcagtccggtgccatcggcatcgcgttctccatcatgaccgtgatgcaggcgctcggcttcttctttggcaacggcgcgggcaactcgatgagccgcgaactcggcaaacagaacaatgagcgcgcctcccgactactggccgtgggcttcgcgggtgcggtgctctctggtttggtgattgccacaatcggattgctgaccctgcggccgctggtcgtcatgctgggatcgacctcgacaatcgccccatacgccgtgcaatacctgacgccgttgttggtcgccgcaccctgtgtatgcggttcgttcgcactcaacggactgctgcgataccaagggcaatcgacgttcggcatgatcgggctggtttcgggcgcattgctgaatttcctgctcgcgccgttgtttatcttcgtgctgcacctcggaatttttggtgccggcctggccaccgccatctgccagacggtgagcttcacgattctgaccacaatgagccgcaaattcggcgtgatgaaactgtccctgcgcaattgcaggccggatgtgctgctcatgcgcgaagtggccggcggtggcctgccctcgctgatccgccaaggcgccggttcgatttccgtgacctgcgtgaacattgccgccaatccgttcggcgatgcggccatcgccggcatggccattgtgatgcgcattatgttgggcgccaactcggtgatcgtcggcctcggccaaggtttccaaccggtgtgcggctacaactacggtgccggcctgttcgcgcgcgtcaaagaagggtactggttctgcgtgcggctcgccacctgcgtgctcgtggtgttggcggtgttgctgtgggtgttcgcaccgcaactggtcgagatcttccgctccgacccggccgtggtggcggtgggcgtggccgcgctgcacatccaatgctgcacggtgattctcaacggcttcaacatgatgggcaatatgatgacccagaccatgggccgcaccggcatcgcctcattcctggccctgtgccgacaaggtctgtttttggcaccgatcgtactgattctgccgatgatgttcggcgtgctcggcgtggaaatggcgcaatcggtgtccgacgtgctgacattcctagtcactatcccgttcatgcggcgaatcctgcatgaattgcggtgaatggtagatggcaactatgaataatcgaagtgcaaagcgggtgccgggcgttccttctcccgcgtatatcgaatcgctgtaccgcaccatggctgccgcccttggcccgaccggatggtggccggctgaaaccacattcgagattatggtgggcgcggtgctgacgcagaatacggcgtggggcaatgtgaatcgttcgcttgcggcgttgaacgcggagggtgtgctcgaaccccataagctggcgattatggggccagcgcatctgcaggaacttattcgcccgtccggcttttatgtcaacaaatccaagacggtacagtcactgagccgatggtatgtggagcgttgcggagcctcgcctgagggcgcggcagatattcccgacgccgaattgcggaccgaattgctcggattattcggtatcgggggcgaaacggccgacgacctgatgctatatgtgttttcgcgccgcacattcgtggccgatacttatgctcgccgactattcgccttccttggatttgatgtgccaaccggctatctggcattccacaaggcctattcgcccgtggtgctggatgcgagcctcagcgtcaaggatttgcaggaattccatgggcttattgacgagttcggcaaggcctaccgcgacgacgcggccaaaagcgagtcctttttgggtggatggagggcttgactgcacggcgaatcgttctcaataagaaaagtgtgaggcccgcacggtgccaatcgcacatctgaatccaagaaatggctgtttgatgctattcccgcgaatgcgcgattgagtgatattgtgcgtttgcctcacacttttcttattgagaatgattcgctgcgatatgccgcttacttgacaaccttaaaaccgctggtccatggggtctgattggtgacgccttcagccgctgctgctgcggccttgtccgggttgcggtcgatgacctgcacggtggcgccagccttgacggtgatgcctgtgacgccggcaatccgctctccaccgagcagatcgacgacccctatcgccgtggcatcatcgccgtgcatgacgccgagattgccgccgaacttgactggctgcgctcgatgctgggtgtcgaaaacgagtctgtgacagaatagttcgaccgacgcaatcgccaaaacgccgaacaggagccaatgatgaccgaagacaagccgatcgccaagccgattatcgatgatgcgacgcgcgagaaaatggcgcttatgttctctggcgaggtctacctgccggatgatgtggacggcttttttgacctgcaggccgcccagcgtgatctccagctcgaactcaacgccacgccgctgaccaacccgaagcgccgtaccgaactcatgcaggcgttcttcggcgcggcgggggagggtctgtacctcgaatgcccggtgtatgcgaactggggctgcaatacttattggggcgagcgctgttacgccaacttcaacctgacgctggtggacgatggtgagatcttcatcggatcccacaccatgatcggccccaacgtcacgcttgtagccaccggccatcccgtgcgtccggacctgcgctatcagggtgcccagtattcgttgccagtccacatcggcgagaacgtctggatcggcgcgaatgtcaccgtgctgcccggggtcaccatcggggacaacgcggtcattggcgccaactcgctggtcaccaaggacatccccgccaacacggtcgcctatggcagcccgtgcaaggtaattcgcgaaatcaacgaacgcgacgacgtctactactggcgcgaccgccaattcagtgagcgttttaagctcaaagagcagtagcgcgaaagctcactcccacacgtcgagcttgcgatttttgtagaaatactcgcggtccttgtcgccgatttcacgcacgacctcgcagggcgcgccgtaggtgacggagttggcggggatggaatgtgtcacgaccgaaccggcgccaatcacgcaattgtcgccgatggtcactcccggcagaatcgacacgttcgcgccgacccacacgttgcgcccgctgatcaccggaatgcaatacgtgtaatggtgctcgcgcagcaccggcaacacggggtggccggcggcgcattagcacggggaacggttgaacgagaagtggattggcatgtggtggtatcgaacatactgatgcgtgtgccgccgagcctgtccagatggctgcctatatgaaccagtgacagaaaagcacgggaacgcgagcgagaggagtgtgcatggggcagttcggcgtcatgattggccagttagtcggatttctgatcatgctgatggtcgggtatggatgtgtgaggcttcgattctacggtcagacggcgttggacggcatgtgctcgttgctgctcaacgtgctcatccccgtgcttgtgttttcgaacgccgtcgatggtgcggaccgcgcgcagcttgccgctaactggggcgtgatgctgctgaccgccgtgatgtacgcgctgctcatcctggtgttctggctggtcgccaaactgttgcggctcaaaggttcgcgtagccatgtatttcaggcgtcgcttattttcggcaacgccggattcatcggcattccgttgattatggcactttggccgcagaacggcgcgatttacgtggcgctgatgtcgatcatcgaccagacgctgctctggacgtacggcgtatggctgtgcgagccggtcgccgaaacgactggcggcaacgcgattggctcgcgaggtgcggtcgcgaacggttcggtgaacggcgccggttcggtgggcaatgctggttcggcgagcaatgccgcaaacggtggttctccggccgtcgtccgcccctcgccaggcacccgcgtcctcggcctgcttaaacgattcgtcaatcccgccttcgtcggcgtgatgctcgccctgattctgattctgctcggcgtcaaggtgccggacatcatcctgaagccgctgcacaccatcggcaatatggccacgccgatgtcgctaatctacttaggcggcctgttcgcgctgaccaagtggtggggcgtcctcaaacgctacgaactctatgctggcctagtcgccaagatgatcgcattcccgctcgccttctacgcgctactgaccgcgctgaccggcgcattgccgcaactgccgatcacccatgacatggtgctgatgattacggtcatcgccggactgccgaccatgaccaccattgccatgttcaccggtcgcaagaacaacatgcccgagtatgcggtcggcttcgtgctcgtaagcacgctgttctcgctggcctccctgacgattgtgtcggcagttgtgttctgaattgtccccttcgacgaaaagaatgccgggggcctccggcgcttggaatttcatcgacgccgccaacgactcggcatccgaggcggccgtgccgtatttcaaggagatattcgattacgcgcgcacgctcgatccgcagcatcgtcctctgacctacaccaatctgatgatggccgccgcaggcaaagacaagtgccatcaattcgcggatgtcatctgcctgaaccggtattacggctggtatatgcaaggcgggtatcagctcatcggagccaagaaggccttcatcgacgagatgaaccaatggatgaacaccgaacccaacaagccattcctgttcaccgaatacgttgcggacaccgatgccggtgcgcacaagctgccaagcgtgcagtggagtgaggaataccagtgtgagtacctcaccatgcagcacgaagtgttcgacatgttcgaggcagtggtgggcgagcaggtatggaacctctgcgacttccaaaccggtgaaggcatcatgcgcgtcgacggcaacaagaagggcgtcttcactcgcgaccgtcagcccaaagccgccgcctatgtactcaaggagcgttgggagactaagtagcggcccgcccctggaatattccaggagcaacgcacatcgcataacatacaacgcaacatacgaaaaagaacctcgtgaaacgaatttcacgaggttctttctagttacgctgaatgactcccattagactcccacaagagaagagcaatggcggaattccaacgttgctaagctctcaaactcagatgtggaagtagagctcgtactcgagcggggtcggagacaggcgagcctggtcgatctcgtcgcgcttgaggccaatccaggtctcgatcaggtcgtcggtgaacacgtcgccggcggtgaggaagtcgtggtcctcttccagggcgtccatagcctcagccagggagctcggcacctgcttgatgccagcgtgctcttccggcggcagctcgtagaggtccttgtcgaccggctccggaggctcgatgtggttcaggatgccgtccaggccagccatcagctgagcggagaaggccaggaacgggttgcaggacggatccggagcgcggaactcgatgcgcttggcagccggggaggtgccggccagcggaatacggatggcggcagaacggttacgagcggagtacaccaggttgaccggagcctcgaagcccggaaccagacggtggtaggagttcagggacgggttggtgaaggccagcacggaggaggagtgcttgatcagaccgccgatgtaccagcgagccagatcggacaggccagcgtagcccttctcgtcgtagaacagcggcttgccgtccttccacagggactggtggcagtgcataccagtgccgttgtcgccggcgatcggcttcggcatgaaggtcgcagccttgccggccagagcggcggtctcgtggacgacgtacttgtacttcatcaggtcatcgcctgcgtgctgcagggtgttgaagcggtagttgatctcctgctgaccagcgccggccacctcgtggtgggaacgctcgagaatcaggccgaccttctgcaggttggcgaccatatcgtcgcgcagatcctgagtgtggtcaatcggcggaaccgggaagtagcccttcttgacgcggttcttgaaaccgatgttcggggtgccgtcttcctcaacgtcaacaccggagttccacggagcttcgatggagtcgacctcgtagaaggagcggttcatgccgttctcgaaacgcaccttgtcgaagatgaagaactcggcctcaggagcgaaggaggcggtgtcggcgataccggtggacttcaggtaagcctcggccttgccggcaacctgacgcgggtcacgggagtacggctcgtcggtcagcgggtcgacgatggagaaggccacgtcaagggtcttgtgcttgcggaacgggtcaacgaaagcggtctcaacgtccgggaccagcttcatgtcggactcgttgatggcctggaagccctgaacggaggaaccatcgaacggcatgccgtcggtgaaagcgtccttcaggaattcgctagccggcacggtgaagtgctgctgaacgccgataagatcggtgaaacggacggagacatactcgatgccttccttgttgataagggcctcggcgtcttccttggacttgagttcggtcacgggaccgctcctttcgtatgaaatataacggtatctatcgtaaaatcgcgcgtttcgccggctcgaaacttgggttacgagaatgtttcgtgactgtggccgacaatcgcgcaggcgcgttatttcaacgaaacatcattacagaatggaaacggaggctatcgggggagtgggtagaggtgtccgcaacgtggacagtggatattgacaggtgacgtaggtggatgtatgtggacgcgattatgagacatatgacgaagccccggaaccgattgaacggattccggggcttctgtgcgatttggtggtgtgctgccgatcagcgaccgcgcatcgcgcggcgggagatcttctgcgggtggttcgggtccatgcccttggggatggcataacccttcttggcctgcagcgtgcgcagacgatcgttcagcgtttccatctcggccttggtcagcaggaagcgacgacgcggatgaatcttggcgatcagtgcgttcttgtggttcgtgggctcatagctcttggacttggtcaccgtgctacgcagcttgtccagtggcacctgcttggggccgtggcccacggagatgcggtacaccggaatggaggagccggcggtgacgcccttgatatcgtgttcctgacgatccatcgccttcatgatgcgaccgtattcgccttcgccgatcaggtagatgccgttcatcgaagtgccgcgccagatggcatccttggtcttcgggtcgatccacaccggctcctgcgggaagttaaagccggctttctgcatgttgctcagcacgccgatggcggcaccaggcttgccgtcaatctgcttgtagccgactgcatccgcgcggcgggtgagcatcatggtggccagtagcatgccgagcatgatggcggtgatcatggtgaagatccaggtcagccaggtccacttggcaatcagaccgatgatgatcatcacgactacaggcagcaggaaagcaccggcctcaagccacggcagggccttgtcttccttagccgtgtacttgtagatctggatgatctgcttgattgtgctctgcttcttcggcttcgcgtccttttccgccatcacttcttcctttgttgggacgaaacacactagacaacatcttatcaggtgcgctggtccgaacttgtttgtgctggttggtctcagcgtgtgtgtaacggccgtccgtcggccttgagcagcgcctcgccgagcgtttcactgaacgtgggatgcgggtgaacgaggcgggctgcgtcggcgagcggcacatggttgccgaccagctgttcggcttcggcgatgatgtcggaggccatctgggagaccatgtgcacgccgagcacgcgcggggtgtccgggttggccgcgtcgcagccggagacgatggtcagtgaaccggccgtgccgctcatcagcatgcgcgcgttcgccagcatcggatagttggtctccttgatttcaatgagatcctctctcgcctgcgcctgttcgacggtgagcccgaccgacgccgcttcggggaaggagaacacgatttgcggcacggtggcttcgtccaccggcttgggattgagtccggcgatggtctccgcgatgacgatgccttgctcaaaagcacgatgtgccagcgcgtgaccggccgtcacatcgcccaccgcccatacgcccggtttgtcggtgcggccgtacgcatccgtggcgacatgtccgtggtcgtcaatcgtcacgccccatgctgggtcggtgatcgggtcacgcccgatggcgacaagggcgatttcgccccagacgctttgttcgccgtcctggccttcgcacgtgtagtgcacggtggcaccaaggttcgcgccggtgtccacatgggtgacgctggcgcgggtgatgatgttcacgccatgacgtttgagctcacgggtcagcgtggtgccggctctccggtcccaggctgagagcacacggtccttgcgaatcagcaaggtcaccttcgaaccggcggcgttccacatcgaggcgaattcaagggcgatggccccggcgccgataatcaccgccgacgagggaaattcgttgacttccagcgcctgtgtggagtcgatgagggcgccggcgaacgggttgccgggcaatgggcgtggcttggcaccggtggcgatgacgatgttcgtggccgtgaggtccatcgtggggccgctgggctcggggacatcggccttgtgataggtgaggatgtcgctttggtcgggggaagggacgaggtggacgatgtggttggaagttgctggagcggtctcatccgcatggaacgcggcattggctcggaacacggtgatgccgcgatgggcaagcagtccggccagtcctcccaccatcgtcttgaccacgcgcaggcgatagtcgcgcagcgtgccgaagtcgatgccattcaccgaggcgttgacgccgagctcggccgcacggtgcacggtgtcgatggtgtgggtggcggtgatgagcgccttggaggggatgcagccacggttgagacatgtgccgcctacggtggcgtcacgctcgacgagtgccactttcatgccgagttcggcggcgcgcaaggccgtggaatagccgccggggccggccccgatgatgaccagatcaaactgttcgctcatgattgcctccttgatacatataagtatggctcccacgctagggagccatatgcggctatcgccgccacttcgcctaaaaacagtccactggactgttttctttacggctcagcccctcaacgaggggagccagagtatatatggacaatcagtccgccggccagtgaccgcgcttcgggtaacgcggcttgggaagcctccaacgacgcatctgaatcgaacggctccaagcgtaggagaaggagcgggagcccttggacacggaccgttcgccgtacttggcgatgagcttggccttgagcttgcgccacatcagccatacgtcgatgatcacggcaatcaggtaaccgtacataagcgccatcatgatgatggaagcccactggttctgcatcaaagaagtgacgaacatggagacgatcagaatcgcgaaggccaccgggatgaaccattcaccaaggttgaaacgggcatccacataatcacggatgtagatacgccaaggcaagcgttccgccttgggcatgtggttgatatcgccattctgcatcgcctcgtactcggcgttctccttctcacgcagacgggctttggcggccttggcgctggccctgcggtccaccggaaccagcggacggataccggcggcctgagcctgcttcatcttcggggtaggacggccttttttctcagaaggattggcggccttcttcggggcctgctcaacaggagcctggacctcttcttttttcttaaacggattccatgtcatgctttgaggttacggtgacgttcagacacttgtacactggcgcagccattgcaatgacgccgctcacacatatatataaaggaggaccatcatgacaacgctcaccgctgacgagattcgttcgcgcgtcgaaaccgattggaaccgcatcgtcaaggtactggccgaaaaggtcgcgctgcagtcgatctccgccaagggcatcaccgccgaacaaatgaagcgctccgctgaattcgtggcagacgaactgcgcctcgtgggtgtggataccaaggtggttcaggcttccaatgccgacggcactccgggcgcatgggaggtcatcggctcgcatatcgtttctccggacgccctcaccgtgctgctctacgcccatcacgacgtgcagcctgttccggacccggccgagtggaacaccgacccgttcgtggccaccgaaattgacggccgcctctacggccgtggctccgccgatgacggcggcggtatcgccatccattccggtgcactgaaggccctgggcgacgacctcaacgtcaatatcaaagtgttcatcgaaggcgaagaggagatgggctcgccaagcttcattcccttcatcgaggctcaccgcgacgaattcgccgctgacgtgattatcgtggccgattccggcaactggtcggcggacattccttctttgaccacctcgctgcgcggcaacacctgtgtggacgtgaccgtgcagggccttgagcatccggtgcactccggccagtacggcggcccgattctcgactccaatacgttggccgccatgctcatcgcttccatgtatgacgagaacggcgatctggccgtacccggcgtggccgcggaagagccgatcggcggtttgcagcacgaccttgacgaaaccaccgtgcgcaaggattctggcgtggtggccggttacgagttcgccggcaccggttcactggcctcacgcctgtggaccaagccgtccgtgaccgtgatcggcttcgacgcccacccggtcgagggatccttcaacgtgatcgccccggagacccgcttccgtctgtcgctgcgcaccgcgcccacccagcgccctgaagaagcgcaggaagcactggctgcattcctcgaatcccacgcgccgttcggtgccaaggtcactgtcgaacgcggcgaaaacggcatgggctgggccatggacccgaccgccgtggccaccaaggacgcgctggaagccatgaccgaggccttcggcgttgagcccatcaacaagggcgaaggcggctccattccgttcatccccgaactgcagcgcattttccccaacgctcaggtgctggtcaccggtcccgaagacccgaaggccaacgcccacagccccaatgagtccatctccctgcccggcctcaagaacaacgtgatcaccgaggctttgctgctggacaagctcggcaagtagccgaaccgcatcggtaatggtagtgagccgccgtcaggtaggtcacagatgtggctattgcctttgacggcggcttgctttatagtcgggagttgacacgggagctgccgttgggcggctgagaggagactcatagtctcgaccgatggaacgtgaccggataatgccggcgcacggaaatgtcgctcttacctacccgtgcctgaaccaacccgcgcgtggccacgaacatatgcatcatgtgcgtacatatatccacgtatgttcggcctgcgtgcgagcagaagaaaggcacattcatgactgaagctgtggccaaagccaattacaagtggcgcgtcgtcgatatcgtcgtcgccgcaatcatcgccgtcgcatccggcgtcattttctggggctgggacattgtctgctccgccccgctggccctgtttgaaggcgtgacccccggtttcgagggtctgctcaacggattctggctgttcgctggcccgctcgctgcaatcattgtgcgcaagcccggtgccgcactgtttgccgaaaccctcgccgccttccttgagcttacgctgggcaaccagtggggcgtcggcggctcgctgatcgtcggcatcatccagggtctgggtgccgaaattgccttcgccgtcttcgcttggaagaagtggaacatcggcaccaccatcctgtccggtgcgctcgccggcgtgggctgctgggcctactactgggccaccaacccgggctggaacggcctgcgcgtcacttggtatctggtgggctccatcatctccggcgtcgtgatcgccggcgtggtggtctggtacttgtctcgtgcgctcgccgtcaccggtgctctggagcgttttgaatccggccgcagcaaggcgcgcgtctgatgcagattaatccggctgcggtagaggccagcggctggggatggcggcacgccacgcgtaaggacttcgcgttgcgtgccgtcgatttcaccatccggccaggtgaacgtgtgttgctgctcggtgcttcgggcgcgggcaaaagcacgatgatggccggtctcgcaggcgtacttggcggcgatgaggaaggcgagcaggagggctcgctcaccatcgatggcgtcgatgcgcgcgaggcgcgaggtcgcgtgggactggtgcttcaggacccggactcgcagatcattcttgaacgactgggcgatgacgcggccttcggctgcgaaaacctcaacgtgccgcgcgaggagatttggcagcgagtgcgcgaatcattggatatggtgggactcggcggactcgaactggatcggtccacccgccatctgtccggcggtcagcgtcaacgtctcgcgttggccggcgtgctggctatgaagcccggtctgctgttgttggacgaaccgaccgccaacctcgatcccgaaggcgtggtcgaagtgcatgacgcggtcaaaaaggtcatcgaggccaccggacagaccatggttgtggtcgaacatcatatcgatgtatggctcgatctggtcgatcgcgtgattgtgctcggccgacccgatgcaagttcgcccacgggtgcggtcattgccgacggcaagccggacgaggtgttcgccgagatgggcgacgtgttggccgccggtggcgcgtgggtgccgggccgtgcgattcccgattactcaccgaagcaggagtctgcgcacgatgcgccggtgctcagcaccgagaacttaagctttggccgtggggccgctcttggcgttggtatcaatctggatttttatcccggcgaagtaacggctctgatgggtccgaacggcgcgggcaaatcgaccttggccttgaccttggccgggctactcaagcctatcgccggcaaggtgctcatcgccgacaacctcaagcccgcgcatgccgggcgtgagccgatcgactggaaaagcaaggaactgctgggccgtatcggcatggtgttccaggagcccgaacaccagttcgctgccaactttgtgcgtgacgaggtatccatcggccccaagtcgatggggcagagccaagacgaggcttatcagaccgccgaccgcatgcttgagcagatgaatctcacgcgcttcgccaaagccaacccgtacaccttgtctggcggggagaagcggcgactgtccgtggcctccatgctggccgccgcacccaaagtgttggtgatggacgagccgacattcggacaggatttcagtacgtggaatgaaatggtcaagctgatcgccgccatccgcgaccaaggctcgtgcgtgatcatggtgacgcacgatgaggcgctggtggatgcgctgggcgcacgacgtgtgatgttcgaggaggcgaaggcatgagtgacgtggtaaccgtcagcccgcaggaaacgcgcgtggagccggtcaaagcctcatcgccctcatggttcatcgcgcgcatcaacgcggtcagtcgcatcatcggtgcgctgttgctgtgcattccgatgttcatcagtctggatgcggtatccgcatccacggcgctcggcatcgaattcgtgctgctgtggattggtggcgtggctccgtggaccgtatgccgtaagacctggccggtatggatcgccgccgccggcagttttatctccgtgttcctctacggccgcacctcgggcgagatcctgtggcagggtggctggattgtgatcagcgagggatccatcaatctggccatcgccacggctatcagggtggcggccattgccgtacccggcgtgattctggccttgggcctcgatcccactgatttggcggacggtctggttgagattctgcacttctcaccgcgattcgtatacggcggattggccggattgcgcatgtttacgctgctgcaggaagattggcgcgcactcggcttgtcccagcgttcgcgcggccttggtgacggcaacgccatcgcccgtgccctctcccaagcgttcggactgctggtgctctccatccggcgtgccaccaaacttgccaccgccatggaagcgcgcggcttcggctccggcgccccacgttcccaagcccgcatctcgcgtctgaagcctatcgactggatcttctacgtcatctgtctggccgtcccgctggcctccataggcgtagccgtcggcaccgggaattggcacttcgcctttcagggtgtctgaaaggcggcagactggcacagtgcctttcagggtgtctgaaaggcgacagattagcacagtgcctttcaaggtgtctgaacgccttatgatgcccccgctggcgggggctgtcggcgtagccgactggggtggttccagcctcgaccaccctcagtctcgcgactgacgtaatgacccggcagtagggtagtggctatgcccatcaacgcccagattcttgataatccgaaatccgaccgcgtgcgccgcatcgccgatctgacccgcgccaaaggccgcgaacgttcgggccgttttcttatcgaaggcccgcaatccgtgcgcgaggccgtcacttggcggccggacgtggtgcaggacctgtatgtagaggtttcgcaggcgctggaacatccgcgtatcatctcctccacgttggagaagatcgtcgaaacctcgcaggatgccacgatttatgtgcactactgcaccggcgacgtgatgcgccgcatcagtccggacgcccaaggcatcgcggccgtcggcaatgccgagtccatgcacgccggagccgatgacgtcgaacttggcaagaacggtcgggccccgcagattgccgccttctggcaggtgcgcgacccgggcaacgccggcaccgtgatccgtgcggccgatgcggccggctgcgacgccgtaatcttcgtggacgactgcgtggacgtgctgaaccccaaggtcatccgctccaccgcaggctccctgttccatctgccggtactcgccatgagcaccgacgaattcttcacctggacaggcgaccataatatggacgtctgggccgccgacgtatacggcaccgaagaacgcaagccggaaagcctgcccgcagtactggcggacaaggcggcggtcgaggctccgaaagccgtgctgttcggcaatgaggcgcgtggcttggaaccggacatcctcacgcgctgcggccgcatcgtctccatcccgctttatggcaaggccgaatcgctgaacctcggcacctcggccgcggtgatgctgatgtcgctgtctatgtcgggtcatgttgaaagaatgtgaaaccggtaaaaacgctgtgaaacgctgagaaaacatcagacgaaagggttctcgtggcagaacaaatggtgttcgacgccgaccaggtgaccgctgaggttgccgagggcatcgagaaaatccagaacgcctccaacctggaggagctcaaggccatcaagacaacgtacgcaggtgccgattcggcgatgaccaaggccagcaaggccattggctccctgcccgccgaccagaagaaggaagccggcaagctcatgggcaagctgcgcgccgacttcggccgcgcctatggtcccaaggaggtcgagctcaaggaagccgccgagaaggccgcgcttgccgccgaaaccgtggatatgacgctgccggtgagccgtaagcctctgggcgcccgtcacccgctgcctaagctgatggaggacgtcgaggacttcttcatctccatgggctggcagatctcctccggcccggaaatcgaagccgaatggtacaacttcgactccctgaatttcggcccggaccatccggcccgccagatgcaggacaccttctacgtcaagggcaatcaagccaaggacgccgccggtttcgtcggctccaacatggtggtgcgtacgcagacctcctccgatcaggtccgtgccctcctgacccgtggagtgccgctgtacatcgcgtccccgggccgcgtgttccgcaccgatgagctggacgccacccatactccggtgttccaccagtgcgaagccctcgccgtcgacaagcacctgaccatggccgacctgaagggcgtgctggacaagctcgccgtcgccatgttcggccctgaagccaagacgcgcctgcgcccgagctacttcccgttcactgagccgagcgccgaactcgacctgtggttccccgacaagaagggcggccccggctggctcgagtggggcggctgcggcatggtgaacccgaacgtgctgaagtccgccggcatcgacccggacgtctacaccggtttcgccttcggcgtcggcatggagcgcacgctcctgctgcgcagcgacatcaacgacatgcacgacctggtcgaaggtgacgtgcgtttcgccgaacagtttgtgatgggggagtgattcagccatgcctatgatcgatatcgattggctcaaggaccatgtcgaggttcccgaaggcctgacctacgaacagctcgccaagggccttgtcaaggtgggtcttgaggaagaggagattcactcctctcaggtgaccggcccgattgtggtcggctacgtggtcgacgccacccccgaaccgcagaagaacggcaagaccatcaactggtgccacgtggactgcggcgacgaatggaacgagaccgacgaagacggcaacaaggtgccgcgcggcatcatctgcggcgcgcccaacatgaaggccggcgaaaaggtcgtcgtcaccctgcccggtgccgtgctgcccggcgacttcaagatcgaaccgcgcaagacctacggccacatctccaacggcatgtgtgcctccgaacgtgagctgggtctgggcgacaaccacaatggcatcatcctgctgcgtcagtatggcttctccgaggctgaatacgaggctctgaagcctggtcaggacgccatgcacctgctgcacctcgaccagcctctgcttgagatcaacatcaccccggaccgtggctacacgctgtcctaccgtggcgtggcccgcgaataccaccactccaccggtgccgcctacaccgatccggccgtggcactcaacgagaaggccccggaacctgctgactaccagcccggcaccccggtggacatcgatgttgaaatcgacgataacaatccgattcacggcgtgcccggttgcgaccgctactacgcgcgtatcgtcaaggacttcaatcccaacgcccacacgcccaactggatgcgccgccgcctgatccgcgccggcatgcgctccatctccttggccgtggacgtgaccaactacgtgatgcttgacctcggccagccgatgcacgcctacgacctcgacaagctcgaaggcccgattgtcgtgcgccgcgccaacgagggtgagaaactcaccaccctggacggcaaggaacatgacctgagcgtcgaagatctgcttatcaccgattcgccgaacggcgaacgcggctcgcgcatcctcggccttgccggtgtgatgggcggcctgtatggcgaagtgaccgccgacaccaagaacattcttctggaggccgcgcacttcgatcaggtgaccatcgcccgttcggcccgtcgccacaagattccatccgaggcctcccgccgcttcgaacgtggcgtcgacaccgcgctgcagcctgccgccacccagatggccgccgaactcatggccaagtacggcaacggcgagcccagcgaacacccgaacgacgtgaacaacacgccgcgcgccaaggccatccacttcaaggcctccgaagtggcccgcgtagccggcctcgacgtggacatcaaccgcatctccgacatcctgaccgacattggctgcacggtggccggtggcggcaacggtgagttcgccgtaaccgcgccgagctggcgtccggacttgaacgagccgtgcgacctggtcgaggagatcgcccgactggtcggctacgaccagattccgatcaccgtgccgccggcaccggtcgagggtctggtgggcctgaccccggaccagcagcgtcgccgtcgcgtggcggacgagctcgccgagttcggcatggtcgaatcgctgagctacccgttcgtgggtgacgacgattacaaggccttcggcttcgacccggaagccaccaagaaggtcagcgtcgagatcgccaacccgctctacggcgaccgtccgtacctgcgtcgcgagattctgccgaccctggccaccaccgtgcagcgcaacatccgccgcggcatcgaaaacgtgtccctgtacgagctcggccacgtctacctgtgggatccgaacgcgcccgtcatcccggcactgcccggcggcgtgcgccccaccgacgaacagctcgccgcgcttgacgccggtctgcccgaacagcccgaccatgtggccggcatcctgaccggtctggccgaggacgacggctggatgggcggcaagcgcccggtcgactggtccgacgccgtcgaggccgtgcgccgcatcgccggccgtatcggtgccgcaatcgaactcgaccagcccgccgccgacgatgtgccagtccaatggcaccccggccgcgccgcccgcgtcatggtgggcgacgtcttcaccggctgggttggtgaactgcacccgcgcgtcaacgaggcgctcggcttcccggcccattccgcggccttcgagctgaacctcaccgcgctgttcgccacgctgaccggcaagcccgtccaggccaagccgatctccacgttcccgccggtcaagcaggatttggccttcaccgtggacgagaccgtgaccgcaggccagcttgagaacgtgattcgcaaggccgccggcgcgaacctcgaatccatcgaactgttcgacgtgttcaccggcgaacaggtgggcgagggcaagaagtccctggcctatgcggtggtgttccgttcaccgagcaagacgctgtccgccgaagacagcgacgccatccgcaaggccatcgtggctgaggccgccgaaatcggcgcccagctgcgcgcctgacccaaccaatcatccgaatcgaggagcgccatgagccaagcggagcaggacaagccgaaatacgggcagtaccagcagcctgaatatggtgctatgtctggccaatacgggccgaattacaacccgtatatttatggcgctcccgagccggatactaagaaggattccgccgcagccgctggcgataacggtggcgcggcacaatctcagcaggctggccagccgtatggtcagcagccggcgtggcccggcaatcagcaggcgggcggctggccgtacgctcaaggcggccaacagtccggtccgggcgcatatccgggcgggtacccgggcatgcagggccagccgtatggtcaacagccgaacggtcagcctcaccagccgcattattaccacggcatcgacctgaacgatccaaaccagaacccactctacgggcactgggattcgtatgcgatcatctcctttatcctcgccctgttcttcccggtgccagtgctctcggcactgatgggcgcggtggcaatgtggcgcacgcgcactttccatatgaagggcttcggtttggccgtggccgccgtggtaatcaacgtgctgtacaccatcgccgtcatctggatggccttcaatggctatgacgccatgagcctttaccaggaagccctccagcaactgaccggcggcaccggctcctcctccgactccatctccgcataagtagcgttcacataccaacacacccactgcataaatatgcaatagtctgcataatcgcgtatactcatccgaagacacatcagtgaaaagagatgagtatggcgaaatatacagtggccgtggccggtgccacgggctatgccggcggtgaagcgctgcgcattctggccgcgcaccccgacttcgacatcacctgcgtggcaggccattcctcagtgggggagtcgatggccaagcacatgccgcatattccccaactggccaatctggtcgttgaagataccacgcccgaagtgctgaacgggcatgacgttatcatcctcgcactgccgcacggtgcttcgggcaagctcgcctcgcagctcgatccgaatgccgtggttgtggatttgggcgccgaccatcgcctcgaagaacaggccgcttgggatgagttctacggcggcgatttctatgagcattggacctacggcatgcccgagctcatcaccggcaaagctgcggacggctcctacacccgccagcgtgcggcgcttcctggcaccaagcgcatcgcaggtcctggctgcaacgtcaccgccaccacgctggccctccagcccggcatcgccgaaggactggttgaatcgcaggatatcgtggccgatctggtcgtcggatactcgggtgccggcaagaatctcaagcgcaccaacctgcttgccgccgaggccctgcaatccgccctgccgtattcggtgggcggcaagcaccgccacattcccgaaatcctgcagaacttcgcccacgcggccggcaagagcgcggccgaagccagcgaattcacgctcggcttcacaccgattctcgcccccatgtcccgaggtatcctcgccaccgtgtccgcccgcatgacggacaaggccaagacactgagcgatgaggagattcgcgccgtatggtccaaggcctatgaaggtcaggacttcatggtgctgctgcccgagggcacgctgcccgccaccggcaacatcatcggatccaacgcagcccacctgcaggtcgtcaccgaccgcaaggccggccgcatctacgcttttgccgccatcgacaatctcaaccgtggtaccgccggacaagcggtccaatcactgaacatcgcactaggcctgccggaagacgcgggcctgaccaagatcggagtagcaccgtgagcgttacatttgcacaaggtttctccgccgccggcgtggcggctggtatttcatccgtcgaaggcaagaaggacttggccctcgtggtcaacaacggcccgctcgacgcggctgcaggcgtgttcacctcgaaccgtttctgtgccgccccggtgcagtggagccgtaaggtcgtcgccgacggtcacgtcaaggccgtgattctgaactccggcggtgccaacgcctgcaccggcgaggccggttacgcccagtccgtcgccaccgcggaaacggtcgccgggctcatcggcgccgaaccgaatgatgtggctgtctgctccaccggtctcatcggtgaactgctgccgttggacaacgtgctggctggtgccaagagtgcccatgaggctcttgccgccaccgccgaagccggcaccgacgcctcccacgccatcatgaccaccgacaccaagccgaagacggtcgaactgaccggctccaacggctggaagatcggcggcatggtcaagggctcgggcatgattgccccgcagctggccaccatgctgtgcgtcatcaccaccgatgcggttgtctccgccggtcagatgcaggccgcactcgctgtggctgccgaacattcgttcaaccgcatcgacgtggacggctgcatgtccaccaacgacacggtcctgctgctcgcctccggtgcctctggcgtcgaaccggacaaggacgaattcaacaagctggtgcgtgaggcctgcgcatccctgtcccgccagatcatcggcgacggcgaaggtgcctcccacgacatccgtatcaccgtcaccggtgccaccagcgaagacgcggcacttgcctgtggtcgtgccgtcgccgcctcgaacctgctcaagtgcgccatctccggcaacgatccgaactggggccgcatcgtcagctccctgggcactgtgccacctgaagtcgcgccttacgattcgaacaaggtgaccgtggacgtcaacggcgtgcgcatctgcgagaacggcggtgccggccgcgaccgtagcgaggtcgacatgaccccgcgcgaagtccacattgacatcgacctgaacaccggctcggacgccgaggccaccgtctggaccgacgatctcacccacgaatacgtccacatcaacgccgactacgaaagctgacaaacagcccagtgggctgtttgtagcagccggcagcgatagcgtcgccggcgtcgcatataacgcaaacagcccagtgggctgtttgtagcagccggcagcgatagcgtcgccggcgtcgcagaaaagagaaaaattgtctacagaattgaagggacctgggttccatttcgacgtgcacaccgatttgcgcgccgatcagaaggcagaagtgcttattgaagcgctgccatggctggaggagttcgccggccagcgtatcgtcgtcaaatacggcggcaatgccatggtcgatgaccatctgaagcagtgcttcgccgaagacatggtctttctgcgtcaggtgggtctgcacccgattgtcgtgcacggcggcggcccgcagatttcccacatgctcaaggccctcggcatcaaatccgaattcaagggcggcctgagggtcaccacccccgaggccatggatgtggtgcgcatggttctgaccggcaaggtttcacgcgaactggtaggcctgatcaacgcgcacggcccgctggccgtaggtctgtccggtgaagacggcggcctgttctcggccatgcagcgcaggcccatcatcgatggcaagtccaccgatatcggcctggtcggcgacgtggtttccgtcgatgcttcggcagtcgaggatctggtggccgccggtcgtatcccggtcgtctcttccgtggctccgaacgaagaagatgccactgaagtgctcaacgtgaacgccgattccgctgccgccgctttggctgccgctgtgggcgcacacaagctcgttatcttgaccgatgtggatggtctgtacgccgattggccggacaagaattctctgattggccggatcggtgtggaaaccctgcgcgatatgctgccggacctggaatccggtatgcgacccaagatggaggcctgtgtcagggccatcgacggtggcgtgccccaagcccatatcatcgatgggcgcaagccgcattcgattttgaacgagatattcacctccgcaggcatcggtaccatggttatgcctgatgaaggactggaaatgaggagctcttatggctactgagcatgaggaaaaactaggtacggaagacagcaagtggctgggagagtactctcaggtccacatgaatgtgttcggtacgccgctgcgcgtcatggatcacggccaaggtgcccacatctgggatgttgacggtaacgaatacctcgatttcctggcaggcatcgccgtcaattccctcggatacgcccaccccaagtgggtcaaggcggttgccgatcaggctgccaaggtggctcatatcagcaactatttcgcgtccgagccgcaaattgaattggcatcaaaactggtcaagctggctggtgcacctgaaggctccaaagtctacttcggcaactccggtgctgaaggcaatgaagctgccctcaagctcgccaagctgtatggacgcaccttgcctggtgccctgccttccatcggcggcaagcccgcacgcattctcgcaatgactcacggcttccatggccgtacgatgggtgcgctgtccgccacatggaaacccggtatccgcaagccgtatgatccgctggtgccgaacatcgaattcgtacgcgccggcgacaaggtcgccctgcacgacgcttttgcacagaccggtctcggtcgctatggcaagggtccggtggctgctgtgattctggaacttatccagggcgaagccggcgtgcagccgttgggcgccgattacgtcaagttcgtgcgcgaactgtgcgatatcaaccacgcgctgcttatcatcgatgaagtacagaccggtatcggacgtaccggcaagtggtttgcattccagcgtgacgatctgtccggcggcgtgacgccggatatggtgactttcgccaagggtgtggcaggcggattcccgatgggcggcatgatcgctttcggcgagaaacttgcggctctgttcactcctggttcccacggctccacctttgccggcaatccgctgggtgcggctgcgggactcgccactcttgacgtgattgaagacgagaatctggtggccaacgccgaagctcgcggcgaacagctgcgcgatggcattatggccaccggtaatccgctgttcgtttccgtacgcggccgtggtttgctggacgccgtcgagctcaagcatccctgctcccacgcggtgatgaactactgcctcgaacacgggctcatcgtcaacgcggtggctcccaatgcgctgcgtttcgcaccgccgctgattgtaaccgcacaagacgtggaccaggcacttgccatcctcaaggatgtgcctacggacctgcccgacgactgatttctctctgtcactgccgacccaccgatccaaggagatcatcatgaccccagaacttcgccacatgctgcgtgacgacgacctcaaccatgaggaacagaagcaggtgctcgaacttgccatcaagttccaccacgaccgcttctacaagcagccgttcgccggtccgcaggccgtcgccgtactgttcgacaagccctccacccgcacccgttccagcttctccatcggcgttgccgagcttggcggctacccgctggtcatcgacaagtccggctcccagctgggccgtggcgagcccgtggccgataccgctcgtgtgctcaaccgcatggcttacggtgtggtgtggcgcaccttcggccagggccgcgtcgaagaaatggccaagtactccacccatccggtggtcaacgccctgaccgatgacttccatccctgccagattctcgccgacttccagaccatcgccgagcaccgaggcggcgtcgacaacctgaagaaccagaccatcgcctacctcggtgacgcggccaacaacatggccaactcctacctgctcggcggtgccgtggccggcatggacgtgcgcgtggccggcccctacggctacctgccccgcccggacatcgtggccgacgccaagcgcgtcgcggccgagaccggcggctccatcctggtcaccaccgatgccaaggaagcggtgaaggacgctgattgcgtgttcaccgacacctgggtctccatgggcgaggaggccgaatacgccatccgttccaagccgttctgggattaccaggtcaacaccgaacttatggcattggccaagccggatgcgctcttccagcactgtctgcccgcctaccgcggcaaggaagtcaccgctgaagtgatcgacggcccgcagtccgtggtgtgggacgaggccgagaaccgtctgcacgcacagaaagcgttgctgacttggttgaccggcaaggcccgtggagacgaaagcctgctcgcatgagtgaaaccggtccgtccctgcagcgccctgccaccagggcggcgcggctgagtgccatagaacaggcgctcgccacgcatatcatcacctcgcaatcacagctgtccaaaatccttatcgacgagggcattgcggtgactcaggcgaccctgagccgcgatcttgacgagatgcatgcggtgaagacccggctgaaggacggcacggtggcctacacggtgggtcgcagcgtcgttgcttcggaaggtgaggatgtaggggagcgcggtgaggcacagatgtcccgcgtgctgaacggactggtcacctcggtggctgccgccggaaatctggttgtggtgcacacgccttccggtgccgcacaatacgtggcctcggtgattgacaagcagccgatcgaaggcgtgctgggcaccatcgccggagacgacaccgtcatggtgatttgcaccaatgacgacaccgccgtctcccgctccgactggctactaagtctcgcttccaaataaccaacacgccgtgcataaatatacagtcctctgtatatacttgcatcagtttgtttttcagaccttgaacgaaagggaaccaatggcagataacaagcgcattgttctggcctactccggcggtcttgacacctccgtcgccatctcgtacctgaaggagcgcaccggcaaggacgtcgtggccgtgtccctcgacgtcggccagggcggcgaaagcctcgagaccatcaagcagcgcgcccttgcctgcggagccgtcgaatcctacgtggtcgacgcccgtgacgagttcgccaacgaatattgcatgaaggccctcaaggccaacgccatgtacgaaggcgtctacccgctggtctccgccatctcccgtccgctgatctccaagcacctcgtgcgcgccgcccaccagttcggtgccgacaccatctcccacggttgcaccggcaagggtaacgaccaggttcgtttcgaggtctccattgcctccatcgacccgacgctgaaggccatcagcccgattcgcgacctgtccctgacccgcgacgtcgagattgcgttcgccaaggagcacaagctgccgatcacccagaccgagaagtccccgtactccatcgaccagaacgtgtggggccgcgccattgagaccggcttccttgaggatccgtggaacggcccgaccaaggactgctactcctacaccgacgacccggccttcccgccggtcgaagatgaagtcgtcatcgagttcaaggaaggcgtgccggtcaagatcgacggacgtgacgtcactccgctgcaggccatcgaagagatgaaccgccgcgccggagcccagggcgtcggccgcatcgacctcatcgaggaccgcctggtcggcatcaagtcccgcgagctgtacgaggccccgggggccgtggccctgattaccgctcatcaggagcttgagaactgctgcctcgaacgcgaacagcaccgcatcaagcgcgacatcgacaagcgctggggcgagttggtctacgatgcgcagtggttctccccggcgactcagtcgctcaacgcgttcatcgaggacacccagaagtacgtgtccggtgagattcgcatggtcctgcacggcggtcgcgccgtcgtgaccggccgtcgttccgactcctcgctgtacgactacaagctcgccacctatgattccggcgataccttcgaccagaagtcctccaacggcttcatcgacatctacggcctgccgtcccgcgtggccgcagcgcgcgacgtcaagttcggcaacggcatcgaggtcccggagaacaccgtcgagtaatcatttactttggctcccctcgttgaggggccgcgccgtaaagcaaacagcccagtgggctgtttgcaggtgaggtgcgaacgacagtgagccaacaatcagcagccgtcaggctgtccgtaattacaggacgctgtcgccgcagatgactgaggggagtacgagcaaagattatgctcgtgctcccctcgtttttttgccgatgacggaagaagctcagtgctctccgtaatgagttcggcagacggctatttccaggttttgaacatcgttacccgtaatgcggtatacgatgcggttcttttcatcaatacgacgtgaccagtatccctgacattgccgccatggaatacgaacaacttgaatccaccggtatgtagcccaacgctgatagtctgacaagcagtctgatttgtttgcaatccatggtttcaaggagccttcatgactgagaacaacgaacatctggccctgtggggtggtcgctttacgtctggtccgtcgccggaattggcccgactgtccaagtccacgcagttcgactggcgcttggccgacgacgacatcgccggttcccgcgcccacgcccgtgctctcggccgtgcgggacttctgaccgccgacgagctgcagcgcatggaggatgcgctcgacacgctccagcgccacgttgacgatggctccttcgcccccatcgaagacgatgaggacgaggccaccgccctcgaacgcggtctgattgacattgccggcgatgaactcggcggcaagctcagggccggccgttcccgcaacgaccagatcgcctgcctgattcgcatgtggttgcgccgtcactcccgcgtaatcgccggactcctgcttgacctcgtcaacgccctgatcgagcagagcgaaaaggccggccgcaccgtgatgccgggccgcacccacatgcagcacgcccagcccgtgctgctcgcgcaccagctcatggcccacgcttggccgctgattcgcgacgtgcagcgactgatcgactgggacaagcgcatcaacgcctccccgtacggctccggcgcactggccggcaacacgctcggcctcgacccggaggccgtggcgcgtgagctcggcttctcccgcgtgaccgacaactccatcgatggcaccgccgcacgtgatctcgtggccgaattcgcgttcgtggccgccatgaccggcgtggacatctcccgcctgtccgaggagatcatcatctggaacacccaggagttcgccttcgtcaagctcgacgacggctattccaccggctcctccatcatgccgcagaagaagaacccggatatcgccgagctcgcccgcggcaagtccggccgactcatcggcgatctgaccggcctgctggccaccctgaagggcctgcccaccgcctacgctcgcgatctgcaggaagacaaggaggccgtgttcgaccaggtcgatacgctcgaagtgctgctgcccgccttcaccggcatggtcaggaccatgcacttcgacggcgaccgcctggaagaggaagctccgaccggcttcgcgctggccaccgacatcgccgaatggctcgtcaagaacggggtgccgttccgccacgcgcacgagctctctggtgcctgcgtcaagctcgccgaaggccgcggccaggaactgtgggatctgaccgacaatgacttcatcgagaccttcgccgcgttcctgccggccgacaaggctccgggagtacgcgaagtgctctccagccacggttcggtcgactcccgcaacggcaagggcggcaccgcttacggtcgcgtgcgcgagcagatcgccgacgccaaggccgaggtcgaagaactcaagctcttccccgcatccacgtcggatggctccgcctacaaagcccccggcacgttctagtcccaatgaagctccctctgatgagggagctctattttgttgttgtcactgcaacggcatacactgagaaaccgtaacgaacgggagccgtgaggctgagaggaagtcgccagacttcgaccggggaacttgacgcgggtcatgccgccgtaaggaatcgttgtcgcagatttgccgggttctccgatacagctttcattccgtttgcataattcagccgtgagacggtcgtgatggagccaatacatcacagcggtcgaacggtcgcatgattgggttcatgaatgggcgcaccacttaaggtacggttcgtttcgtgcacccttttttactatctgaaaggatattatgcaggtcaacggagagcaggtcacgctcgagacgccggtcagcgtcgccgattatctcgaagcgcacggattccgcgccgagcgtgtggccatcgaactcaatggtgagattatcccgcgcgataagcgtgccgacgccatgctcgacgaccagtgcgtcatggaaattgtgcagtttgtacagggtggatgaaaggaaaagctatgagcaatattaatccggttactgaagcatctgttgaggcgactccgctgccgccgcagcccgccgtcaccaatccggtcggcaccgccgcgccgattctcccggtggaagacaagccgctgaacctgggcggtcacgagttccagtcgcgattcattctgggctccggccgctacgacctgaacctcatcaaggctacggtcgaacatgcaggcacgcaaatcgtcaccatggcactgcgccgcgcgcagaccaccgagaacagcgtgctcgactacattcccgaaggcattacgctgctgcccaacacctccggtgcgcgcaacgccgaggaagccgtgcgtatcgcccgactggcacgcgaagtgtgccacaccgacttcgtcaaggtcgaaatcgaacacgagaccaagtacctcttgccggacaacgccgaaaccatccgagccaccgaaatgctggccaaggaaggcttcgtggtcatgccctacatgttcccggacccgattgcggcccgtcagctggaggaggccggtgccgctgccgttatgccgctcggttcgttgatcggctccaatatgggcctgcgcatgcgtgacttcatcgaaatcatcatcgccaacgcgcatgtgccggtcatcatcgacgctggtatcggccgtccgagccaggcctgcgatgcgatggagatgggtgcggatgcggtgatggcgtacacggccgttgcctctgctggcaatatcccgctgatggctgaggcgttcaagcacgccatcgatgctggtcgtgcggcgtatttgtctggccttggcaaagtgaccgagggacaggctgtgccgtccagcccgactacggggtatttgcactgacacttttattagctcccctctctgaggggagctggccgcgtagcggactgaggggagatggaaacatggagaaaacatggcattgactgatgaacaggtggagcggtacgcgcgccatctgattttgaagggtgtgggggtcaaagggcaaaagcggttgctggcctccagcgtgctcatcatcggagcgggcggtcttggttctccggccgccctgtatctggcggcggccggcgtcggccatatcggactggtggacggcgatgtggtggatatgagcaatctgcaacgccaaatcatccataccactgcacgtgtcggagcgcccaaagtggaatccgcggccacagccatccgcgcgctcaacccggatgtgacggttgatacctactacgagctcgtcgacgcgagcaacatcgccggcctcatcgaaccgtacgatctggtgatcgatgccaccgacaacttcgccgcaaaattcctcatcaatgacgcctgcgtgctggccggcaagccgtatatccatgccggcgtggtcggattcgccggtcaggtgatgaccgtcattcccggcgaaggcccctgctaccgctgcatcttccgcgacctgcccgccgccggtgagattccgacctgcaaggaagccggcgtactgggcgcggtggtcggcgtgatcggcagtctggaggcgactgaggccgtcaagctgattgccggcgtgggggagccgctcgtggctcgcatgctcactgtggatgccctgaccatgaatattcgacgggtcccactgccaaagcatgtgccggattgcccggtgtgcggtgagcagccgaccattactgctattgatccggccaactatattcagccggcctgcgcgatttagagctatgtggtgcccctccttgaggggtgccaagatcagaacgagaggggaagaacatgcctattgctttgcataatgcggtcgatgacgatgagagcagtgaagcatcgtaccgccgcatcacgccggcggaatttgccaagctcgacccgaatacggtcacgctgctcgacttgagggaaccagccgacttcgccgcccacccggtcgaaggtgccatcaatgcaccactcgaccctctggcccatgtgctcaaaaccgtgcccacagatcgaactgtcgtagtctattgtgctcaaggatggtggagcgaggaagtagctgaaatccttgccgatcgcggctacgatgtagcaagcctcgatggcggttttcaaggttatctcgactatcttgaaacccaccacgattaacggttcccgttgtcgttcttttggatgagtgtgcacggacatatttgtgccctacaatcggtcacggtattactcgatggattcttgaatatcgccgggtaatcgtaattcacaacaggggattgcactgaaccaacccaaaacgggaaggaccgaaaatcgtgggacatctgctcacccgaacgcagattcaacgcctggtcgccaagcacggccgtgaggtcatcgagcatcgccacatgcagatcgaacgctgctgctaccagcacggcaatgtcaccacgttcgaacattccgtgcgtgtcgcctgcctggctgtgtggatggccgaccgcgcacacctgtggtaccgcgtcgacctcaaatccctgattcgcgcggccctcctgcacgattacttcctgtacgactggcacgactgggataacggcgaacaccagtggcatggcttcacccatggccacgccgccctggtcaatgccctgaaggacttcaagctcaacgatatcgaacgcaacagcatcgagaaccacatgttcccgatgaccccggtgccgccgcgctatatcgaaggctatctggtcaccttggcggacaaatgctccgccaccgccgagaccttctcgttcgaccggttcaacaagcgcgcgttgcccgccgcgaagccttacgccgagatcgaagcccgtcgatgatcatcacactcgaacattatttcctctggtttctgttctacagtttcgtcggctggatgtacgagtccattctcgtctcctgccaacagcaccgcttggtcaaccgagggttcctcaacggcccgctgtgcccgatctacggcaccggcgcgatactcggcgtcgccattctcggcaacgtacataacccgatcatcatcttcctgatttcgatggtgggcgccacgatactcgaatacacaacctcgtgggtcatggagcagctgttccacgcccgctggtgggattactcgaacttccgcttcaacctccaaggccgcgtctgcctgctgggcgcgttgattttcggcctcggcggcgtgggcgtggtacttggttcgcagccatatgtcgagcgggtcacggatatgattccgctgccgatgctgcatacgctggtcacggtactggccctgatcaccatcatcgacttggcggtcacggttgcgggcatgctcgaattcgagcgggtgctcgattccgtctctcaggtggtgcaggatgtggcggcacgcgccggtggcacgtggcagtggggctccagtgcggtatccgacaggatgcgtgagctttcgcaggatacggttgagcgtctgcgctgggccgtcaatggcgtcatcaacgcacagcagaagcgtatgctcaagtccttcccgaagttccaggtgccggatcgtcaggacatcatcgactctttgcgcgaacttatgggcccgcgccgctagaataaggcgttttactgaatcgcgcggctcggctggtgttcggcactgtcgccatgttctgcgaaacttgactgtgcccaattgggcagtcttattcacaattcgatagggagaagcgacaagctatggctcacgtcaccgacttcaaggaagcgggtttcaacaccctgcttgaggaactggaatggcgcgggttgatttcccagtccacggaccgggatcgactcgcagaagcactgaacggcgagcccatcacctattattgtggcttcgatcccaccgctgcatcgttgcatatcggcaacctcgtgcagctcatcaacatgcgtcacctgcagcttgcgggccatcatccgatcgctttggtcggtggcgccaccggactcatcggcgacccgcgccagtccggcgaacgtacgcttaacccgaaggacgtggtggccggctgggccgatcgcctgaagaatcagatcggcggcattctggacaccgaaggcgcgaacgccgtacgtttcgtgtccaattacgattggaccgcctcgatgaccgtcatcgacttcctgcgtgacgtcggcaagaacttccgtctgggcaccatgctcgccaaggacacggtcgcccgccgcctgaactctgaggaaggcatctccttcaccgagttcagctaccaggtgctgcagggcaacgacttcctccacctgtttgacgaataccactgcacgctggaactcggcggctccgaccagtggggcaacctcacctccggcctggacctaatccacaaggtgcgcggtgtggacgtcaacgtgttcaccagcccgattatcaccgatgcttccggcaagaagttcggcaagtccgagggcaacgccgtctggctcgacgccacgatgctcagcccgtacaagttctaccagttctggatcaaccgcccggacgtggagatggaaagcctgctgaaggcgttcaccttcctgcccaaggccgaaatcgaacgactggtcgaggaatccaagaccaaccccggcaagcgcgaggcccagaagacccttgcctgggaggtcaccagcttcgtgcatggcgaggccgctacccaggctgccatcgatgcttccggtgcgctgttcggccgcggtggcaacctcgaagacatcgacgaggaaacgctggaatccgtgctcgacggtttcaaggtggtcgacgagaacggcgagcacgtcttccccgtctccaagcccggcgatcgcgtaatcgacgccgcccaggctgccggactgttcaagtccgcttccgaggcacgccgcgccatcaagtccggtggcgtgtatctcaacaacaaccgtatcgaggatgaggagcaggtgctggccgaagccgacttcctggcaggccgcttcgcgcttatccgtcgtggcaagaaggcgctcggcgccgtggaaaaccgttaatcaacaacgaattaaggaaaacaagtaatggcagaaggtaacgagcgttccggcaagtcttacggcggcggccataaggggtatggcgatcgccgaccgggcaaccgcggcggcaagggtttcaagccgcgcggcaagggcggtttcaagccgcgtcatgatggtgagggtttcaagccgcgtcgccgtgaggatggcgagggctacgcgccgcgccgtgacggtgatggcgagggccacggcggctaccgcaagtcgtacggcaagtccggcggcttccacaagggcggccgctccggcttcggcggcaagggcggttaccgcggcaatggtccgcgccgtgacggcgaaggcttcaagccgcgccgcgaaggcggctaccgttcccacgaaggcgagaacggcgagaatccgcgctaccagcaccgtgataacgatcgtcgtgatttccgccgcgatggtgagcgtcgcagcttccgccgcaacgacgaccgccgagatttccgtagggacgaccgtcgcgatggggaccgtcgtgacttccgtcgtgacaatgaccgtcgtgacttccgtcgcgatgaccgcagggataacgatcgtcgtgatttccgccgcgatggtgagcgtcgcaacttccgtcgcgacgacgatcgccgtgatggcgaccgccgcaacttccgcagggacgaccgccgcgatgatcgtcgtgacttccgccgtgacgatcgccgcgacaacaaccgtcgtgacggcgaattccgcgagttttcgcaggaagagaagcgccagtaccgtgaggagaagcgctctgaatacatgaggcgcccgcgccgtaactccgacggcacgatgagcttcccctcgcagaacccgtacaccgaccgtcgtcccgacgagcccaagatgcccaagggcatggaatggtcgatgctgtccaaggatgagcgcgaacgtctgcgcggcctgtccaaggagcacgcggagaacattggtctgcacatcctcgccgctttcgcgctggaggagagcgaccccgaacttgccttggagcacgccaagtgggtggcccgtcaggcctcccgcatcgacttcgcccgcgagacgcttgcgttcgtggcctaccgtcagggcgactacaagctggccctgcgtgagttccgcaccgcctaccgtatgaacggcttcctcgactacctgccgttcatcgctgactgcgagcgtggcgtcggagagccgaagaaggccgtggaactggcgctgtccgatgagggcaagcagctgcatggcgctcccaaggtcgagatgttcctggtgtacgccggtgcccttggcgatttggagatgtgggacaaggccattgaagtggttcacaccgtcggccgttcccaggggctgccgggtgagtaccgcatgcgtgccgtgcaggccgagcagtacttccttgaagaggccggccgcagcaaggaagccgagcagctcaacgacctgctggaccgtcttgaggaccagtatgccgacgaggagattgacgaaaacagcgacgacgtggtgatcgatcacgatctcgaagacatcaccgacgactccgacgtgctcgaaaagctcggcatcgatccggatgaggcgcagtacgccccggatccggagcaggaatacggcgatgaggatgacgaggctgaagacggtgatgccgagtctgatgaggccgacgagaccgagaccgattccgccaatgacgccgaggctgacgattccgccgaatccgccgactccgactccaccgaacccgaaaccgaggagtgaacggcgtaatgacccgtttcctcaaaggcaccgatcgcccgctcgccgaggcctatcagcttgcgctgctggacctcgacggcgtggtgtatcgcggcaagaatccggtcgaatacgcggccgattccattcgtgcggccgaagccgccggcatgaccatcgaatacaccacgaacaactcctcgcgcttccagcacgtggtggccgaccagctcaagggcttcggcttggacgtggagccgtggcaggtcatcacctcttcggtggtggccgcccgtatggtggccaaggcgttgcccgccggcgcgcgcgtacaggtattgggcgccgagcatttgcgcgatgaggtcacccgcaacggcctgaccatcgtggacggtcctcaggaccgcccgcaggccgtcattcagggctggtatccggatatgacttggcagatgatggccgatgccgcgttcgcggtcgaggccggagccacgtatttcgtgaccaaccgcgacctaacgattcctcgtgaactgggcatcgcccccggttgcggatcgatgattcgcgccgtgatcacggccaccggcgtcgaaccggtcgcctccgctggcaagccggaagcgtacatgtacgatgaggcccgcgaactgaacgccgccgaaggccacgatttggtgcccaaggaggcgtccatcgccattggcgaccgcctcgacaccgatatcgaggccggtaaccgcggcgactacgattcgctggcggtgctgaccggtgtcaccaacccgaccgaactgatgctggctccgtcacacctgaggcccacattcatcgcccctgatctgcgtgaactcggcgaagcccaaccggagccggtccgcgatgagagcggtacttgggaatgccgcaaggctagcgcttggtttgaaaacggccaggtacacgtcagcgaccccaccagtatggacggcctgcgcgccgccgtatgcgccgcatgggaagccgccgaccaaggcgcacagcttagcgaggccacggtaccggtgttcgccatcgaggcatagtcctatgcctacggatagcgaacatgcgccggtcaccgagcgataccccgaacttgcggatatcgatgaacaagacaacgaccgcaagcttgagacctatcgcaacgtgctggaatccttacaacacgagcttgataacagccgcagctagcagaggtgattcattctcccgccagcggaagatgacgtgaagtgctagatggtggctccatgccgagccaccccgttggtggatggtgggccgaaaggaagatatatgaccgagcagcatatcgatcccgcgactccacttgaccgacttgacatgatgctcgtggcttcgggactggtcgaatcgcgggccaaagcgcagcgactcatcaaggccgggcatgtgcgcgtggacggcgagaccatcaccaagccatcgttcatggtcaaagccgggcacagcgaactcgccgtggataagggcgacgactacgtctcccgaggcgcttacaaactcttgggcgcgttcgaaacctttgccggcaatggccttaccgggccggaaggcttggaatgtctggatatcggtgcctccaccggtggcttcaccgacgtactgttgcgcgggggagcggccaaagtcgtagcgctcgacgttgggcacggccagctcgacccgcgcatcgccaatgacgagcacgtcatcgaaatgagcggcgtcaacattcgcgaagtagaggccgacgacctgccttaccggccggcgatgatcgtttccgacgtctcctttatttccctgacctatgtgatcccggtaatcgcgcgcatcgcggctcccggtgcgcagattgtgttactggtcaaaccgcagttcgaggtcggccgggcaggactcggcaaaaacggcatcgttgaagatccggcattgcgggagcgggcattacacgacgtggtcgcctgtgctgaacagcacggacttgacgtggtggccactgccgatagtcccatcatcggcacccacggtaatgaggaatacctgctttacgctgtcttgagatgaatgcgttggcagtctccgttcaccagcagcacgctggaggtacggtcgatgcctagtgcggtggcacacgtggcgctttccaccgcactgccgttgcgtagcatggcggagtccgccgtcaaagtccggcattgcagatggttggcttcaaccgtgacggctgtgatatggcgaaccgtgctgccatcctcatacccatccatatcaaaacgggaaaacatcgtactgcggagtggatgaacttccagagccctgctgttgacgtcatgacccttcaacacgccgttcaagcggactgtctgaccgctaatatgacgggtgcctagggagccattgacggacagatttccggaacaaacgatatcgccgttgcatcgtagtttgccggtaaaggttatttcatcgcaaataatgtcgccgccgacttcgatgtcgccgctgccgctgatgctggatacgcgaatatcaccatcacaccgcacaatgccacttttgatgaccagtttgtccccttctataactgaggcctcgagggtgctggtcacaatcatggtgtgaaaatgcgcgccatcggcaagacgggaacgttggtccactcctatggtgccgtagactcctttgcctatcagcgtgcaattctgcgtatgcttgcccatgatgataaaactccccttattaatatggacgtacagctttatggcttattgccacaataatgagcgcatccatgttgagggggttatatcggtcacgatgtgagcagatagggggtatagcgagcgcagttagggggttagccttggatgaagtggtcgatctgatcctgcttgcccatgaggatgagttcgtcgttgcgatgcatgaccagttccttggagccgtactggaactccttgcctggggccttgaggcccaccacggtcacgccgtacttgtcatgtacttgtacgtcctcgatgctgcggcctaccgcgtacaggggcgtgtggaccttgacgacggtgtacggcccgtcgatttcgatgtaatccagataattgccggccaccagatggcccacgcgcttgccggcatcggtctccgcgttgatgatgtggcgggcgccgatgcgctgcagaatgcgcgcatgctcctgggacacggacttggcccacaggtcggaaacgccggcgtccagcaggttgccggtgatgatcaccgaagcctcgatgctgtcgccgatggccacgacggccgtgtcgaactgggaggcgtcgatctgctcgatggccagcacatcggtcatatcggcctgaatggtgggcagatgcgcggaccaacgggccacaagctccgggttcttgtccactgcgagcacatcctgacccatctggtcgagggtggcggccacggacccgccgaaacggcccagtccgatgaccagcacgcttttgttgccgctcggttttgctgccatgatgatggtcctctctatgtcagattgctgggcgccgattgaatggccgatcagccaacgataatgttttcctgcggataacgaataggttcgggagccatcggtcggctgatggagtaggcgatggtcaacgggccaagtcgtccgacaatcatctcggcggacagaataaacaggctggccggattgccggcgcttgccacgcccaccgaataaccacccaacgagaaggccgagcaggcttcgaacacggcgtccacgaacgcgcagccggtggtgaacatcagcatcatcgcaccgaccataaccaacgcaaagcaggccgtggtcacggacacggcggtcatctgaatacggcgggggatacggcggcggaacacggtgacatcgcgatggccggtgaatgcggcgcggcaaatcaagagaatcaccgcgaacgtggtgacacggatgccgccagcggtggatgaggaacctgcgccgatgaacatgagtatgctcatgaacaccttggtctcattcgtgacttcgggcacccaggaaatatcgaaaccggcggagcggggcatgacggcggcgctcatcgcacggcgcatcttcatgccggggtcatctgcggggaacaggccggtattgctccactcgaccagcaggaaccaagccagtgaggtggccaccagcacagcggtggtcaccaaagtgagtttggtgtgcaatgtccaacgtttcgggctgagccgccggcgtgcgcactgcaccagattcagcaccacggggaagccgagcgttccgatgaatgcactgatgagaatcggcagccccacgccccaacggttcacatgcagaccagtggcatccggcgtgaaaccggtgttgttataggccgacaccgcgtagaacagcgcctgccacaaggtacgccccatattgccatggttcacgcggaacaggtcgggcagcagcagcacgaaggtcagcacctcggcgatgatggaggtgcccagcaccacggtgagcacgcctttgacctcggaaagcttcgtggtgcccagctcgttcgcggtgagcatacgctgggagaccttgagtctgcgggaaacgccaagagccaccatcgaggcgaaggtcatgactcccagaccgccgaactggatggagaacaggacgacgacctggccgaacatcgaccagtattcgccggtgttcaccaccggaatgccgcaggtggacagggccgagacggcggtgaagaacgcgatcgggaaattggtgaagatgatgtccgatgtggagatcggcagcagcagcaaaccggtgacgatgatgatcagtgcgccgaaatacaccatggacagacggcccgggtgcctgagcagacggtcggtgatgctgatacgtcgaatgcgcttggcggttttatcgcttttgtctcggctcagtacatcggctgaataccaccatgacagtcccttcgaggcctcctcattggcggaggattcgtcgaagtcattggccatgggtcctcaagctcctcaactgatactgctgtacggtcatacggcatgccatcgcgctgcgcacggcacgcgtacggtgattgcgcggctgtacgccattgtatgccgaagccttacgataatcgactctgtggaacgttgccggcgacgcgccacgaagcagcatttttcgaacacctgtacgactgatgacggtgtctgcggttagaataatgagcagtgcgaccgaatcgacaggaggatgccatggccaagcgcaacgcggtggtggtgacgcataccaggctcaggcagaccggaaccgtagtggccgaggcggtgagccagctgcgagtggccggtttcgaagtcgccatcatcgacaacaccgaggcccccgatttcggcgtgcagccgccgtgcgtgtcggacgacaccgaaatcgtcgtggtcctgggcggcgacggcacgatactgcgcgccgccgaactcgtccactgcacccaagtgccgattctcggcgtgaacatggggcatgtcggcttcctggccgaattcgaaagcttccagatcgacgaggcgatccgccgggtctccacccacgactattcgatcgacgaacgcatgatcgcccatgtggacgtctggctgcccggcgccaccaagcccattgaggattgggcgctgaacgacatcacactggaacgcgccgaccggggcaagatggtcgaactgtccatccgcgtggacgatgtggagatgaactcgttcggcgcggacggcgtcatcgtctccacgcccaccggttccaccgcctacgccttctccgcgggcggtccggtcatgtggccgaacgtcaaggccctgcagttgattccgttggccgcgcacgccctgttcgccaggccgctgatcatcggctccggctcgaccttcaccatcgatattctggacgattccatgtccgaaggctggatttgctgcgatggacgccgtcagcgcgccctgccgcagggtacgcgcgtcatggtgcgcgaatcgcgcgataccttgcgcctcgcccggctctccggcgtgccgttcaccaaccgtctggtctccaagttcgatctgcccgtggtcggttggcgcgagcacgcgcgcaacgaggcctcgagccagtcgctgcatcacgggcacacgttcccggcggccgcgtatgcggctggcgttgccgttgccggtgacgctggcgtcgctggtaccgagcccgacaagccgggcgaacgtgacggcaaggcaggatcctgatgctcgaagaactcgatatccgcaatctggggccgattcgagaagccaccattgcgccggccgcaggcatgaccgccatcaccggtgagaccggtgccggcaaatccatgctgctctccgcgatccgactggtctccggcggggccgccgaatcctcgcgcgtctcggccggggcggacgaggcttgggcccaggcgattttcgcgctctcggatgatgccgtcgcatctgaacattccggcgacaccaacgatgccggttctggcgatgccgacagtgggttcaccggtgctgccgcggccgtggccaaggcccatgacgcgggcgtcgaccccgaagacggcgaactgttcctttcccgcaccgtacgcgcttccggacgttcgcgggctgtgctcggcggcaagtccgtaccgcgttcggtgctgggggccatcgccggcgaactggttaccattcatggccagaccgatcagctgaaaatcgcggcctcctcacggcaacgcgagtttctggaccgggtggccggagacgaagccgaactggccgcctaccgcaaggcgtgggatgcgctggccgccatggatgagcggctggaacgcctgcgctcgcaggaatcctctgcccgccaacaggccgactacctgcgcgaatccatcgaccgcatcaaccgaatcgacccgcagccgggggaggatgaggagctgaaggcgcgccgcgaacgcatcgaaaacgcggccgacatcgcccaaggcgtgggttcggcgctgggcgcgctggatgcctcgcaggtggatgtggacgccgccgacggcgcttcggccgtggaactcatcaatcatgcggtgacctcgttgcgcgcgattcgcgtcggcggcacgttcgctgagcaggccgatcggcttgaatccatcaatgccgatttgggcgacgtggtgttcgccctgagccaggagctgggcgacgaaggcagcgtggaggatctggaccagatcaacggccgtatccacgagcttggcgacctcacccgtcggtggggccccaccttggccgacgtgctcgcttggcgggacaaggcggcgttcgatctggaggatctggacgcctcgccggaaaaggtcgccgaactcgaatccgaacggcagacgctgtacgatgcggccctcgccgccgccgacgtgctgagcgccgcgcgcgtggctgccgctgccgacttgggtgcgcgcgtcactgaagaactcggctcgctcgccatgctgggcgcctccttggaagtgcgcgtcacgccgcgagacaaggccgatgatccgctcggcccgtatggtcgcgacgatatcgcgttcctgtttacgccgttcgaggggtcgccgcagttgccgatgggcaaaagcgcttcgggcggtgaactgagccgactgatgctggccttggagctggtggccgccgacacgcgcggcggtgccgaccagaccttcatcttcgacgaggttgacgccggcgtgggtggcaaggccgcggtcgaactgggcaaacgtctggcacggctggcccgcagcgcgcaggtcatcgtcgtcacccacttggcgcaggtcgcctcgtgggcggacgcgcagttcgtggtcaccaaggagccgccggatgccgatgacgacgatttgggcgtggtcaccaccatcgccgaagtcaacggcgaaacccgcgtccacgaaatcgcccgcatgctctccggcagcgaatccgaagcttccctggaccacgcccgagaaatcctatccgattctcggcttacgctcccgctggcgggagctggcgtcgcaggcgactgagggtggttgaagaagatggagattagcaaatgaccaaggccgccatattcgacctcgatggcaccctcctagactccatgggagtctgggaccaagtcgacatcgacttcctgaacaagcgcggaatcgaagtgccgcccgactacatgaccaaagtttccgccatgcaattccgccagatcgccgaatacaccatcgcacgcttcggccttacagacacgcccgaagagctcatgcaggaatgggacgacatggccagcgtcgcctattccaccacggtcgaagccaaacccggcgcgcttgactatctgcgcgatctgaaagactccggtgtcaaactgggtgtcgccacctcgctgcccccgcgtctgcgtgagccggcgctacgccacgtcggcatgttcgatttgttcaacgatatcgtctccgtcgatgacgcgaacgacgtcggcaaggaccagcccgacgtctacctgctcgccgccaagcgcctgggtgctgcaccggccgactgcacagtgttcgaagacctgctggtcggcatgaagtcggccaaatcagtcggcatgaaggtctgggccatgcacgacgactcctccgcctccgactggcccgaaatctgccacctagccgacggtgtcctcttcgacttccacgacgccccgcgcgtgctgtgataaaaaagttacgcccccgctggcggggctgtcggcggaacggcgttgttcggcataggtgcccctttccgaggccattgtaggcacggcccatgtttcgacactgtatgttggcgaggtgtttgttcaccgtttaactgttatgtaacacaccttgacagttaagcagaacggttatactgtgttgtataacagctaaacagctggggtgctagtcaatcacaaccgaaaggggcatagatgaaactgatcatctcatccgtgtccggtgagcccatctacgagcaaatcaaaacccaaatccgttcggcggtgctcggcggcgagctgaaggcgggcgaggccctgccttccctgagaaaactcgccaaggagttgcgcatctccgtactcaccgtcaccagggcgtacaacgaactggccgatgagggcgtggtgcagaacatccaaggcaaaggcactttcgtgatggacaagggcaacgaactgatgcaacgtcagctcgaaacccagattcgtgaaagcctggccgaggcaagccggggcgccaaagccgccggcattccgctggacgcattggaccgcatgctcgaagaggaataccgcaaggaataacctcaagaaaggaccatggccatgaccgccatatccgaatccgacgcgatggcgttgcaggtcaccgacgtcaccaaacactatgattccggcttcacgctggacgacgtgaccttcgacctgcccaagggctacatcatgggactgatcggcccgaacggcgccggcaaatccaccctcatcaaactcatcctcaacatgatccaccgcgacgccggttcgattcacgtgctcggcctcgacaacatcgccgacgaggagcccgtcaaggaacaactcggcgtggtattcgattccagctacctgtatgaacagtggcaagtcaagaacgttgaacgtatcgtcgcgccactgtattcatcatgggacagtggatgctatcgcaagtatctgggtactttcggccttggtggcgcgcagaacggcaagaaacatatcaaggatctttcccgcggtatgcagatgaagctgatgctcgccatcgcattgagccatgacgccaaactgctgattctcgacgagccgaccagcggactcgatgtgcttgcccgcgacgaactcatggatatcctgcatgcctacattgaggatggcgaacattcggtactgttcagcacccatatcactgccgacctcgaacgtgccgctgacttcattacctacatcaccgatggccgtctctactacaccggtccgaaagacgagtttgaggaatcgttccgcctgattaagggcggtccagacgaactggcacaactgcctgcggacgtggtgctgggctcacatatgtatgccaccggattcgatgcgctggtccggtcagacaggcttgatgctgttgcgtcggtggtttcggggcttgtcgttgaatcggcttccattgatgacatcattcgcttgaccaatgcccatgattccaatcgtgacttgagcgggaggtgagcggtcatgggggcaatactgagggtgccgcggtctcggcaacatgcattgaccactgcattgcgcgtcgatatggcctacctgtgcgtcggcgtacagactgtgttctcgttgttgttggcaccgttgttctccgtcatctttcaaggtgaagtttatggtgatggcttcggctatcgcatgggtgtcatcatgacggtattcacctgcgccatgtgggtgctcaccatggctgttgctgacctgcagaacggatatcggcttcgtggcattattccgtcttcaaggaagaaccaggtggccgcgcgatatgtggttggattggtgatttccgtattgtcggtagcgatgattgtgttgattgacgggttgcaagtgctggtcaatccggattggtcattcgcgggcaatctgtgggcggcgccgttgggaggtttctgcaccgcgctgatgatcgcgcttatcgtgcccacgggttatctgtggaccaaactaggcggtcttcaagtcacgatgatggtgatttatgtcgttgtattggctggatccatactgctatctattttgcctgcttcggtgaccagaggattggcccatgccgcgaatgccatcatcgcgcaatgattgtggctggttattgcggtattgacaacgacggttgtggcatatggaatctcgtatgtaattgcctctcgcatatttgcttcaagggagtggtgacgatgagctggaaatccgtagtaaagcaatgtcgattcgattgtgtcgggacgggtctgttcagcgtggcgaatatggtgtttctgctggttttcccggtgctgtctatcgtggtatcgctggtgatgatatcgacccatgtcgatgaacacgttgccagtggtctgatgggcggactcggaggtctggcatcggtgatggcatatatgagtgcattggggcctgccgcatccgaggaatctgcaggacacagtgccatgcgagggctgattcctgtttcacgcaccgcgcaagttgtaggtcggtacctctttctgttggtggctggcctgctctgggctctggatgtggtgatatgcggtggcatcttcattgtctttggcgatatagcagatatggggtggattggtgccttggcatcaggtgcctccatcttcgctttggctatcattcttgggtcggtgctgctggcctgtgcataccggttcaccttccgcaagatgatgatggcctttggcgcggtcatggttggcttgtatgccgtcattgcgctgctggctcgattgcctgtcgactggcaatggctattgctgaatattgccgatttcctgacgatctggtggcatacggcgcttgttctcgccgtgttgtgtctgctcgcattttttggctccatgctgatagccatccgcatctaccgagccaaagaactctagccgcgcatttgtctgaccacgaatgaaaagagaccgacaggaatctgtcggtctctttccgttatcggtgtgttatcagtccaccagatccagagcgattggctggtgcggttgctgggaatcgctttcattggccgtgcggcgcgcgcggatggcggcggctgcgcgcttgacggtcttgataacttcctgcagcaccaccacgccgaaaccgaccgcgatgattttcagccacatgtcgatcggcagcggcacggtgcggaacatcgcgccgccgaattgcaccactagcacctgaagtgcgaacatcagcgcgaacacgccgatcatcaccttattgcgcagcagattggcgaacaggctggcgttgcccagctcgcggctgttgaaggcgttgaacagctggaataccacgaacagcgtgaacagaatggtcgactgctgttcggcggtgccgcccatgaagttcgtccagctttgcgccatgaacaccacggcgatgaacgcgccggagacgatgatgcgctccagcatgccgcgcgagacgatgctggcgtcgcggcgggtgggcctgcggtccataagattgtctcgaatcggctccataccgagcgtcagcgcgggtgggccatccatgatgatgttgacccacagcagctgcaatgcggtgaacggcgcggccagaccactgaacagcgaggcgagtaccacgaccaccgaagacaggttcacggtgagctggaactggatgaatcgctggaaattctcgtaaatgccacggccccagtgcacggccttgacaatggtggcaaaggaatcgtccagcatcacgatatcgctggcttccttggacacctcggtgccggcgatgcccatggcgatgcccacgtccgcgttcttgatggcgggcgcgtcgttgatgccgtcgccggtcaccgccaccacattgccctgggctttcagagcgttcaccacgcgcatcttgataaccggcgtgctgcgggcgatcacgcggatgcggccgatttcgcgggacagttcctcgtcgctcatttcctcgatctggcgcgcctcgacggcgatatgccgctcgtccagaatgccgagttcgttggcgatggccgtggcggtcacgatgttgtcgccggtgagcatcttgagctcgatgcccgccttgcggcagcgctccacggcaccgggcacatcctcgcgcaggggatccacgatggccacgaagccgtcgaacatcatgccggattccaagccggcgcggtcggcagcgtaatcgagagccgcagtgtcggcgtccttatcggaaatatggcggtgggcgaagccgagcactcggcaggactgcgcctggaacttcgcgatctcccgttcgatttcgccgcgcgtcttggcgtcgacggcgcacaggtcgagcatcttctccgggctgcctttggcgaacacggtaatgccgtcgccgtcacgcaccacagtggtcatgctcttggtctccgacgagaacggatacgtgtggagcaccgtcgcgcgctcgcggcgaatccggtagtcgagtccggccttgtgcgcggcgaccaacagtgcgcattcggtggggttgccgatgaattccggcatcgcgccggcctcggcttcggtggcgcccgggaaggtcacgtcggcggtgccgttgacgcagaagttctccagcagcatgcggttcctgatctgctcgggcttctccaaggcgcggcccggcgcgttgtacgcctcgatcacggtcatgcggttctgggtcaacgtgccggttttgtccgagcagatcacgttgatgcagccgatggtctcgcacgccaccatcttcttgaccagcgcgttctgcttggacattttgatgatgttcaccgcgaggcacgcggccacgatggtcggcaggccttcgggcacggcggccacgatcagcgttatggaggtgatgaacgcctcggaaatcgtgtcgaacgaggcggtgccggaagccacgaaccgggccacctgaagcacgaacaccagtgcggccacaatcgagcccaccacggcgatcaccttgccgagcttcgcgagcttctcctgcagcggcgtcataccggtgttggcggcgcgcagttcgcgggcgatcttgccgaactcggtgtcgtcgcccacggcggtgaccacggcacggccattgccggcggtcacgaagcagccggaatagagcatgttcgtgcggtcggccaccggggtcttcgggtcggtgaacacggcgtcggtggctttggcactcggcacgctttcgccggtgagcgcggattcgtcggcggtcagatcgttcgattcgatgaggcgcgcatcggccggcagcttgtcgccggtgctgatctgcagcacatcgccgatggtgatgtctcgctgcgacaccagcgtgacctcgccatcgcgcaccacggtgacggtcgtgtcgtcattgatgtcgttcagcgcttcgaatgccttggcgctgcgaccctccatcaccacggtgattgtcacggacagggcgatggcgaagaagatgcccacgcattcgagaatgtcggcgtggccgccggccatggcgcgggtgatgttgacgcccagggtgatggccgccgcgatcataagcatgatgagcatcgggtcggcggccgtcttgacgatgcgggaaagcatcgattccggcttcggcttggtgaaggcgttgggaccgtactggttcaggttgtgcgcggcctgttcgctggtcaggccttgatgtgcatcggtgcccagcgtgctgatgactgctggcgcatcctgcatgaatggtgcgggcgtctgcccgttggccgtggtcatatgttcctctcgtttggttgacacaccgcactgaaacccgcgtaatatcactcgcgtaccgcgcaacatggcggcacgcagccaaacgaatcgttgacgaccatgtatcgcatactccgcggtacatgagtctcgtcatttaaggcaaagccagaccgtaacggaactgccgacggccacgatgttgacttgccacattgcggtttgggccgagcccttcgccgcaatgctgtctactccctcatgggactattcagttgcagaaacagaacctaacaaaccacatggattttcccgttcgccggcagcatggcgattcccgccttcctagaaaaaacaagcaacacgccattggctcgttgcaggtgaaaagccgcaagaaagccgcgcgtgacaaggctcggacatgcttgaacatgcctggaccttcgacttgtgacatcagaaaacaaaaaaccgatacatgctggtaaagcatgtatcggttgggaattgtcagttagtgccgtcagcggactatcacagcgcctgggcggccttctccacgtagtcctccatgccgtcgatggccacgacgtccttgaaccgcacgtcggcggtctcaagaccacgcagggcggccggggcggtggtgccggtctcgtgggccagcacatccatgcactcgaagtcggtgccggtggcgtcgaagcccaatgcctcgttcaccacgcgcgggaacttgtaggggctggcggtggagagcagcacgcgcggggtcagcgggtcgcgcggcatctgctcaagcaggtagtagccgcaggcggtgtgcgggtcgatcacgtagtggttctcgtcccaacagtgcttgatggactcgcgtacctgatcctcatcggcccaaccggtgccgaagatctgacgaatcttggccagcagttcttccgggatctcgtacgtgccccacttgttgaggtcgttcatcagcatggagatcagacgggtgtcgccctcggacaagtagtacagcatgcgctccaggttggaggagatgaggatgtccatcgagggggagatggtctggaagaacgggcgctggcggttgtaggtaccggtggtcaggaagtcgaacagcacgttgttcttgtcggaagccaccacgaggtgcttgaccggcagaccgagcagcttggcatagtagccggcgaggatatcgccgaagttgccggtcgggaccacaaactcgacctcatcgccgacgttgatcacctggtcggcgagcagttgggcgtaagcggagaagtagtagacgacctgcggcaccagacggcccacgttgatggagttggcggaggaaagcaccacgtgcgaattgccggcgagacgctcggccagggcgcggtcgccgaagatgcgcttgaccgcggactgggcgtcgtcgaagttgccttccacggcggccacctgcacgttggagccggcttgcgtggtcatctgcagctcctggacctgggagaccttgccttccgggtagaagacggtgatcgcggtgcccggggcgtccgcgaagccggccagcgcggccttgccggtgtcgccggaggtggcggtgaggatcatgatcttctcgtccgcgtcgccatcggccggcgtggtgtgcgccatgaagcgcggcaggatctgcagcgccacgtccttgaacgcggaagtcgggccgttgaacagttcgagcacgtaatcgtcgcccaggggcttgagcggggtgatgcgctcgtcggaccactgttcgccgtaggcgtcggcgatgcactggcccagctcctcggccgtgaagtccggcagcagcgcgcccagcacctcggcggcgatttgctggtacgacttgcccggcagggaggccacgtccaccttggtcttgcccaacgcgtccgaaacgaacaggccgccgtcatcggcgatgcccttacgaatcgcctgcttggcggtcagcgaatcggtggtgctacgggtggaatggaaggtggttgtcacgatgaatccttctgcctgaaagggatgatgaatccacatcagtctagcgtgggccgtgggcagaagggccgtccgtctcgcataaccgaccggtcgcaccggcgaaaatcaccattgccatcgaacggggaccggccatatcatgaaacaggccggctgcaaacgggccatacggtaaggcgacaacggcgaatcaattgtcgcttataccaaagagcacccatgaccgcttcaccccttgcgcagaaggcaaccgatgctttcaacgcgccgatctgcgaaaccgatcctgagatcgccgaactgctggactccgaactgggccgccagcgcagtggccttgagatgatcgcctctgagaacttcgtgccgcgagcggtactgcaatgccagggctccgtgctgaccaacaaatacgccgaaggctaccccggccgtttctaccacgccgaggcgtacggcgtgaaccccgagaccttccgcatcgacccggagatcatccgccagcgcacgttcgacggtgccaagatccttgccgaacgactactggccgacgacgtcaaggccaacggcatcttcgtgctgaccggcggcaccgatgtgcatctggtgatggtcgacctacgcaacagcgagatggacggccagcagggcgaggatctgctcgccgcctgcggcatcaccatcaaccgcaacaccgtgcccttcgacccgcgcccggcctcggtggcctcgggcctgagaatcggcacgtccgccctggccacctgcggcttcggaccgaaggaatacgaggaggtggccgacatcatcggcaccgcgctcgccgccggcccgtccgccgacgtgaccgcgctgaaggcccgcgtcggcaagctcgccgaagacttcccgctctaccccgacctggaccagattcactgattttttgcggatgtacgcagctccctcatcagagggagccgcgcttatatccccggctatcttcggtgcaatatgggtcgaaacgggcaatgcggcccattgtgggttactcttgttttttatgagcgatgaattgagtcctgaggtgttcgacgcggtgtgccgccaggccgatcaggccgcacgcgcacaggagcgtcttgcacaggcaaataccgaagccaaaaacgaactgttgcttgccattgcggacgcgttggacgagcatgctgcggacatcgaagccgccaacgcgctggacatgctcgaatccaaggaaaacggcatggatgcgggcaagctcgaccgcctgctgttcgacgtgccgcgcgtggccgccgccgcccaaggcgtgcgccatgtggccaccctgcccgatccggtcggcgagatcgtgcgcggatacaacctgcccaacggtctgcgccttacccagacgcgcgtgccgatgggcgtcatcggcatgatctacgaggcccggccgaacgtcactgtggacgtggccagcctgtgcctcaagtccggcaatgccgcgttgctgcgaggcggccacgccgccgaacgcactaacgccgccacgttgggcgtcatcgccccggtgcttgaagcccacggtttcgaatccgcactggtgcaatccgtcgaccagtacgggcgcgccggcgccaccgccatgatggaggcgcgaggccatatcgacgtgctcgtgccgcgaggaggagcgggtctgatccaagccgtcgtgcgcaactccaaagtgccggtcatcgaaaccggtgccggcaacgtgcatatctatatcgacaagtccggtgatctcgccaaggccatcccgatcatcatcaacgccaaaacccagcgcgtgggcgtgtgcaacgccgccgaaaagctattggttcataaggatgtcgccgccgaattcctgccgcagatcgccgccgctctggccgaggcgaacgtcgtgctgcagaccgacaccacgtcgtacggcatcatctccggcgcggcaatcgagggccttgacctcaaccacgccgccgaagaggattgggacaccgaatacctggccctcaaaatgggcatcaaggtggtgtcggacctggacgcggccatcgaccacatcaacacgcattccacaggccacaccgaatccatcatcgccgaggattatgcggccatcgaggaattcaccaagcgcatcgactcggccgtggtcatggtcaacgcctccacccgcttcaccgacggcggcgtgttcggctttggtgccgagcttggcatctccacgcagaagatgcacgcacgcggtcccatgggattgcgggagatgaccaccaccaagtggatcggttacggaacaggacaggtgcgcgcatgaacgaggacggcaacatgaacattacggctgacacggcaaacaaggcaagcgaactgcggcccgacatcgacctcaacgatcccaagctcggcctgaagatcgcggccgaacggctcagcatcgtccgctacgtgttccttgtgcagatcgaggacggcatcgcctccgccgcccagcgtgcgtcgctcgaatacgcggacgccgtgctcatcggttggcccgagaccgattcgcccgaagtcgcggacctcgacgatgcccagctcaagatcgtgcgcgaacacatggagctcatggaaggctacatcggcaaatacagccagatggagcacgacggtgaccttgacggcatgaccgacacgctcatccgcatcaccgagcgtgtggccgaggtccgccgcctctaccagccggacttcccgctgcccaccttcgccgaaattcgtcgcgtggtccaggacgaatgggatgaagacatgggcaagatcgatcccagggaagacaatcccaccgccggcgaaatcgaagaggaaaccgaatcagccgatgacgccgccggcgagggcgaccaggcatgagtggtgttaccgacagccacaaaacggctgcgtcagttcagtccgaaaaatcagtggaatccgccgagcccgccgaaatcgttgccgtcacccaaggcgaaaccgaacggcgcatgtctgacctgtccgcgccggccggggccagcagccatggcaaaggcaggctttccgcacgcggcaactggcatacgcgcctgcgcgtcggcatcatgggcggcacgttcgacccgattcacaacggccacttggtcgccgcctccgaagtagcttgggtatacgacctcgatgaggtgattttcgtacccaccggccgacctgtgttcaagctggacaagcacgtcaccaacgccgaagatcggtatctgatgactgtgatcgccaccgcatccaaccccaaattcaccgtctcgcgtgtcgacatcgaccgtccgggcgtcacctacaccatcgacaccctgcgcgatatccgcgcccaacatcccgacgccgagctgttcttcatcaccggcgcagacgccgtggccgaaattatgcagtggaaggacgccgacctcatgtgggacctcgcccacttcgtggccgtcacgcgccccggctactccagtccggacggcgtgaccttgcccgaaggaaaggtcgatacgcttgagatcccggccttggccatctcttcgaccgatgtacgccgccgcgccgaacacgacgagccggtctggtatctggtgcctgacggcgtggtgcaatacatcggcaagcatggtctgtattcatacgaggactgacgattcgtacgaggactagtgtgcatttgtacgagggctggtgaggattagcgcgaatcagtgcgcagcaatcctcaccagtgcaaaggataagcagtcaggccagtcccatcttgattttcaatgccattacgcgagtcgccgccgccgtcactttcgaagcgaaagccggatcggacttcgcccgttcgttgaggccgtccacaattggctttacgtaatccgtctgaccgatgcaggacatgtcgccgcccgcctcgacaagctttactcccaattggcttacatcgtagctgctcaacgcttcggcagacatcgaatccgaaatcaccacgcccgtgtacttcagggcgttgcgaatatgaccgtcgataatcgtagaagaaaacaccgccggattattcgggtcgatggattgatacgtggccaacgacatcatcaccatcgcaggatcggtcttggtgatcgcctggtcaaaggcacctgcctcggccccgcccaacgtggtggtcgtatccagaatgccttcggtggtgaagtcggtattgccgcttaccgcgcccaacccaggataatgtttgaccgccgcgccgacctgagcgtctcgcaaaccttcaataacggcgatgccatgttcggcgttgccggccgcatccaatccgaaatcacgatccagcgcgccaatcggagcatttgaggcacgatcgcccaccaccgtgccgagcaccggtgccaaatcgacatttatgccagcagcagctaattgcgaaccccacgtgcctgccgattgacgcaatgcgtcagcggacattgtgccctgctcaacggcactgggcattgtgtcgaaaccggtaccagtcagatgctgcacctgaccaccctcctgatcggtggcgatgatgagacgattgccggccggcgcatatccttggagttgcgcggtcgcggtcttgaccgtatcggcgccggtattccaattgccaatgagaatggccgagccaatgtgctcatcggtgattgttgaagccaacgaggagggatcggaaccggcaagcaacggcaccatcactaactgtcccacacgttcctcaagtgtcatggcggataccgcacgttgggcttgtgcggccggttcgttcttcttcggggaaggaacgtcggcgcgtggtaacgcacttgtctgggaggtctggggagtggtggtgttgccgtttgatgtggatttggcgaaccatccgacatgccatccgtaggctgccacgccggccaacaccactgccaaagcacatattgccgccacgattggagtgctcctgtgccgaagttggcgtgtggcgtgtgctgagggacgcatatgttgtggccgttggctgttcataccggcaagcgtagaacggagcgtagaacagaacgctgcctcattctgtgctcagggcataacctacctcccgccctttcgataggcttgagttatgtcttttaacgatcctttctcaatactgttcggcaatggcggcgattcacgacgcaacaatgcgaacaatgacgatccgatcatcctcgatgtcgaggccgatggggacggtccggcccgcaacaccaacgccggcccctccgggtcatcccgccctccacgtggcccggccaatccgcgtatcacccgtaagccagcgtccggtggctcaggaggcagccgtggcagcaagattctgatcggcgtggtgctggccttggccatcatcgtcggtctgttcttcggcctgtcccgattcatcaccgatctgatgtggtacggccagctcggcttccagtccgtggtctggacccagctcggggtgaaaatcggtctgtgggtggcctacgcgctgctcatggccttgaccggcttcgtttccgcctggctggccattcgagcacgccctgattcggccgacggttccaccattcgcattaacggcgatgtggtcgaggtcggcaaatccgtcagctcgaaaaccgctcgccgcgtggccgtggtgatttcgctgatcgtcggcgtcatcttcggttcccagtttaacgcgaactggagcgagattctgctcatgttcaacgcgcagtcgttcggcaccaccgatccgcagttcggtctggacaacggcttctacgtgttcgtgctgccgggcctgaagctcgtgctcgccgccgtggccatgctgctgggcgtgggccttgtgttttccgtggtcactcatgtgctgatgggtggtatccgcattactatgccggttaacggacgcggcctgttctccatcaccaagcgttgccgtcgccagcttggcatctggctgatgctcaacatgttcgcttgggcagtgcgccagatgatcggcgtcttcgaccagctcaccgtgcagggttcacgcatcaccggtgcctcctacaccgccgtgcatgccaacatccccgtcaccttcatcatggccgcgctgaccgccatcctcggcgtggtgctgggcatctggctcatgcgttcccacacgctcgaaggccaggcgtccatcggcgtgcgcgcctccgccgcgctcaaggcctggcgtgtgccggtgacctccattgccgtcgtggtcgtggtgggtcttgtgctcaccgtggcatggccggtgctgttgcagcgcttccgcgtcaacccgaacgcacaggagatggaatccacctacattcagcgcaatatcgacgccacccgcgccgcctacggtcttgacaagctcaagaccgagcaatacaaggtaaccgacaagggcgagcagggcgctctggccaaggagggcgacaccaccgcgcagattcgtctgctcgacccgcaggtcgtcagccccacattcaaacagctgcagcagtccaagcagtactacaccttcgccgacactttggcagtcgacaagtacgagatcgacggcgtttcccaagacaccgtgattgccgcccgcgagcttgccctggccggcaacgacaaccgcaattgggtcaatgaccacaccgtgtacacccacggttacggcgtggtggccgcttacggtaacaaggtgaccgccgacggccagcctgaattcttcgaatccggcatccccactcagggcaagctcactgaatccgaaaagtatgagcctcgcatctacttctcgccgaacaccaccgaatactcgatcgtcggcgcaccggagggcacgcaggcttgggagttcgactacccgaccggttcggaaggcgccctgaccacgttcaagggcgacggcggcccctcggttggcaacctgttctcccgtattctctacgcaatccgcttcggctccgatcagattctcttctccgaccgtgtgaccagcgaatcgcagattctttacgatcgttcccccaaggagcgcgtggccaaggtggcgccgtacctgacgcttgacggccgtgtgtatccggccgtggtcgatggccgcgtcaagtggatcgtcgacggctacaccacctctgatgcctacccatactcgcagatgaccgacctcggctccgccaccaaggattccaccaccgtctcttccgcaacggtctcatccttgggctcgcagaaggccaactacatccgcaactcggtcaaggccaccgtggacgcctacgacggttccgtggatctgtacgtatgggatcaatccgacccggtaatcaaggcatgggagaagatcttccccggccagtaccaccagctctccgatatctccggcgacctgatgagccacatgcgctacccggaaagcctgttcaaggtgcagcgcgagctgctctccaagtaccacgtgacctccgccaaccagtactactccggcgaggacttctggcagacgccggtcgacccgaccgaatcccagtcccagcaggaccaggacatcctgcagccgccgtactacctgaccttgcagaccggtggcaccaaggaaccggtgttctcgctgacctccacctacattccggctggccagtccacccgtgagatcctcaccggcttcctgtcggtcgactcggatgccggcaatgagaagggcaagataggctcaaactatggcaccatccgattgcaggagctgcccaaggattcgaacgtaccgggccccggccaggcgcagaacaacttcaacgccaacgccgacgtgtccaaggaactgaacctgctgcaatccggcgacacgcaagtggtgcgcggcaacctgctcaccctgccgctcggtggcggactggtgtacgtgcagcccgtgtacgtcaagtcttcgggtgcgacttcattcccgctgctcaagaagacgctggtcgcgttcggtgatcaggttggattcgcggatacgttggatgaggccttggatcaggtgttcggtggtgattccggcgcggccgcaggcgatgccgagaacgtgtccggtgacggatcgtctggtggccaggcttccggcgaccagtcgtccggcacatccggtgaccaatctggttccgataccaatggtggccagtccggcaccactgacggcaagtcggattccggctcgtcttccgaccgtagccccgaactccagcaggcgctgaacgatgccgcccaagccatgaaggacagccagtccgccatgaagaacggcgactggaccgcctatggcaaggcgcagaaggagcttgaagacgccctcaacaaggccatcgagctcgacaagtagttccgacaggaattggctcccctcagggtgaggggagccatcgccgaaggcgactgaagggagtcggttacctcaactgacatagcccgtccttatcataaggacgggctatttgcgtattcaaaggaacctcatgccatacaccttccgtccggccgtcgaatccgacatccaagccatcaccgacatctacaacgcctcagtgatggccggcggtgcgaccgccgacctcaccccgcgcaccctcgaccaacgccgcgcctgggtcgaatcccatacgccgccctacggcgtttttgttgtggaatcggaagactgttcaatcatcggcttcggtgcgctctccgtgttctatgaccgtgcgggatatgacggtgtcaccgatttggcctattacatcgatccggcatggcaaggcaggggagtaggcacgttcatgcttgacaggctgctcaccgaggcgcgggcccgccacatgcgcaaggcctgcggcatcattttcgccgataacgccggctccattgccctcatgcaccgcttcggcttcacccaattcggactcatgcccgccgctgccaccgactccaccggcaccatgcgggacatgtcctactggtatttggacctgtagccttgcggtaagtcatttcagtcaagaaaagtgtgagaatgccggagcaaacgagcttgacggcggcgttgagtacaatcttgacggttggattcggccgggcatgggccagtgcgcgaggcgaacgcgcgcatgacgtacggaacgtacagaacgtgcatacgggaatataggaagacggacgaggagcggattatggcatcggatttctggctgattgcgggactgggcaaccccggcaaaaaatatgaggacacgcggcacaacatgggcttcatggccgccgatgtgctcgccgaacgttggacggtgaacttcgccgatcacaagggcttggccatgctcggtaaaagcgtgatgaacctggacggccgcaccgtcaagttctttctggccaagccgctgacttatatgaatgattccggcaatgcggtggcttccattagcgcctattaccagatcgagcccgaccatattgtggtgattcacgatgacatggacttggaattcggccgtatcaaggtcaaggcaggcggctccgcaggcggccacaacggcatcaagtcgattgaccgttccctcggcacgccgaaatacgcgcgtgtgcgtatgggcgtcggtcactccaagcgcggtacgaacgcgcatgacaacacggtgaactgggtgctgggcggattcggtccggaccagcgcaagcagctgcccgaattcctggctgacggcgccgacgccgccgaggacatcatcttccacggtcttgccaagacccaggagaagttcaatggccggtgaggcgacgcacccggacctgatcaacggctcactggtaggcatcctgtctgagctggaacaggacaagaccttcctgaagctcgccgccggcgacatcgaggcttcggacgacgtcgacaactccgtcctggccggcacccccgaaggtttgcgcccggctttggccgccgccatcgggcagggtgtggccggcaaacccggcaagccggtcgtgctggtcgtggcctccggccgcgaagccgaagagaccgtgggctcgctgcgctcctggtatgatggcgacccgaacgacatcgcccagctcgaagcctgggaaaccctgccgcacgagcgtctgagcccgcgcgcggacaccgtggccagccgcatggccgtgttccgcagactcaagcatccgagcgataccgattcgatgttcggcccgattcgcattctcgtcatgccgatccgctcgctcatccagccagtcgtccaaggactgggcgatgtcgagccgctcgtgttcaccgtgggggaggacctgcccctcgacgaagccgccaaacgtctgatcgaaaacgcctacacgcgcgtggacctggtcatggaccgtggcgagttcgcggtgcgcggaggcattcttgacgtattcccgcccaccgcaccgcacccggtgcgtatcgaattcttcggcgacgaaattgacaccatcaaggaattccacgcctccgaccagcgtacctacggcgacggcctcaagaccatctgggccaccgcatgccgtgaactgcagctgaccgacgccgtgcgcacccgcgccaaagccttggtcggttcgattcccaatgctgaggacatgctcgaatccatcgccaacgccattccggtcgaaggcatggaatccctgatgcccgcactcgtggaccatctggaaccggtgggctccatgcttcccaagcacgccgtgatcctcctgagcgacccggagaaactacgccgctccgccgaagacttggcaaaaaccgcgaacgagttcctggccgcaagctggcatgtggccgcctccggccacggcgccggcgcgcccatcagcttcgacgaagccagcttcctcgactatgcggaaaccatcagctccctcgaatactccgagcatccggtgattcgcctcaccagtttcggcgtggacaccacgttgaccggccatgtgcagctcgacgcccagaacccggccgaattccgaggggatgaggccaaggcctcccaaggcatcgaaggcctgctcgatgccggcttccacgtcaccatcaccgccgctgcggccggcaccttggccaggctcaagcgtgcgatcaacactaccggcatcgccaatttcgacgtcatccgctctcaggccatcgacggcttcgtggacaaagccgccaaaatcgccctgctcaccgaacgcgacctgaccggccgcacttcagccgtggccgtggccaaaacgccgaaacgccggcgcaaggccatcgacttggtggagctcaaaaaaggcgattacgtggtgcacgagcagcacggcattggccggttcatcgaaatgcgtcagcgcaccatcggcaccggcgccaacaaaaccactcgcgaatacctggtcatcgaatatgcgccttccaagcgcggcgccccggcggacaaactgttcatccccaccgaccagctcgaccaggtcagcaaatacatcggcgccgaagcccccaagctcaacaagctcggcggctccgactgggcggccaccaaggccaaggcccgcaagcacgtccacgagatcgccgacgacctgatcaagctgtactccgcccgccagcgcgccaagggcttcgcgttcagcccggacaccccatggcagaaagagctggaagacgccttcccctatcaggaaaccgccgaccagctcaccaccatcgacgaagttaaatccgacatggaaaagcccgtgccgatggaccgcctcatctgcggcgacgtgggcttcggcaaaaccgaaatcgcactgcgtgccgccttcaaggccgtgcaggacggcaagcaggtggccgtgctcgtgcccaccacgctgcttgtccagcagcattacgagacgttcagcgaacgattcgagggtttcccggtcaatgtggcggccatgagccgattccagaccaccaaagagatcaacgagaccatcgaggggctggaaaccggcacggtggacgtggtcatcggcacgcacaagctgctgaacccgaaaatcaagttcaaggatctgggactcgtcatcatcgatgaggagcagcgtttcggcgtgggacacaaggagacgctgaaagccctgcgcaccaacgtggacgtgctgtccctgtctgccacgcctatcccgcgcacgctggaaatggccgtgaccggcattcgcgagatgtccacgctcgccaccccgcccgaagaccggttgccggtgctgacctatgtgggcgcctacgaggatgcgcaggtcaccgcagccgtacgccgcgaactgctgcgaggcggccaggtgttctatgtccacaatcgtgtgcaggacatctcgtccatcgccgacaagatccacacgctggtgcccgaggcgcacgtcggcatcgcccacggcaagatgggggagaagcagctcgaccagatcatccgcgacttctggcatcgcgacatcgacgtgctcgtgtgtaccacaatcatcgagaccggtcttgatatctccaatgcgaacacgctgatcgtcgaccatgccgaccgtttcggcttgagccagctccatcagctgcgtggccgcgtcggtcgcggccgcgagcgcgcgtacgcctacttcttgtacgacccgtccaagccgatgaccgagcagtcccatgaccggctcgccaccatcgcgcagaacacggcgctcggctccggtttcgacgtggccatgaaggacttggaattgcgcggcaccggtaaccttctgggcgacgagcagtccggccatatcgagggcgtgggcttcgacctgtacgtacgcatggtgtccgaagccgtggaaaagtacaaggagcccgaagagaacgtcgagccggtggccgtgtccatcgacctgcccatcgaagcgtcgattccgatcgagtacattgattcggacaagctgcgtctggaagcgtaccgcaagctcgcctccgcccgcaacgaggccgatctgaaggatttggaagaggaacttaccgaccgttacggcaagccgccggtcgaattcgagaccctgttcgacgtggcccgtctgaagttcaaggcccgcaagctcggcatttcggagattctcgcgcaatccaaccgcgtgcgcatcggtcgcatcgacccgcccgaatccatccagatgcgtatgggccgtatttacaaaggcacccaataccgcccggtcacccaccaactcatcgtccccaccccgttcaccggctccctgggccaaggtcccatgagctccgaccaggtagtcctctggaccaaccagttacttgatgatttggcatggaccccgtcgtcaagcaaacggcagagccgtttgtagacggggtgcgaggcgacagtcgagccagctatggctcaccgggcaacctccggtgagccatattcatattcatgccgtcgtttgtgacgatgattcaccccagacggaatcgttccgactgtccagcgagcgagattaagtgactgctatgagcgaaacgactacgagccgcacgaaccagagcgcgaccacggcaacacttgccggctatgagattccccgcctcggcatgggcacgatggcgctcgccatcgaggggcgcccctccaaccgtaatcaggcaatcgagaccatccatgccgcgctcgatgccggagtccgttatttggacacggcttggtcctattatctgcccagcgcacccggcaccggcgaaccggaggatatgggctatggcgaatatctggtccgcgatgctctgcactcgtggcatggccccaaagatcaggtgctcgtagccaccaaaaccggctggctgcgcacgcttgacggcaacggcaactacggctggcaggccgacgcccgacctgaaaccatgatcgccaatgccaaggaatcagcccgccgcctcggtgtcgatacgctcgatttgctctactcgcactgcaacgatccgcaggtgccgtacgaagaccagatgggcgcactcaagcagctcgtggacgaaggtgtggccaaagctgtcggcatctccagaatcgacaacgcggacatcgaaaccgcccacaatattttgggagatcgtctcgtggccgtccagaaccagttctccccggtccaccgcgaccctgagcacacgttggaaacctgcgaaaagctcggtttggcttttgtctgctggtcgccgctcggtggattccttgacccgttcaacgagcatctgttcgaccggttccgcgaagtcgccaagattcacgactgctcctaccagcgcgtcacgctcgcgtgggaacttgcgcaataccaatatctgttcacgattccctcggccagaaacccgcaggagattcaggactcgttcaaagccagcgaactgaaattgtccgacagtgaaatcggctacctcaatggcaaggatgttgactgagcgatttcgtccgtactgccttgcaatcaggcggcacactggcattgtgagcgctaacgctaaattttgggcgtgttgttcacaacgtccacaaatcgcactattcttaagaatgtcattcaagatacacaaccgttttaaggagtagttgtggcagtaattgaaagcgtgtacgcgcgtcagattctcgattcccgcggcaacccgaccgttcaggtcgttctggacaccgaagacggcgcccagggcctgggcctggttccgtccggtgcctccaccggtgaggccgaggcttgggagcgtcgcgacggcgacaagtccgtctacggcggcaagggcgttcttaacgcggtcaaggccgtgaacgaggtcatcgctccgaaggtcatcggcatggacgctgctgaccagcgcgctctggacgacctgatgatcgagctcgacggcaccccgaacaagggcaagctgggcgccaacgccatcctgggcgtctccctggctgctctgtacgcttccgccgagtccgccggcctgccgctgtaccgctacatcggcggcaccaacggccacatcctgccggtcccgaacatgaacatcatgaacggtggcgctcacgctgacttcgccaccgacattcaggagtacatgatctccccgtacggcttcgacacctactccgaggctctgcgcgctggcgttgaggtctaccacaccctgaagaacgtcctgaagaaggaaggcctgaacaccggcctcggcgacgagggcggcttcgccccgaagatgaagtccaacgaggactccctcaagtacatcatggacgccatctccgccgccggctacgagcctggcaagcagatcggcatctgcctggatgtcgcctcctccgagttctacaacaaggagaccggcaagtaccgcttcgacggtgaagagcgtgactccgcctacatgctcgactactacgagaacctcatcaacgagtacccgatcgtctccatcgaggacccgttcaacgaggaaggctgggaagactgggctgccatcaccgctcgcctcggcgatcgtctgcagttcgtcggcgacgacctgctggtcaccaacccggctcgtctgcagaaggccatcgacctcggcgccgccaactccctgctggtcaagctgaaccagatcggttccgtcaccgagaccctcgacgccatcgagctggccaccgccaacggctacacctccatggtttcccaccgctccggcgagaccccggacaccaccatctccgacctggctgttgctaagaacacccgccagatcaagaccggtgccccggcccgtggcgagcgcgttgccaagtacaaccgcctgctcgagatcgaggaggagctcggctccaccgctcagtacgccggctacagcgccttcaaggcctgcaagaagtacctggccaagtgagctgaaacgcccgtaaaggcgtgagtttccactgaagctcgatacccgtcgtattcgtcaagtcgaatgcggcgggtattttcgtgtgacatgagcaagtcgtcccgtaccggcaaacctggcaaaaccggcaaagcacaagttaggaaaaaagggtcggcggggcctatagcgttcttcgtctccctgttcattatcgcccttggcaccatccagctggtctccaccttccacacctatgccctgaacctggccgaactcaatggtctcaagcgtgaggaggcttcgctgattgcccaaaagcaggagttggaaaacgacatcaagcgttgggatgacaaggcctacatcaccgcccaggcccgtgaacgcctcggcttcgtattccccggcgaacaggccgtgcgtgtgcttcatcccgaagccgtgaccggttccgatagcgaatcccagaaaacggaagattccagtagcagcaacaaaaaagttctgccatggtacagcgaactgtcttactcgctcaaaaaggccgatgagcctgtgaccgatagcgagtccggcaaatccgatatttccggttcctctgactcgtcatccaacgactcatccaagcggtccgataagtcagaccagaacacccaacagaacacccaacagaacacaggggagggaacccaacagtgaccatcgatatcgccgccaaggccaaggcccttgtcgataccgtgcttgccgagcccgccaacgatcatgacatcgacctggtgcagcatcagctcggccgatacccgcgcggcatggtcgccgtgggggcgcgatgcgtctgcggtaggccacttgccgtaatcacccgtccggtgttgcccggcggaatccctttccccaccacgtgctatctgaccggtccggaagccgtcaaggccgcctcccatgtcgaggccgccggcgtgatgcagcaatacaacgacatgttggcctcggacgaggagctcaaggccgcatatgagcaggcccataacctgtatctggcattccgccacgaactggcaggacgtcttggcgacagtgaggagcatattgaaggcacttcggccggcggcatgccggtgcgcgtcaagtgcctgcatgccctgctggcccaatccctggttatgggaccgggcgtcaaccccattggcgatttggtactggaacgcgtcaaagacgaattcgatccgaccgtctgccgctgcacgctggacgattgatcaacagatgagccagcgcgaacagtccattcatacgcactaagggatacgaggagaaggcaatgagcaaggaatccgtaaccgtcgccggcattgattgcggcacgaactccattcgactgaaaatcgcacgtgtcgatgccgatggcatgcatgaggtggtgccgcgcatcctgcgtgtgatccgtctcggccaggatgtggacaagacccatcgttttgccgacgaagcgttggaacgcgcctatgtggccgctcgggaattcgccggtgtgattgccgaacatcccatcgacggcctgcgtttcgttgccacctctgcaactcgtgacgcggaaaaccgtgaggagttcgaggatgagatcgaacgtatcctcggcgtgcgccccgaagtcattcccggcaccgaagaagccgacctgagcttccttggtgccacttccgtggtcaatcgcgacgatctgcccgccccctatctggtggttgatctcggcggcgggtccaccgagctggtcatcggtggcgacggcgtcagtgcgcccactacccaggttcagggcgcgttttccatgaacatcggttccgtgcgcatgaccgaacgtcatctgaccaatgatccgccgacccagacacagatcgatgaggccgttgcggacgtcgatgaacatatcgatgaggccttccgcaccgtggacgcaggcaaggcccgtaccatcattggcgtgtccggcacggtgaccacgatgaccgccttggccatgggattgaaggaatacgaccacaccgtggtcgacgggcatcggttgagccttgaagacgcctatgccgtggacgacaagttccttaggatgacgcgcgccgagcgccgcgaatacaagaccatccaccccggccgtatcgatgtggtcggcggcggcgctgtggtctggagccgtgtgctggcgcgtgtcagcgaagccgccaaggccgatcatggtgaagccatcgattcgttcgttgccagcgaacacggtctgctggacggcattgtgctcgattatggtcgccggttgctggctcaatagcgtaagtggtaagtgcctccagcgggctgagccgttaagcaaacagcccggtgggctgtttgtaggcgaggggagcggctatgccgcgacggctgcacgaagtgcagcaacccgcaagcaatgctcagggcaggagatagcttataatagaaaagttggcctccgtggcgaaatggtatacgcagtcgacttaaaatcgatcgcttcggcttgtgggttcgagtcccaccggaggcaccttgaaatcggcctgtggccgatgccgtttttgcggctgtgccgtggtctctccccagtcggcttcgccgacagccccccccctcgtcagagggggctcgggcgggttctagtgatcgttgcaacacctgacctaccgcaaggagggtcaggtgaccagaagccaccgaaacgaagaccgtggcggggaacaccgttggacgttcaacggcgtcgaatatccgacgaggaagctgatgtgcgaggcgagacgcgccgagtacgtgcgcctgctggacgaggaaggcatgaacttcacccaggccgcgcacgcggtcggcgtctcgaaacgcaccggcaaggcgtggcgcaacggcaggacgcgcgccacgggaaggaacgagaaacccctggtggactggtatcgttccaccatggacaaacccaagaccctccatccgcgctacctgagccaggaggagcgcatccagatcgcggaccgtctgcgtctgggcgattcgatccgcgccatcgcccgcctgctgggccgcgaccccggcacggtcagccgcgaggtcgagcgcaacaggaatcccgagtccggcggttacgagccttaccgcgcccagcagaaggccgcggaccggctcaaacgccccaaaccgcgcaaggcggccgagggcacgcgactgtgggacgagatcgccgccgggttgcgcaggcattggagcccggagcagatagccaaccggctgaggctggacttcccggataatggggatatgcacgcgagcgtcgagacgatctaccaggccatctacctgcaggccaggggcgaactcaagcaggagctgaaacgcgccatgaggcaggggcgaaccgcccgcagaccccaaggcggccaaggccgcaaaccccgtttccgcgaacccatggccatgatctcggagcgacccccggagatcgaggaccgggcggtcccgggccactgggagggcgatctcatcaccggcagccgcaacaaaagcgccatcggcacgctcgtcgagcgcaccaccaggttcacgatcctgctgcacctgcccgacgggcacgacgccgaacacgtccagcaggccatcatcgacaagatgcagcacctgcccaaactcctgcgcaacagcctgacctgggaccagggagcggaactcgccctgcacaaacggatcggcgcctcgctggacatggccgtctacttctgcgacccgcactccccgtggcagcgcggcaccaacgagaacaccaacgggctcctgcgccagtacttccccaaaggcaccgacctatccgtctacccggaggactacctcgacgcggtcgccgaggaactcaacgaccggccacgcaaaaccctcgggttcatgaaaccaagcgagaagatcatcgaactgctcgacgccgcgtgataacctcaacaaccgacaacgtgaccatggaaggccgctcaaacctcaggtgttgcaaccaccactagaatctgccctcgcagctcactatgtggagagcttataaggccgaaacaaaaggccgttaggctatgtggcgttgtgacgatgtacctgatgaaacgaggaatccacatggcttcacgctggaccgatgtcgaacgagtcgaacaaggcgcactgcccaccatgcttgcccaagccgtcattgcgggcactgcactcaccgttggtgccatcgcctgctcgggattctatctgtccatgatcggcaatgtggccgcactcctgccatgggcgactatcgtgatactgatcgccgtggcgttcacctacatcgtcggcttcgccctgttgtggtgtgccgaagccctgaccctgcgtgccaacgacaaactcaagccatggctgtacggcgtcgtcggattaatcggctacggcgtgtggggcatgttcgtgatgagcgcgatgatgaacacgctgaaccagccgctgaacggcgtggtgttgtcgaacggcgatgtgatggccctgaccgtcaactacgcggtgttcggcttcatcgccttcctgttggcacaggcgtacgcgcccaaaatcgccaccaagaagggactgaccatcgggctgatggtggtgcagatcgtattggccatcatcggtatcatcgtactggtcatgatgttctccgcactgtctcactgactgacttatcgctcgccggcatgacgcgcgcggccatcatcgcacaaggcgaaagcgattccgggcgctgggctgggatacgatatcgtgatggtatgacgcctggtaacaccggcatgccgaaccagcaggggagaaggagccaaatgttcagtgtgcttgacatgttcaccatcggcgtcggaccttcatcctcgcacaccgtaggcccgatggtcgcggcacatgctttcgcctcctcgttgcaggccgaccatttggtcgatcgcaccgcacgtgtcaaaatcacgctttatggttctctggcgctgaccggtctcggccacggcaccgatcgtgctgcgatggctgggctcgaaggcaatctgccggccaccgtggataccgaccacatgatgcacatccgcgagatctgcgcgttggatgatactctgaacctcgccggcctcaaacgcatccatttcgactacgaccgtgacgtggtgttcgaacaatggaagcgcatggccgcgcaccccaatggcatgcgattccaggcgttcgacgccgccgcaagcttggtcgacgaacaggtctggtattccatcggcggcggattcgtgcgcaaaggcgctcccgaagacccgatgatcggcattcatgaacgccctccggaaggcgcctcctttgccgatgcggacgagtcatcatccactgatttcggcgtcgaggcaccctacccgttctcatcatgcactgaactggtgtcgttatgccgggaacatcatctcagcatcgccgaacttgtatgggccaacgaaaccgcttcacgctcgggcatccaggtccgatccgatattgatgccatctggcgtgttatgcgcgcctgtgtggaccacggatgcacctcggcggaacccacattgcccggtggccttgacgtaccccgccgcgcgccgaaaatgtatcggcgtctcgcctcgaattccgatgtgctgcgccgcgacagccggcgcaaagacgccgtgctcgagtcttccgacgccgcatgggtggatctcttcgccttggccgtctctgaggagaatgccggaggcgggcgcatcgtaaccgctccgaccaacggttccgccggcatcattcccgccgtgcttcactattactggcatttcgtggacaacgccaatgaacagggcgtggtcacgtttctgctgaccgccggtgccatcggatacctgttcaaacgcaacgcctcaatttccggtgcggaagtcggttgccagggcgaagtcggctcggcctgttcgatggcggcggccggacttgccgcagtcgtgggcggcacgccggaacaggtggagaatgctgctgagatcggcatcgaacacaacttgggtctgacttgcgatccggtgggcggattggtgcagattccatgcatcgagcgcaatgccatggccgccaacaccgccatcaacgccgtgcgtatggccatgctcggcgacggctcacacatcgtgacccttgatcaggccatcgaaaccatgaagcagaccggtgaagacatgatggccaaatacaaggagacctccaagggcgggcttgccgtcaatgtcgtcgaatgctgattgacatgtccggtattcaccagcatgatgaccggaattgacgtatacggccagcgtgtcgtatcgcacagggatgaaggactaccgccgattcgccgatggtgctaaggtagggcgcattgtgtctttgaaggaggactaatgacagatcagatgcctcaggtgaacgccgaatttggcaccacgcccgttatcgagttcccgacgcccgaagccccgaagggcctcaaggttgtggagctgaccgagggagacggcccgatcgtgcgtcgcggcgacaccgtcaccgtgaactaccacggcgtggtgtggggtaaggacaccccattcgactccagcttcgaccgtcatcagcccgccagtttcggcatcggcgtgggacaggtcatcaagggctgggaccagactgtgccgggccataacgtgggttcgcgtctggtggtttccattccgccggaatacggctacggttcccgcggcatcccgcaggccggcatcggcggcgaggacacgctggtgttcgtcatcgacatcatttccacccgctgaccataggtcagcacatgacgaacgccggggtcatagccggcgttttgtcataaataacgaagattgtttcagcatcgacaacggttcaggaggacgatatggctgaggacaaggtctacctgctgacgcaggaagcatacaacaagatgaaggaagagctcgcccatcgtgaaggtgagctgcgtgaggaaatcgcgcacaagatcgccgtggcgcgtgccgagggcgacttgtccgagaacggcggctaccaggccgcccgtgaggcgcagagcaagaacgagggccgcatcaccgagctcaccgtcaagctgcgcgattccaagatcatcgagaatgctccggaaggcaccgtgggcgagggctctgtggtgaccatcgagctcaacggcaacgagatgacctacgtgctcggcagccgtgacatcgtggccggcaccgactacgacatcatgaccccggattccccgattggcaaggccatcgagggcgccaaggtgggcgacgtcgtttcctacaccgcaccgaacggccgcgagctgtccgtgactgtcaaggccgccaagccgctggcctgagttaagtgactggtatgcccccgtaggcgggggcatacttatatgtcgtagcgcttattgccacagcgagacgatcaccatgtagatggccaccatatggcaggcatatccggccaccgttccgcagtggaaaatctcatggaatccgaagacgcgaggccaagggtcgggcttgcgcaaggcgtagacgatggcgccgaggatgtagcaggcaccgccggcgcacagcagcaccaccacggctggccccgcatacggcgaattccagaacatcaccatataagccaggccgtagatgccgaagatgatgtacaccaccgtatacagccagcgtggtgcattgatccagatcacatgaatcacgatggcgatggccgtgcacgcccacatcgatatgatgatcacattgcgccagaacggttccagcgcaaacgaaaccggggtatacgtgccggcaatgagcaggaagatgttgacatgatcgatacgccgcagcacatcggtgacgcgcgggctccaatcgcccagatggtagcaggccgaattggtgaacagaatcagcgacgctgtcatgaacacggcacacgcccacttcagactcgcgccatgtgccaagcatataagcacgatgcctgccgccaatgacaggggagcggcaatcgcgtgaatccagccgcgcatcaacggctttggtcgtccgtgcacgtcgagacgaatcttgcgttccacttccgcaggggcaatgccctcgattttcagcgcacggttctccgctttggcgagcttgtgccgggccttctcctcggctttggctcgaatggcctcggccttgaactgggccttggcccgtacggcatcagccttggcctgcaacgcctgttcgcgcgcctcgatagccgcctgacgcttggatgcgatggtggcatcctctgcaatcgtcgcgctgttatgagcgtcgtgatgcatcgtcttttccgagtcgccggttgttgatgccatggtgatgcccccgtttcacgagttgacgatacgcttcttacgctgccgtaacctacgttagcgtaacttttatgcttgtcaataccgactcgcacgaacactatcacccaatggcggcgatactatggaatccgaagatgagaacgtcgcagcaataaagggctcggcgatggtgtattgcacggagtgtgggtttgccaacgagcaaggaaatgccttctgttcgcagtgcggaagcccattggagcagcccgaggccaatccggcggcccctgcttctcctgaacctcccgccgggcgtcctggcgtcgatcacaccaaagcggtggtgattgtgctcatcgcgctgatttgtgtcgtggcgttagtcatcggcttgttcatcacccatagcatgggattgtggggagctcagccgcaggcgcaaacatcggcacagtcgaccggggccgatgcgttggattccgccgatgatggcatgacggattcttctgacgccaagtccaaggccaagaagaacacgtctgatagcgccaaagacaagaacagcgacgattcgtccaagaaaagctcgacggagaagtcgaagccttccactccggtgatcacatccagccagttgtctgacatcgcggattcatactcgtcctccgatgtggccgtctccgccatggtcatcgatggaacatccgccgactcctcagaggacgccaccatcgcgaccacgtcgcagtccggcaagcaattcgtggctgccgatttctatctgccggtctatcttgcggcccaggacaatggcgatgacaacgccaaagcgcaggcaaacgcgatgatgggttccatggacacagcaatgccggcaatatggtggcggcttcggatatcaaactgtacgtgatgcttgccgtgtacgataagcaacatgccggcaccttggccacgggcgggaagccgtgcaacgcgattggcgcggtattgaagatgcgatgtcgtcatagtcgtcgtacttgcccgtgtggcttgccgcgacggcggcggtgcgtctgcgtatgatagggatatggctgatttttcacatatccttgcaacgcgccccgacttcgacgacgaggaccgcgagtggctgcatcatcttgtcgccgattggcaggtgatcgccgatttgagctttgccgatctgctgctgctggtacaggatggcgatggcaaatacgtggtggccgagcaatgccgtccatccaccgttatgacgctgcgggcggaagacgtggtgggaaacgtcatgccggacgacatggtcggcgaattggacgccgccatgctctccagcgtggtgttccgctccacggtattgagaaccgtgggcaaggcgaccgtctgcaacgtgtacgcgccggttcggcacaatggcaagaccttgggcttggtcgtgcgtgagaccaatatggccacacgagaatccaacggccgatatgagtcggaaagcatcaacgccggcaagcatctgtacgagatgattccgcgaggccaattcccctacaaggattcggtgatgagccaacgccatatcgctcgcgtggcggacggcttcatcatcctgaccatggacggcgtggttcgatacgcagccccgaacgccatcagctgctttaggcgtctcggtctgctgaccaccatgcctggccattacctcagcgaactcggcacacagctattgaaggagaacgaccctgttccggaaaccctgccgttggtgttgacaggcaaagccgcggtcgactccgaactcaacgccaaccgttccgccgtctcgatgcgctcgttgcccttgtatgacaacaacggccgtatcggagcgattctgctatgccgtgacgtcaccgagctgcgccgtcgtgagcaggagctgcagaccaaggacgctacgatttccgagattcaccatcgtgtcaagaacaacctgcaggccgtctccgcattgctgaggcttcaggctcgtaagaccaagtcggatgaggtcaagaaggaattgcaggaggcgcaacgccgcgtgcagaccattgccatggtgcatgagggattgagccagaccgccgacgaggtcgtcgacttcgacaaggtgatcgccaacctgctgcgcatggccgtggacctagccacgatgaaagaccagcacatcgatatcaactacatgggcaagttcggcatgatgcccgctcaggatgccacgccgctgtccctcgtgctgaccgagctcatcaccaattcggtggagcatgggttcgaaggccgcaaggatggccatatcacgatttccgtgggccgctccggcccgaacctcaatgtggtggtcgaggatgacggttccggtctcggctccgaagaacagggtggattggctcgttcttccggttccggtttgggcacgcagatcatcaacacctttgtgaccaatgatttcggtggttccgtgcattgggagccgcgccgcgaaggcggcacccgcgtggtgcttgatatgaagctcagggctgctcaggacgagtgatgcgaagcccgaaatgaggaaaccctcccaagcgggagggtttcctagtatgacgaagcgataatcaaaacatcagatttgcatctgcatggcctgagaacggcgggcgcgcatggcgcggcgcttcagcgcacgacgctcatcttcgctcaagccgccccacacgccgtaatcctgattggtgtccagtgcgcacttcaggcatgcgtcaatcactttgcaggtgcggcacacggccttggcctcctcaatctgctgataggctgcaccggtgttgcccaccgggaagaagagttccggatccttgtcacgacatgcggccttggctcgccaatcaaaagcgctgctcattgcttgcctcccttaaaagccccgtggctggtgttgttccttaagtccagtaccaaggtaaccacgaaccgtggtgattttcaagaggttttgccgagaaaaaaccgaagttttcacgaagcgcactgcaccagacatgccgatgtgccctcgatgagcacggcccggcccgcgttgtcggcatcgatatgactcatcatatccaataggcgagcggggactccggccataagatcggacgttttctccccgcacgggaacacgattctggtattgcaatgctccggtatacgtatcgggcgaatcgtgctgacggcgaataccacgctgacggactcatcggccaacgcatgtgtgaaagacagcgcctgctcgtcggtgcggaatgggtcgaacaactcatcggcgtcgtcgacgaaccacacgatatgcggaggcggtggtgcatccgagctggcatacggcgtgcagcggccgccatgaagccattgcgagctccatacccgacgatgcggggaactgacacgtaccgccaagccatcagccatgctggcgtgtcgagccaatgttttcagcaacgtggttttgccgcgcccctgcgggccgatgacaccgatattgccaccggtgagggataccgtcgcctctcgcaggttgatgccatcgtcggcaagtccaaatcgaatgcgttgcggtgcgtggtcggccacagtccggtcttttacgtgccgggggagtggcgcggtaaacagggacggttgcggcgggcttccgacgaaccgcgatgcgaacgcgatctggcggcacaccgcatcgatatcgcgtgccgttgcacagcggaatgccgtcacctgttcggaatcgttgcagaacgccgcaccgggcattgccggactgaggtcggcggcacgaccatcgccaagcagctcgcatgattgcagacggtcccgaacccgtaaacaaatgctgacggacatattcgccttcatatcggcactgacctgacccatgggattctgcgtacaggcgatcagatacatgcccagtgacctgccgagcgaggcaatacgcaccagacgattcacataatccgggagctggtccttcagggcatggaattcgtcaatgaccacgatcaggcgcggtggtggattgaccatatcgcggatatcggaagcatggacagcggcggacagctgttcacggcgtgtcagttcggcttccagcgcacgcaacgcgcgtacggcatgcgccagatccagatcgcatacgctgcccacggtatgcggcaaccgttcgagtttgcggaacgcggaaccgcctttgaaatccaagaacacgaaattcagatgctcaggcccgttcatcgaggcgagcgccagacaccagctttgcagcaacacggattttccggaaccagtggtgccggccaccagagcatgcggcccctgacggttcagatcgagcatcagcggctcgcttccggtcatgccgatcggcaccgcaaggtcaaggggttcaagccagcggcccacaatggcgcgccatggcaggcgtgcgaagtgcagcagcgattctatcggctgcgacggcgcatgacggaggtctgcggcgcggtcatcggcgtcgcccgtgataccgacatcgatcgttgcctgttgcggatcgggagccttctccgggcctggaggcgaggggagcgtcagcagcagggacacgagacaggcgaatatgcccggtgcgatcatggcggcgaacagccattgcccgtgcaacagcagtatgaccatcatcaatgcctgcgcgatcatcgggcatgccgcggcaaacatggtcaggcgggcgcgcaatggcggcgcgcccaaacggtgcttcgcccgggatacggcggatgccgtatggacggaatgtcgcttcgaatcgttctgctgtgatgtcatgcttccagcgtgggggaacgcatgccgaaagcgcaagccgaatcaaggtatgtggttctagcttgccgagttatccacatgacattttgcccgtgcatgattggcggtgtaggcaacggtgacgatcatgcgccgatgatgaagccgatgggctccgggaaagcgtcggtcagccttccgccagattgcccacggtgccggccttatacgtgccgtcggcaagttgattgaacagttcggtgttcttggcgtcgtcaagcagcaccgaggaaccaacgccatcaacgtaataatcggggtcggaccagtacacgctgccggagatgccattcgagccggtggcgcttttgaacgccaacgccatggtgagcaacgtgtaagggttggtcttctcgtccacggtgagtgcgctcatcgcggcattggacactgccacgattttggacggattggtcagggtctcactgctggaagccttcttgacgatggccgagatgacctgtcgctggcgttcgttgcgtccgaagtctcctcgcgcgtcggcatatcgcatacgagagaaggacaatgcggtggaaccatccgccgtatggcatcccgccttccagttcagtccggaataggaatcctgaacatcctcgtcatagcacagttcgataccgcccaaggcgttcaccacgttctgcagaccgccgaacttgatctgtgccacatgatcgattttctggccggtgatctgctcgacgttgcttaccaaagccttcttgcccgcaatcagcgccaccgcattgattttcatgtactggttatcgacgttcatgagcgaatcgcggggaatggaaaccaacgaactcggcccgcttttgggcttgatcagcaccagaatcgtatcggtcctgaagccagagatattgtctacgccgccgtaatcggtggaaccgtcacgctcatcggagccaagaatcagccaagtcgaggccggcgtgttgggggtgtcggtcagccagtcgctccgattcagtttgctgtccacccattgccaggcaccgaaaacggaaagaatcaacgccgccaccagtaccgcgattgcgcatagggtgatgcgtaaggctcgcggacggcgtgccgttaccgttttcgccgttgccgccgccggccggccaagatggctgaacttcgtggacacgtttgctgctggcgatgagggccgggaaaccggcatatccgacggattgcgcacggcgttgcgggatgagccggaagacatccgcgctcgcgacggcggaatgctgcgcggtgcggcggcatccggagccgtgctgcgagtggcgcgtccggttttcggagaaaaactgggcggagtccgcctgccgttgtccgcgacgttggcgcttgccgtggcgttggcgttcagttgaggctcttcgatgtcatttcccgtgacggacggacgggccgatggagcttgacctgactggcgcgaggttcgggcgggggcgaaggagcgtggcacctgcccggaaggccgggtgcgtcgatttcccgcaggaatgaagcttggcgggttgatatgcggatccgccccacctgattcctgcgtcataacccctcctgaaactgtcgattgtctgaatgacactttgacacagcatccgccgggtgttcctgcgctatggtgttcctgcgcaggaacggcacaatatcatgtgcaacggcgtcagggcatcgcgttcacgccatagcacacagttccataaaaatgatgtaatgacacgagaaagaatttgacaaaaccgaaattgcatgtgtgtaatttagtccgtatgaaaagctcaataggcaaggagaatcgcatgtggggtgtggtcgacgattcagccgaagagccatggcacgaattgtggggactattccgacctgatggcgatgtatcttggcagcacaaggcgttgtgcgcgcaaaccgatccggaggcgttcttcccggaaaaggggggctcgacccgtgatgccaaacgtgtgtgcgcaaaatgcgaagtgcgtgagcaatgcctgaaatgggccatcgaccatgatgagcgattcggtatttggggtggcatgagcgagcgcgaacgccgtcgatataagcgagagcaccgggagcgggcgtagctccacacacccccttcaagtctggtgcgtacactgggagtttatgagtccgacaggtaatagcgatattcatgaggcgttggccgacgccatgtcttctcgaccatatacgcataggcaggatgtggataccggcattacggctgtgatcaccgttgaggaggatatgcgtttcctccggtctacattgcgttcggtattgacgcagaatgttcttccgggggtcgtcatcatcgccgacgcgaccgggcgcaccagttcgaggataaccacctcgttcgaggtcatcccctcgccatcggggccggtgatggaggtgccgcagtccaagcatgtgaccattcacatcgtctcggccaagggcgcacgctccttcggcgatgcggtcagccgggcattggatcgtgccgatctggatgacgctccccgcgcattgtggctgctccatgatgattcccgcccttcggatgactcatgccttgaacgattgcttgaggcgtggcgcaatacgccgggcgccagtgtgctcgggtgcaaacagtgcgattgggaaggctcccatctgcatgatgtcggtatgtatgcgggtcaccacgccgtgcattccctggtggtcgatggagaacccgatcaggagcagtatgacgggcggcaggatgtgtttgcggtgtcgctggcaggcgcgctggtgtccatgtcgcaattcacgcgactgcggggcatcaatgcctggctgaccacctacagcgaatcggttgatttctgccgccgtgtctgcctgagcggcggacgcgtggtggttgtcccgcaagcggagatatcacatcgtcgcgcacggtatgagggcattcgtacgcgaggcggggaaccgcttaaggacgatcacacggtcaatcatgcgatgacggtgcatcgctcccaacagcggtatctgtacacggacctggccatgtcgtcctggtttatcgtctggctgtggaggctgctccgcagttttggcatggccatatccatgatgttcggcaaggagccgtatgaagcatgggtgcaattgtgcctgccatggctggccttggccgatatcgcgggaaacatgaaatcacgcagtctggtggccagacaatcgaaggtcgccgcatcgtccctgcatgtcttgttcgcagacagccagcagatcaagcagttccatgatcgtcgggatgcattccaatcccagcagggcagagtgctgctcagtccgctggaacgtgcccatctgcggacacgcaccatatatcgctggagtgcggccgtggtgatggcgctggtgtgctttgcggccatcgcggtgatgtattggccggtgttccgttcgatattctccggcggatcgttgtattccgatgtgttgcttcccaccggtgccagcttcacgcaactggtgcagtccgccaccacgccgtgggtgtttggcagcggcaccggcattcctgcgccgcccacgccgtggctgctggtgctgatgctggcctcgttggtcacgctcggccatgtgaccgccgctttggcgatgatactgtttgtggccgcgccgctgagcgcattgtcgttctgggcgctggcgggcgtattcacccgctcggacgtggttcgtgtgctgggaggactgctgtgggcatccaccggcattatgttcggctggtatgcgcaggccaatatgccgatgcttaccgtaatggtgttcctgccggccgcgttcgcattcgtgttccgtgccgtgggcatgtaccataccgaagacccgctcaagccgcgcacatccgttcaggccgcggccatcgccgcactgtgcttcatccctgtggtggccgctgaaccgcagctgctgttcgcgctgatcgtcgtgttcctgatgttcctgctattcgtgcgtcgcaagcgcgccatgctgttgctaattccggttcctgccgcctttgcggtggctcctacgctcgtcaatgcggtgcgttacgccgatttgggcatgtggcgtcaactgttcggcgacatcacggtgccaacgtcatccgccaacgggtcgccggcgtcgctgagtctgcttgaggccgcacagcgtgcgctgggatggcgaatggggtcgactgattatgccgatttggcggtcactgtgctgtttggcgtcatcacgctgcttgctcttgcttcgctggtgctgccgttcgcgttgcggacctcgcgactgatgtgggtggtaatcgtctgcggaggcgcgctcgccctggtctccagccgtgtggccataaccgtggatgccgatggtgtcgtggccggttccgcgcagccgggcatcgcgatgatgatattgggcttcctcgcctgcgtgtgtctcgtcgctggtggggcggtgaagcgattccaaccgttgcatgcgtctggcagtgatcccgcatcgaaaaaggaccgtctgcatgtgctcatcgtgtctggccgtgtggtgcttgctctgatactggtgtgctgcattggcatccaatgcatgtatggcatcgaacgtcataaggatgcgggactgggcgtgtctgaaaacggcctgcccatggtcaccaccgattatctggaggccggtgccgatcatcgtgtgcttgccgtgagcgcggagacccgcaacatcgtcaactatgcggtgatgcgcacctcgcgcggcgatttgatcgacagctctccggtccagcgggcgcgcctgctgtccggcaagcatgatgcggttgacgaacaactggcccagtcctgtgcctcgctgctgtccaatcccgacgaagaggccatcgcggccatcagcgcgcttggattcggcggcatctacgtggttcccgagaccggcgattccttgaacgacatgccgtatgaacagttgagcgcgaatatcgccgcatcgaacggcacccagtccctggtctccacggatagcggcagctactatcgtctgacgctgcgtagcagcgcctcacagcaggtggatacctcatggcagcaacgtgcacagcatagtgtctggaggcacgcctggctgatatgcctaggtgtgatcacggcgttgtactgcttggtcgccatgcctcgcagacgaccgtcctacggattggaggagcaggcatgagcaacaaaacttctggtttcaaacgtgcgatcggcatcgtgctcggtgtgatcaccatgctggtgttgattgcgctgttcgtcgttctcgtcatggcccccatccccaatatctgggtggataaggtggccgcttccgataatgccatcgaccagaccgttagtccgacccagtccgaaacctactgcccggcacctataggattggccgataccggcacgtacggcgacagcgccttccaggccactgtcggcaatctgagcacacaagcgcgctatgcggcgttcggctccgtctacagcgccactgtctcggcgatcgggcaaaagtccagttcagatgacgtaactttgaaagacgccgattcgaccgacgattcctcggtgaaaaccggtgctcagaagatcaatcagggagctcgtctgatcaatacccgtatgctgcaggccgcagctggcaccggcaccgtcggcaccatcgcatcatgggccgatgatggcgatgtgagaggcatatcggcggcatcctgcgtatcgacctcgctcagccagtcgttcctgctctccgacagcacgaccggtaccacacagcagctcatcgtctcgaatctctccaccaagccgaccaccgtcgacattgccgtctggggttccgagacagccgggaaaatggcattgtccacccaatccacgctgtctgtgccagccgagggggagtcctcgatggaactgtccgccgcggtcgatgggcagcatggtctgttcgtgaccgtttccagcaaggagactcctatcgcgtccgtggtgcgcacggtgaccatggatggtctgacaccgaagggttctgatttcgcgctgccgctgccgaccgcatccaatgcatcggtggcgccgtccatcactgccggcgatgcggtcaccgcttatctgttcgccaaggcagacaccagcaccgggctgtcatggattaccgccaaaggcttggttcccgccaaagatgccaccgtcactgctgataaagtgacggcgatcgacttgggagaagctcctgatggggcgttgggcgtgatgtccaccgcagaggacgccgtgtcgttctccgtcaaggccacacgctccggtgactccggccaagccgatttcgcattggtcaatgccggcgagccatccgaattctcggggttggcccttcccgacggagtaaaggcctccatcacgctggccaatacgtccaatgcgcgcaggacggtcaccttgcgcgcctacgatgatgccggtgcttcggtaacctccaaggaaatcacactggatgcgaacgcagcacaaacgattgaagccggcaatctttccggcgatcatggcaccgcggtcgtgctgatgttggaggactcatccaagaaagtgagctggggagcgcggttcagtcacgattcgttgcaagacaaggacatcgccggattgtccgtcatcgacgcttcaacgctgatgcccgccacggttcatgtctgggctcggaacgattcctccatcgtcaagtagaagggtatgctcgccgaagcgtcagtttgatgatgtttcggcggcgatatagctgcgggccgtgccactaccttattacaagtgacacggcccgcagtgttgtcacaggccccagtcggggtcgatttcctcgggcctgcgcccatacaattccgctatgcgggccaccagctcatccctgacggccaattgcagttcgagcttggtaggtgcctcggtctgcaacggcatgcggtagagcacgactcgtgcaggaatgccgtggctggcggggaagcactgggacgtcatattcggctcggtctgccaaggcgtcggatccgaaggcggcacatcctccaccgcgaactggagcggacgtatcagttccggccacgcttggccgagcctgcgaacctgggccgccaccatatcgtcgaacatgccggtgcgagtgcggtaacggggcagacgggtgccgaacatcggggttcgtgtgccgcgaccgtggcggttgcggtagattcgtgcgttccaaggtggctgaagcatggttcccaccatagggcatggcggaggcaacatgcgttaggattggttcattggctgtgaacattcgtcaacgagggaggcacgacaaatggtggtacgttcgtggtccgaacttgatttcgataatgtctgctccaacgccaaggtgttcggtttcgatttggacaacacactggccagctcaaaacagccgatgaagcccgcgatgatcgaacggttctgtgcgttgctcgaccatacggtggtggccctgatctcagggggcggcatggcggtggtcacctcgcaggtgctggatgtactcaccccgaatgccaggcgcggcaatctgcatgtcatgcctacctccggctcccggtattaccggtgggatggcacgcaatgggccttggtgtatgcgcatgatctgtccgaagccaccgtggccgctgtctcggaaagtcttgagcgacatgcccgggaactgggattgtgggaacagcaggtatgggggcctcgaatcgagaacaggggcagccagatcaccttctccgctcttgggcagttcgcgcccgtagcggccaagcaggcatgggatcgcgataacacgaagaaacaggcgctggtcgaagcggtcaaggccgatctgccgcatatgcgggtcaaggccggcggatacaccagtgtggatgtcagcgaatgcggcatcgataaggcctatgccgtgcgcaagctgacgcagacacttggcatacgggccgatgaaatggtgttcgtgggtgatcgcatgacgcctacgggtaatgactatcccgcggttgaggccggtgcgatcggtgttcgtgttgagaatccgcaagatacggtacaactgctggatgcactgcttgcgcgattcgatactccagctcgatagtgacgcgttatggacgggccgagcgtatacaagtggtggcatgcgatgtgggcacaggtctgcaatctgctgtttccacgcggctgcgctgggtgtgacgcgccggatgaggtattgtgtgcggcatgctgggccctgttcgcgcaatgccgggaacgggatgcagacagtggtggcggagcccgtatatggtccgcatcgatttatcagggagcggtacgtcgtgccattctcgactggaaggaccacgacgataccgagcttgacggcccgttcggccgcatcatggtgtcgctgctgaacaagacgccaataccatcatcatgcttgggtcatcgcgtattggtggttccggtgccatcatcgcgggcgtcaatgcgccgaagaggacgtgcccatacggcaccgttggccaaatcggtggcaggggcattgcgtgggtgcggcgtcgatgcgcgaccatgcaatgccctgagctcctccaccaaggcacgctccgtgcagcaggtctcttcggcacagcgtgcccgtcgtatcaccggtcatgtcagggtgaagcgtgatctcatcggcaatggcgacgcggtgcttctcgttgatgatatcgtcaccacaggtgccactgtgcggcaatgcgttcaggcgtttcagcaggccggcaccaaggtggtgggcgtgctggtattggcggatgccgtggtgcgacggtccgatgacgatatcaacgggtgaatgacatcggtgacgatgccccagatagcaggcgaagcgccgttgctcggcatgtaatcggggtatcgcggattctcggcgtgcaatatggtgatgccggcccgtgaaaccagccgcttgatggcgatttcgtcgtccatgacagccgcaaccacatctccggggactggtgccaacgaacgatcgacaatcagcagatcgccgttgtgaatacccgcattgatcatggaatcgccggccatctgcataacaaacagcgtggcctcgtgcgccatggcctgtgactcggattgctgtgtcatgctgcgcctcccaccctgtattcgaacatctgttcgaatacagtatacggtaggacgtcggacaatatcagcgttcggcgatgtgatatttaggcaggatgatttcgaaatcggcacctcgcgtgtcgtcgaccactttgacggtgccaccgtgcaattgggccgcccagcgcgcgatggacaggccaagaccggtgccgcccgactcggtgccgggacccgtcttgcctttgacaaagcgccggaagatgtccaaacggtcggaaggtgcaatctgggagccgaaattcaccacattggtcacgatggtgccttggttttcgtcctcgtgggcgtcgaccagcacggtggtgccgtcggccgaatgtttcagcgcgttggcgatgatgttggtgaatagctggcgcaggcggtcctgatcgccttccatcgtgatgtcggccggcacggtgacgcggatgtcgtgggcgtggccaccatcggcgatttccaacggctcgatggtctcgtcaagaaagtcggcgaagttgaacttttcgatattcagactcgccgcaccggcctccatacggctcaggtccagtaggaaggcgatgagatcggagagacgctgcgtttgggtgaggatgctctccagattggtgggagtgggctcggtgacgccgtcggccatgttctcgaccatcgcctgcaaagcggaaacgggcgtgcgcagctcatggctcacattggcgatcatgtcgcggcgcattttatcggcatgctcgagttcgccggccatctcgttgaacgagcgagccagcttgccgacctcgtcatgacgatcctgatcgatatccacgcggaccgtgtaatcgccatccgccatggcttcggccacatcgcgcatctggcgtaggggagcggtgatgccgcgagagaagaaataggtgatgcccaaggccaccaccaaagtcagcggcatggcgatccaaccggaccagccgaatttcaggaggaaccagcacatggcaaacgcgatggcagtggcgataacgatcagtgcgctgagttccagcttcagagatgagaacaaatcaaccggcttgacgcgaggtttcatcgcatcaagccgggattgctgttgttttttggatgccatcacgcggtcggcggctcgaaagcgtagcccacgccatgcacggtgcggatggtatcggcaccgagcttatggcgcagcgccttgacgtggctgtcgacggtgcgggtgccggatgcgtcgacccagtcccagacctcttcgagcagcttttcgcgggtgagcaccgacttcgggcggcgggccagcgtggccagcagatcgaactcggtgggggtcagatgcacctgttcgccgttcacggtgacgatgcgctgggccgggtcgatgaccatcgaaccgaagtcgagcagcttctcgttctccgagttcttggcgatgaccttcgcacgctccacgcggcgcagcagcgccttgcagcgggcgataagctcgcgcatggagaacggcttggtcatgtaatcatcggcacccgctcccagaccgatgaccttgtcggcctcgtcatcacgtgcggtgaggatcagcaccggcaccggacgttcggcgacgatgcgtttggtggcctctagaccatccataaccggcagcatgatgtccatgatcaccagatcggggcgtagctgggacgcggcctggacggcggaagcgccgtccccggccacgcgagcggtccatccttcagcggtgatgcgctgggcgatggccgtggcgagcgtgggctcgtcctcgaccaccagcaccgtgcgcggtgtcgtattctgacgcgctgtggtattgagcataaataaaccggttacctttcagcctgttgaccagttcagtcttccggcttcaagaatacaactcccagagccggaacggtgatcttcgccgagaacggacgtgaatgatattcgccctcgaccgcttcgaaggtgccgttgtggatgtcggagccgccgtacttggcgtcatcggtggtgaacacttcggtccacttgccgccggtgggcagcgccacctggtaatcggaccaggcctcaccggagaagttgaccaccacagccaaggtctcgcccttggtaccgatgcgcaggaagctcagcgtgttgtggtcggcatcgtcgctggtcagccactggaagccggccgggtcgaagtcctggctccatagtgccggatgcgccttgtagaaggcgttaaggtcggcgaccatggtctggacctgacggtgctcctgccagttcaggcaatcccaatcgatggaggcgtcgtgatcccactcgccccactgggccagctcgttgcccatgaaggagagcttcttgcctgggtgagcccactgataggcgaacatcgaacgcacgccggccagcttctgccagtcatcgcccggcatcttgccgtacagggaacccttgccgtacacgacttcgtcgtggctgatgggcaatacgtagtgttcggagtaggcgtacaccatggagaaggtgatctcgttgtggtgccacttgcggttgatgggctcctcgtgcagatactcgagggtgtcgtgcatccagcccatgttccacttcatgccgaagccgatgccgccggcggaagtgggggcggtgatgcccggccatgcggtggactcctcggcgatcaccatgacgccggggttgttcttgtacgcggtggcggtggcctccttgaggaagtcgatggcctccaggttctcgcgtccgccgtagatgttcgggcgccaatggccgggttcgcggctgtagtcgaggtagagcatggagctgacggcatccacgcgcagtgcatcgacgtgcaggtcctcaagccagaacagggcgttggccaccaggaagttgcgtacttcgcggcgtccgaagttgaacacataggtgccccattcagggtgttcgccgcgcagcgggtccgggtcctcgtacagcggggtgccgtcgaagcggccgagcgcgaaggcatccttcgggaagtgggcgggcacccagtccatgatcacgccgatgccggcctgatggaactggtcgaccaggtaacggaagtcgtcgggggaaccgagacgggagtcgaccgcatagtagccggtgacctgatagccccaggagccggagaacgggtgctgggccagtggcatgaactccacgtgggtgaagccttcctgcttgacgtagtccacgagctgcttggccaggtcgcggtaggtcagtccctgcctccagctgccggcgtgcacctcatagatggagaccgggccatcatgcgggttggtggtgcggcggtgctgcatccaggcgtcatcgttccacttgtaggtggattcggtgacgatggaggcggtgttcggcggaacttcgtgctgacgctccatcgggtcagccttcatctcccacgtgtaattggcgttcaggatctggaacttgtaggtctcgcccgcgccgattccggggatgaagatctcccacacgccggaggagccgagctcgcgcatggcatgacggcggccatcccaagcgttgaagttaccgactacgcgcacggcatgggcgttcggggcccacacggagaatgcggtgcctaccacctgttcgccgggcgtgccgtctgcgccgcccatcggatcgtcatagcgcagcacatgcgcgccaagcgtctcccagagcttctcgtgacggccctcgccgaacagataggtgtccatgtcgccgactgtgggcatatagcgatatgggtcgtcctcaatgagcactgcgccgctttcccactcggtcctgacacggtagtcgggaatcgtgggctgcttcttagtgccggaagccggcacggtaaccacgaacacgccgttgtattcgtgggtcatcgggtattcgccatcctgggtgaggatggtcacggacttggcaagcggacgcagcacgcggattgtggcggtgtcggcatgcttgccgatgccgagatgcccgccgagaactccgtgggggttgtagaattcagcattgctcgtcgcatcgaggtcgccttgggcgacaggcacggtgacggtatcttccttgatcttcgtttctttagccatgtcccaaagtctacgtgcgttgaagtcgaaaacgctacattggcgcgttgaaaatggcgaattcttgcccttttcgttgtgtttccgtggttgtgagcgctctcataggggtggtccagaccgcatggcataattattcgagttttcgtgtgtaagccgtcagttctcggagggtacatgtcttacaaagtcggcgatatggtcgtctatccgcgtcatggtgcagcgaaggtggaggccattaccgagcggacggtcaagggagtgacgcgcgaatatctgcagttgtccgtactctcttccgatggtttggtcatcaacgttcccgtggacaatgccaagaaggtcggtgtgcgtgacatcgtctccgcatccgaagtggccaaggtgttcggcatcctgcggaccccgatcatcgagaaagagatgaactggtctcgccgttacaagctgaacgtcgaaaagatcgccaccggcgatgtcaacaagatcgccgaagtggttcgcgatctcgcccagcgcgatgtcgacgagcacggcctgtccgcgggcgagaagcgcatgctcaccaaggcccgtgccattctgacttctgagatcgccttgtccgagaagatcgacgaggcggaagcccagcgtctgctcgacgtgaatctgggctacgagcccgctcagcccggtgacgacaagcatcacaccgccgagcccgaagaggccgcggccgatactttggctcgtgttgaagccgagaagaagtccaagaagaagtgatttgattgttttgaggccccggtcgtgtccttatgcgatgcgccggggcttcgtgattcataatcgtttgctgccgttcgtctgggcaacgccatcgaaggggactgcatggggtctgtaggagtgctgatagggcaaggttttgacgctcaccgttttgcgcctgctggctcaggccgtgaactgtggattgccgggctctactggccggtgcctgattcatgcagcgaggccgatgccgccaaatacgaggggatcgaaggcgattccgatggcgatgtggccgcgcacgctctgattgacgcgttgcttgccgccgcccgattgggagacattggttcactgttcggtgtcggtgcggacgcgcatggtgccggaatgcatggcatcgatatgttgcaagaagttgtggcgcatctggcatccaacgggtatacgccggcatcggcctcggtggcgatcatcggcaaccgcccgaaaatcggcacacgccgtgctgaagccgaagccgccctgtctgcggcggttggttgcccggtatcggttactgccaccaccaccgaccatatgggattcactggccgcggcgaaggcatcgccgccatcgccaatgccttggtggagaagatataacaaagcccccgctatgaattcgccagcgggggcaagaaaaaatggatgagattacttccgcatcgtctccacggctttggcgatagcccagaacagggtggaaagcgtcacgatgatgaagctcgggggagcggggaacatcgccgacagcacgagtccggcccaaatcgacaccaagcacagcacgctggcgatcaccattgccttgaatggggagccggccagaatattggcggtggccgcgggcgtaatcaccagtgcgaaaatcagcaaggtgcccactgccggcacggcgatggtgatcacaccggccataatcgccataaacgccacgttcatcagcccgatcggcacacccttggcctgtgccacctgctcatccagcgagctgaacagcagcgggcggtagatgatggccaacaatgccagcagcagtacgtcgaacacggcgaagccgatgatctggccggtggtgatggtcaggatcgagccgaagaggatcgactgcatctgctgggaggcggaactcgacaatcgcgcgaagaacagacccaagccggtggcgaaggccagcacggtgccggtggcgatttcacgctcggaaacgcgcttgcccaaagcaccgatcaccagtgcgccgcccagtgcgaacacgcccatgcccagtgacacgggcaggccgagcaacaccgcgccggtcgcgcccggcagaccgatatgggccagcgcatgggccgcgaaggtggaacgacgggcgatggtgaagtatcccatgacaccggcggctagggcaatgcacaggccggcgatgaaggcgttggtcatgaatggagcggacagtgtatccagccattcgggatcatacgaaaagttgatggtgctcatgtctctgtattttctccatgcctgagctgcagtccgttgatgggctgtgggtcggctcgcttgatgttatcgattctcggcgctgatggcggcactgccattggtggcattgccgtgctcgtgatggtgcaattgcgccacttcggctgccgtgtgcatatcctgcggctggtcctggagctcatccggcgtcggggtcacgaacatgtctccctgcggagtggtgaccacctgcacctgtgtgccgtagaggtgggtgagtaggtcggagtcgagcactttgtgcatatcggcgtagtgcgggtgaccgtcgagcaagtagacggcaccggtcagaatcggcaagagcatattgagatcgtgcgcaaccacctggatggtcatgttcagttcgcggttcagcttggccagcacgtgtacggtggcgcgctgactggccagatcgaggttggccaacggctcgtcaagcatcagcagttgtgggtcgcacaccaacgcctgggcgatggccacacgctggcgcaaaccgccggacagttcggacagacggtaccgcgccttgtcggcgatgccggtgaactccatcgcctcgagcgctttggctttctgggccttggtgatggggtggatgccgaatcgggtgccggtcaggcccagcaacacggattgttcggcggtgagattggaatcgacattcgccacatagctctgcggcacatatccgatgcgtttgttcatctcgcctgcgggcttgcccagcacggtcaggctgccatgacagagcggcaaaaggcccagctcggccctcatcatcgtggttttgccggtgccgttggtgccgacgatggccgtgaccgaaccggtgggaatggcgaaggtgccatgctgccagatgatatggtcgccacgcttgatggcggcatcgctgaacacgatgcaatcggaagtttcactcataacgcccgattgtggcaaacgatgctgacaatcgttctcaatatcgtgtacggatggtgataaccaaagagaagggttgtgcggccatctcgacaatggtcgcacaacccttctcatgcaaggcgtctattggcattggcacgaatccgatgccggtgtcctttgcttctaactatttgccggagtcggtctggtcgttgccggaggcatcgccggaatcgccattggcggcatcggcctttgccgaatcctgagatgagtcactggatgcggccgccttgcactgacggatgtacttggggtccgtgctggaaccggtgctggccttggagtcttgcgcattggcatcatccgtggcggagccttcggcgctggaatcatcggaattcgcgttgctgtccgcggtatcgccgtccgtggcgtcttcacagccatagcttggatccaccgcgtcgatgatggtgttgatgagctggttgatccaggcgttcagcgtgtcggcgtccttgggcatttgttcggagacgtcgactaccggcacatcggcgcgaccggcagcgccagtgatcatattggtcgcgtcactggcttcctgcgtgttgttgaccagcacatccacgcccttgtcttcgatgagtttctggaaagactgcaggtccgcgggtgccggttcgccgccggaagcggtcgattgcgtataccccttgggcgtctgatctttgaacccaagatcggccatcagataatagaccacgggttcggtggctgcataggtgaggttggagtgggacttggtgaactcggacgcccatgtttccaacgatttctcgtccgcctgccatgccttgagccgcttctggaaggccttcttcttgctggggagtgcctttatatatgcatcggtgatggccgtggccatgctggatcgagcgtctttggagaaccacagatgcgggttatcgccctcgacggcacccatgacggaagcggcggatacgatattcgtggtcttggtcatcgatttggtggcccaggaatcgtagcccgcaccgttggccacgatgatttgggccttggacagcttggcgacatccgaggtctttggctcgaaatcgtgggcatccacattggtggagttcacgatggacgtgacttccacatcatcgccgcccagctcggcagccagcgagccccattgattgagggagaccaccacattgatcggcccggtcggtgcgggaacgctggtcttgttgtccggctcggtttcagcgggggaggtggctgcgcatgcggtggtcgcgaacaacaggacggcgctcaggccggctgcggcgagtcgcgtaagtcgtgtgatttgagtccccatggcacgccttcttcgtgagagcgaacgatatataatcctgacttgttccaacgatagcctatcgtttcgatagaatgcaccgaaactacaggggagggcgttgatgtccacaaaaatcgacggtaagcagattgcggccgaaatcaagaccaaccttgccgagcgagtgaacaagctcaaggcgcagggcatccaaccggggctgggcacgctgctggtgggcgaggaccccgggtcgatgaagtacgtggccggcaagcacgccgattgccaggaagtgggcattacctcagtcaagaaggaactgccggcggacgccagcttcgacgacatcgccgctgccgtacgcgaactcaacgaagatccggcctgcaccgggttcatcgtccagctgccgttgcccaagggcatcaacgagaacgcgatcatcgacatgatcgacccggccaaggatgccgacggcatgcacccgtacaacctcggcgaactggtgctgcatgtgcgcggcgacatttcgacgccgctgccttgcactccgcgcggtgtgctcgagctactcgacgcctatgacattgatctgaacggcaaggaagtgtgcgtgcttggccgcggcatcaccattggccgcacgattggcctaatgctcacgcgcaacgccgtcaacgccaccgtcaccctgtgccacaccggtacccgggatgtggccgaccacatgcgccgcgccgacgtgatcgttgccgcaatgggttcggctggattcgtgacgcccgacaaaatcaaggacggcgccgtgctggtcgacgtgggcgtcagccgcgtctacgacgaagaagccggtcgctaccgcatcaagggcgacgtggacaaggcctgctacgacaaggcctccgcctacacccccaaccccggaggcgtgggccccatgacccgagccatgctcctagccaacgtcgtggaaatggccgaacgacacgcctagagtttcctaggaaatttgggcagagttgcttgtattgtgagtatctgtatgcctgtagggtgtgcgtataactgaatatcgagaaattatccatccactattagaaaccatatatttacatggcagagaacaacactgaagtcaccaaggttgccatcaacgacatcggcaccgaagaggacttcatcaaggcagtcgattccaccatcaagaacttcgatgatggtgatctggttgagggcaccgtcgtcaagatcgatcacgacgaagtcctcctggacatcggctacaagaccgagggtgtcatcccctcccgcgagctttccatcaagaaggacgttgatcctgacgaagtcgtcgaggtcggcgacaccatcgaggcccttgtcgtcaccaaggaagacaaggaaggccgtctgattctgtccaagaagcgtgcccagtacgagcgcgcctggggcgacatcgagaagatcaaggaagctgacggcgtcgttgagggcaccgtcatcgaagccgtcaagggcggtctcatcgtcgacatcggtctgcgtggcttcctgcctgcctccctcgttgagatgcgtcgcgtccgcgacctctccccgtacatcggccagaagatcaaggccaagatccttgagctcgacaagaaccgcaacaacgtggtcctgtcccgtcgccagtacctcgaggagacccagtccgaggtccgcgagaccttcctgtcccagctcaagaagggccagatccgtgagggcgtggtgtcctccatcgttaacttcggcgctttcgtcgatctcggcggtgttgacggcctgatccacgtttccgagctgtcctggaagcacatcgaccacccgtctgaggtcgtcaaggtcggcgacaaggtcaccgtcgaggtgctcgacgtcgatctcgaccgtgagcgtatctccctgtccctgaaggcgactcaggaggatccgtggcagcgcttcgctcgcacccacgttcccggccagatcgtcaagggcaaggtcaccaagatcgtccagttcggtgtcttcatctccgtcgaggacggcatcgagggcctggtgcacatctccgagctcgccaaccgtcacgtcgagaacccggagaccgtggtcaagccgggcgagaccgtgttcgtcaaggtgatcgacgtcgacctcgatcgtcgccgcatctccctgtccctcaagcaggccaacgactccgttgacccggcttccgaggacttcgatccggccatctacggcatgccggccgagtacgacgagcagggcaactacaagtaccccgaaggcttcgacccgaacaccaacgagtggatcgctggttacgagaagcagcgcgaggagtgggagtctcagtacgccgccgctcacgagctgtgggaggagcacaaggagttcgtggccaaggagctggagaacgctgccgaatccgcagccgccgacggccagggcccgaaggaagagaagccggtcgaggagacctccaactactcttccgctgctccggctaccggtaccctcgccgactccgatcagctcgccgccctgcgcgaccagctgctcggcaagtgagtttgccgcgaagctagcgcttagcgtgtaaagaaacccggtccgattgggccgggtttcttgtgtttttggagttatccgccaatgactcccctcagtctcgctacgcgagccggctcccctccctgaggggagctgtcggcgatagccggccgaggggagcgccagctatcatgggcaccatgatgcgaataggactgaccggcggcatcgccgcgggcaaaagtacggtggcggcgcgactcaagcaactcggcgcgttgcatatcgactacgatgcgctggcgcatcagatcgtcgaacccgggggagtggcgctgccacagatcgtcgccgagttcggtcctgatgcattgctcgccgatggcactatgaaccggccatggattgccgatcatgtcttcggcgcgaacgccgcgccgggcgcacgtgaacggctcgacgccatcgagcacccattgatctatgccgaggcggcgcgactggagcatgagcaccccgaggcagccatcatcattcacgacattccactgctcgccgaggtcattgacgatattccattcgcctttgaccatatcgtcacggtcgaagctcccgtgtgcatgcggctcgaccgtatggtcgaggaacgcggcatgagcctggaacaggccgaggcccgcatccgccaccaatccagtgaggaggagcggcgggccatagccgatatcgtcatcgactccacccatccattgcccgagatgctggcccaagtgggtgagatatacgcaggatggtgcgcaggtcgctaagatgaggccctatgggattcaatatcgagcgcgcggacaagcctttcgtcgtcaaatcgccatataagccatccggcgaccagccgcaggccatcgccgaactggccgaacgcatcgaaaacggcgagaatgatgtggttcttatgggtgccaccggtaccggcaaaaccgcaaccaccgcctggctgatcgaaaagctgcagcgaccgaccctgattatcgagcccaacaagacgctcgctgcgcagctatgcgccgaattccgcgaactcatgccggacaacgccgtgagctacttcgtgagctactacgactactaccagcccgaggcatacatcccgcagaccgacacctatatagaaaaggactccaacatcaacgacgatgtggagcgcctgcgccaccaagccaccgcaaacctgctgacccgccgcgactgcgtggttgtggccaccgtctcctgcatctacggcttgggcacgccggaagaatacgccggtcgcatgctcttcctcaaagtcgggcaggaaatcaaccgcgacgacctgctgcgccaattcgtggccatgcagtacaagcgcaacgacatcgccttcacgcgcggcaccttccgcgtgcgcggcgatacggtcgaaatcatccccgtctacgaggaactggccgtgcgcatcgaattcttcggcgacgagattgaccgcatctccacgctgcacccgctgaccggcgacgagatcgacgaggaaaacgaagtccacatcttcccggcctcccattatgtggccggccccgaacgcatggaacgggcgctcaaaaccattcgcgaggaactcgacgaacgcctggcagaactgcgcaaacaaggcaaggagctggaagcgcagcgcctcaacatgcgcaccacctacgatctggaaatgctcacccaagttggcgtgtgctcaggcgtcgaaaactattcgcgccactttgacggccgcgccgctggcaccccgccgcacacgctgctcgacttcttccctgacgacttcctgctggtcatcgacgaatcacacgtcactgtgccgcagatcggtgccatgtacgagggcgatgcctcccgcaagcgcacgctggtcgaacacggcttccgcctgccctccgcgatggacaaccgaccactcaaatggccggaattcctgcagcgcgtcggccagaccgtgtacctgtccgccacgccaggcgactatgagatgggactgtccgatggggtggtcgaacagattatccgcccaaccggtctgctggacccgaagatcgacgtacgcccggtcaaggggcagatcgacgatctgctcgccgagatcaaggcccgtgtggccaagaacgagcgcgcgctggtcaccactctgaccaagaagatggccgaggacttgaccgactatctgctggaacgcggcatcaaggtcgaatacctgcattctgatgtggatacgttgcgccgcgtcgaactgctgcgcatgttgcgcgaaggcaagatcgatgtgattgtcggtatcaacctgctgcgtgagggcctcgatttgccggaagtatcgctggtggcgattcttgacgccgacaaggaaggattcctgcgctcctatcgttcgctcatccagaccatcggccgtgcggcccgaaacgtgtccggcacggtgatcatgtacgccgacgagaccaccgaagccatgcggcaagccatcgacgagactgaccgtcgccgcgccaagcagattgcctacaaccaggagcatggcatcgatcccaagcccctgatcaagaagatcagcgacgtcaacgacatgctcgccaaggaggatgtggacacccagaccttgcttgaaggtggctaccgcaacgcgggcaaggccggcaacacgcacctgggcgtgccggtactcgatcccaacgaggcagacaaacgccacgaggagatcctgaaggccggcctgcccgcgcaggacctcgccgacctgattcgccaactgagcgaacagatgcacaccgccgccgaacaactccagttcgaacttgcggcccgtctgcgcgacgagatccgagacctcaaaaaagaactccgtcaaatgacggaagccaacaagtaaccaaattcccatacccgaggcgggcagtcaggggatgcgttgtcgaccgtaaagacttggcctgagcggcccggagcgtgtcgaacaacacatcccctgactgcctggcgatcagcgctaccggaacggccccaaaaccgtcacatacataagttagtgtagggaatcatggcagaaaccccactcgcatttgaaatcatcaccttcgtggtgctcgcgttgttctttatcgtcgacctgttcgtcatcgggcgtcgaccgcatgtgccctccaccaaggaatgcgtgcagcatatcgccttcttcgtggttatggcgctgatcttcggcggatgcatctggttcttcgccggctccaagcctgccatcgagttctattccggctggctcaccgaatactcgttgtccatcgacaacctattcgtgttcgtcattatcatgtcgaacttcgcggtgcccaagcagattcagaagtatgtgctgtccatcggcatcaccattgctttgattttccgtggcattttcattctgatcggcgcggccctgatctcccgcttcacgtgggtgttcttcctgttcggtgccttcctgatctacaccgccgtcaaactggtgctcggcggcgatgaagatgaggaatatcacgagaacggcatcatccgtaatctgcgcaagatcatcaagattaccgacgactacgacggcgagaagctgcgcaccaccaagaacggcgtgcgttactggaccccgatgctcatcgtgttcctgaccatcggcaccaccgacgtcatgttcgctttcgactcgattcccgcgatcttcggcctgaccaaggatccgttcctggtgttcacctccaacgtgttcgcactgctcggcctgcagcagctgtacttcctgctgggtgctctgctcgacaagctcgtctacctgcctgccggcctgtccgtggtgctgggcttcatcggcgtcaagctcatcatggaggccctgcacggcaataccttgccgttcatcaacggcggcgaaggcgtccattgggtgccggaggtgcccacatggctgtcgctggctgtgattgtgctcgcaattggcggcgcatccgtggcttccgtgatcaagatgaagagcatggaaagcgctgaaaaggcctgaaatcgttagagaatacaacccttaaacccagtcaacacaacaatgtgagcgctcacaacacaccgtgaagaaaacttgtcatgagtcggctcgcgctagtagactgggtttcggcaaatggggcaatcgcgcctcgaaccaaattgaacaagaataggcaggcattcatgcgtaaagccaagatcgtagacaccatcggtccttccaccgaggattacgacaacctcctgaagctcgttgaagctggtatggacgttgctcgtctgaaccgctcccacggcacccccgaggatcacctcaaggtctacaacaacgtgcgcaaggccagcgaagccactggtcgcaacgttgccgcgctcgttgatttgcagggcccgaagattcgctgcggttggttcaagaagaacgccgatggcgaagacaaggttcagctgcagctcggccaggaattcgtcatcaccactgatgacgtcgagggcgacgagcacatcacctccaccaccttcaagggcctgccgggcgattgccacccgggcgacccgatcctgatcgatgacggcaaggtccgtcttgaggtcaccaaggtcgagggcaacaacgtgtacaccaaggtcgtcgtggccggtcctgtgtcctcccacaagggcatcaacctgccgggcgtcgccgtctccctgccggctctgaccgagaaggatgaggccgacctgcgttgggccatccgcaccggtgccgacatcatcgccatgtccttcgtgcgtttcgccaccgacatcgaccgcgcccacgagatcatggacgaggaaggccgtcgcatcccgatcattgccaagatcgagaagccgcaggctctggagaacctcgaagagatcgtcaagaccttcgacggcgtcatggccgcccgtggcgacatggccgttgagtgcccgctggaagaggtcccgctggccactaagcgcatcatcgagctggctcgccagtacgccaagccggtcatcgtggctaccgaagtcctcggctccatggtgaactccccggttccgactcgtgcagaggcttccgactgcgccaacgccatcctcgacggctccgacgccaccatgacctccaacgagaccgccgttggtaagtacccggatgtgaccgtggccaccatggcccgtatctccggctacgccaccgaccacggcttcgaccgcatcccggagctcaagaaccttgacatgtcctccaccggcgctgtctcctccgccgctgtggacctggccgacaagctcaacgccaaggccatcgttgcttacacccagaccggtgccaccgtgcaccgcgtctcccgtgagcgtccggccgccccgatctacggcctgaccagcaacgagcacacctaccactggctggctctgtcctggggcaccgaagccttcctgctcaaggaggactaccacgacaagtcccgcaaggatctcatggtctacacggacaaggtcctcaaggatgctggcaaggttgctgacggcgacaagatcgtcatcctgagctctgctcagggcgatcaccagccgggccgcactgactccatctacgtgcacaccgttggcgcttgcgactgatttcaggcttctggtagctgctgacagctagcatatagcacacgaaagcccccatccaaagtggatgggggctttcgttatctgttatgttgcgattgtgtggtgattgcaatggcccacagtcaccgcggtgatcgagcgtggcgatcagtcgttgagatgatcgagcgtgccgctcttcaggcgcaaaatggcgaccatggtcttggcatccacaatcgtgccattgaccaccatctcataggcatcgtccaccgacaccatacgcacgtcggaacgcggagtctccgggccgatttcctgacgggaagccggggtaagaccggtggcgaagaagattgcggtgtgctgggtggaatagctcggcgtgttcataaaacgggtgaactgcgtaagcttggtggcgtcgaaaccggcctcttcggccagcttgcgcttagctacatcggtcgggcgttcggacgggttgttggcgtgaccggccggaatctccaacgtccaacgatggttggcgatgcgatactgctcgaccagcggaatcatgccatcatcggtgacggccagcacagccacagtgtcgccattgttctcctgaacaaagtagcgttcaaacgaaccgatttgattcgactcataggagacgtgatcgacattgaaataatgcgtctccacaatctgtctacgggaaatctccttgaccggagaggggcgccagggatcgaactgacggtaagtttcgttgctcataagccctcctaacaaaagcgatacatcgaaactacagcccattgtaagcggtgaaaccacgcaggagaacgggcaacacacgggtgcgccgtccgcgatatcgacgtgtttcgcctgtttcaccggggggaatggaggattggcgcgtgtcttgtgtcgcaagagtcgaattggtatgctactctcttcagagtgctttggcacgccctcgtatcccaattggtagaggaagcagcctcaaaatctgcgcagtgtgggttcgagtcccaccgagggcactttagttaggagttcgctgaaattattgtgaaccccattgttgggtaattcaagaaagaggttggcatggctgcaaggaagaagtccgaagaaccgagtatcaacatcgatgaggtgctgaccgacgaagagctcaaggccgtggccaatgaaagcgaacctgctgagcgcaaggccaagcccgaggacggtccgcgtaccgttgtcgtggccgaggacgaagccgtgaaccgcatggatctggtcgccatgctggaagacaacggttatgaggtcgttggtcaggccgccaacggcgaggaagccgtggaactgacccgcaagtaccgccctgatgtggtgtgcatggatgtcaagatgccgcgtatggacggcatcaccgctgccggcattatctgcgatgaaaacatcgcccccgtcgtcatgctcaccgcattctcccagaccgatctggtgaagaaggccaccggcgctggcgccatggcatacgtcaccaagccgtacgaggaatccaagctgctgccgaccctcgaggtggccatgggccgtttcgccgagatcaacgatttgctggacagcgtggagcgcagcgaacgtaagctcaaggaaaccaccgatcagctcaaggaaaccgaagagaagctcaagaaggccgaagacacgcttgaggagcgcaagctcgtcgaccgcgccaagggtctgctgatggacaaggcggacttctccgagcagggtgccttccgttggattcagaagacctccatggaccagcgcatccccaagaagcgcctggctcaggccatcatcgccaagtacggcgatccgaagccttctgattcgggcgaacgctgattatcggcgtcgccgtactgagtcgtaaagcaacacaaacacactatgggagaggccagcgtgaccgtacccaccaatgaaacattgctggtggtggacggccactcgctggccttccgtgcatttttcgccctgccggtcgacaacttcagcacctccagcggccaggccaccaacgccgtctggggttttgccaccatgctcgcgcaggtgatcgatgcggagaagcccgaccatctgggcgtcgccttcgatgtgaagggcggcacattccgcaatgagatgcttccgcaatacaaaggcacccgtgaggcggctcccgaagagctgctcacccagctgccattgattcaacgcatgctcacggccctcggcgtcacctacatcgagaagccgggattcgaaggcgacgacgtgatcgccaccctcgccaccatgggagacaaggccggttaccacacactggtattgtccggtgaccgagacgctttccagctggtggatgacaacgtcaccgtgttgtacccgggccatcacttcaaagacctgaagcatatgacgccgcagtccatcatcgacaaatacaaagtcactcccgtacaatatccggatctggcggcactccgaggcgaaaccgccgacaatattcccggtgtgcccggcgtaggcgacggctttgcggccaagtggatcaaccaattcggttccctcgacggcatttgcgagcacgccgatgaaatcggcggcaaaaaaggcgaatcactgcgggccaatatcgaccaggtcaaactcaatcgcaaagtcaacgcactggtacgagacgtcgatctaggcgtcgatatcgaggatctgacattcggcaccgtggacgtggcacagatcgacgccctgttcaaggagcttgaattcggacctcgcaccaagagtcgtgtactgaaaaccttcaataccggggccaaggcatccaacacatccggagctggcgagtctacgaataatgagcagaacgagcaggatagcagcctcgatctgaacctgccggaacccacgagcatcactgctccggagcagttcgacgaatgggtcaaggcccatcgcgtcgaagtcaaggttcccggtgaaatcgccgatttcacggtttccgactatggcgatggctcgcagcggcatgccatctgcggcgacgcggtcggccacgcttggaccgtggccgcatggggcgacgaaaggccgggtcgtgccacggcacaagccattgccgtggccacggcaacatcagcggccatagtgccccttccaatcaccgataccctgcgagcacagcttgcgcggttcctgaaaagcgaacactcccgcaccatcgtgcatgggtataaagaattgctgcatcttttgggcgcggtcgatcttgacatggacctgccgatgttcgacaccaagcttgccgggtatctggcccaaccggatttccatgccgatagcctcaaacaggcggccgagcacttcctcgacatccacttcaccgaaaccgaacagccttcgcaaggcacattggacttcgacgacgatcaggtcgaagaagatccgaacgaacatcgtctgcgcgatttggccattatccgcagcctcgccgtcacgctcgggccgattatcgacgagcgtgaacaatgctggctgatgcgcgcgattgaacttcctgtttcccgcgtgctgcacggcatggagcgcacaggagccaaagtcgatagcgttcgactcgtttccatgcgtgaccagtttgccgccgaggctcgccaagcgcaggaaatggcttgggagtatgccggcaccgaaatcaacctgcaaagccccaagcagctgcagaaggtgctgttcgaagatatgggtttgaaacccaccaaacgcaccaagtccggctcatacaccacgaatgcggccgcattgcaggatctgtatgtcaagtcagtggacaatgagcgggccaacggtttcctcggagcgttgctgcgccatcgcgagatcaacaagctcaagcagatcgtccaaacgctgatcgatgccaccaacacatcagatgagcgcatccacaccactttcgagcaaaccgttgccgccaccggccgattgagctccgtggacccgaacctgcagaacatccccaatcggaacgccgccggccgcgagattcgtggcgtgttcgtgccgggggaggggtacgaggccctgatgagctgcgattactcacaggtcgagctgcgcattatggctgatctgtccgatgatgaggcgctgatcgaagcgttccgctccggagccgacttccacaaatacgtggcctcgatggtctacaagctgccggtcgaccagatcaccggcgaccagcgcagccacgtaaaagccatgagctacggattggcctatggcctgagcacgtatggtcttgcccagcaactcaagatcgcgccacgtgaagcggaagcgttgaaaaaccggtatttcgataccttcggcaaggtgcacgattaccttgaatcgctggtggccaatgcccgagagaaagggtatacggaaaccattttcggacggcgtcgctacttcccggccctgcattcgaccaatcgtgttgcgcgtgaggccgccgaacgcgcggcactcaacgcaccgattcagggatccgccgccgacatcatgaagattgcgatgattcgcgccgaacagaccttggccgaggctcacgtcaagagccgtatcattctgcagattcacgatgaactggtagtggaaatcgcgccgggagaaggcgaccaggtcaccgaactggtgcgcaacgccatggagcacgccgtcgaccttgccgtgccgctggacgtatcgtgcggcatcggttccgactggcaactcgctgcacactgacaatttctagctcccctcgggtgagggggctgagccgttgagcaaacagtccagtggattgtttgtaggcgaaggcgagccgatagtcgagcaatgaagagcacgagcatggcttgtccgcaattgcagaatgagtcccttgccgcaatagcccactacaatgggacatatgccgaatctcaagcaagtcatcgacgttctcgagaccctgtacccattgcgctacgccgaagaatgggatgagccgggcctcattgtcggagatctgagccacgacgtgcaccgcatcgtgttcgccgccgacccgacctccgccatcattgacaaggccatcgctactggcgcggacctgctcatcacccatcacccgttgttcttccgttccgtacacgagacgagcggactcggtttccggggcgacatcgtccgcagactctaccagcacggctgcgggctgtgggtagggcacactaatgccgacgctgcgtatcgcggcgtgggacaggcggcggccgactacttcggactcatcgaccagaaaccactcgtgccgattgacgatgcaaacgcctctcatccggtcggcttggggcgtgtgggtcgtttgccgaagcctgttgccctgaaggatttcgctcagcgtgtattcgacgaagtgtccgatcatggcatgaccaccgcgctcggcatccaggtatgcggcgattcggacacttttgttcagtatgtggccattctgcctggctccggggactccctgttcaacgaggtgcgtgccaccggtgcggacgtgtacgtaaccagcgatttgcgtcaccacccggtgaccgacgccatcgaacaagcccggtatgaagcccgtatgaggtcccaaggcatcatgctcggccatggaatggcgggggagagccatgtgcgtccctgcttcatcaacacccctcatgccgccatcgaatccatgtggttcaactacgcgatcgatgacgtgccagccgccatcgaacaagcgaccggagcaaggcctgaagtcgagtggttccacgacacgaccgatccatggacgctgtccattaccgcgcatcgagattaagacgctatagtaacgtggcaaaaacgttttttccgaggagatgacatgtttggcggaagcaagcaggaacaactggagcatcggctcgaccataagctgaacgcctcctcggacggcatcgacatggacgtgcccgccaaagtgatcagtagcgaaaccgtttataccgggcgtatcttccatgtggacgacatgcgcatcgctctgaccgacaagcagggcaaggaacacgagatcggccgccaggtgctgcgtcacgccccctgtgtggtcatgctcgtgcacgacatgtccaccgaccgctacctcatcgaacgcgaataccgcgccggatcggacatgttcgcctacgggcttcccgccggactgatggacgagggcgaggacatcatggacgcggccctgagggaactggccgaggaaaccggcgtggtgccggaccgtgacaccatgggcgttgacttcgtaggtgatttctactcgtccgaaggcatgaccgacgaactggcccacatcatggtgttgcatttgggcccgttcaggcgggagcagcgccatttcgatgcggacgagcatgtggaatccgcgtggattccgtggagcgaccttgccgccacgcgcatcacctcatccaattcgatgatcgccatccagcatgaggcgttacgcagactcatcgccaggaactccgacaaagataagccgtcgctgttctcctgacgttcaactccccggcacatcactgacacaaaaaaagtgggatactgaaaactatgcagatcagacctggatcaatgtatccgctgggcgccagctatgacggcgccggtgtgaacttcgcgctgtactcacaggttgcgcagaaagtcgaactatgcctgttcgacgagcacgatgtggaaacacgcatcgaaatgaccgaacggaactcgtacgtatggcataactacattcccggcctccatcctggccagcgttacggctaccgcgtctacggtccctatgacccggtgcacggcctcagatgcaaccccaacaaactgctgcttgacccgtatgccaaggccattgaaggtaatatcgacggcgacgaaagcctgttctcatactggttcaagagcccggacgacaactcggcgatgaacgaccttgactcggccgcccacaccatgaagtcggccgtcatcaacccctacttcgattggggcaacgaccagcatccgtacatctcgtaccacgattcggtgatctacgaggcgcacgtgcgcggcatgaccaacctcaacatggacgtgccgccggacatccgcggcacctacgccggcctggcctatccgagcgtcatcgaatacctgaagaagctcggcatcaccgccatcgaactcatgccgatccaccagttcgtcaacgactccttcctgcaggagaagggcctgtcgaactactggggctacaacaccatcggcttcttcgcgccgcacaacgcctactcctcctccggggaacgcggcgagcaggtcaacgaattcaagtccatggtcaaggcctaccatcgcgccggcatggaagtcatcctcgacgtggtgtacaaccacaccgccgaaggcaaccatatgggccccaccctgagcttcaagggcatcgacaacgcctcctactaccgactggtggaaggcgaccagcagcactacttcgacaccaccggcactggcaactcgctgctcatgcgctcgccgcacgcgctgcagttgattaccgattcgctgcgctactgggttactgaaatgcacgtcgacggcttccgcttcgatctggccgccacgctggcacgccagttccaggaggtcgacaagctgtccgcgttcttcgacatcgtggagcaggacccgatcatctcgcgcgtcaagctcatcgccgaaccgtgggatctgggctccggcggctatcaggtgggcggcttcccgtccagctggtccgaatggaatggccgctaccgcgacaccgtgcgcgacttctggcgctcgcagccctccacgttgcccgaattcgcctcgcgcttgatgggcagctccgacctgtatcaggtcaacggccgccgaccggtggcgtccgtgaacttcatcaccgcgcatgatggtttcacaatgaacgacctggtcagctacaacgaaaagcacaacgaagccaatggcgagggcaatcgcgacggcgagagcaacaatcgctcttggaattgcggcgttgaaggcccgaccaatattccggacgtcaacgacttgcgtcagcgtcagatgcgcaacatgttcgccacgttgctgttcagccagggtatcccgatgatttgcggtggcgacgaagtggcccgcacccagcagggcaacaacaacgcctactgtcaggacaacgagatctcctggaccaactggcatcttgacaaaggacgcaaggaactgctcgccttcgtttccaaactcattcatctgcgtttggatcatccggtgttgcaccgccgtcgcttcttcaccggccgtgagcccggcgacgattcgaacacgattccgcaggtcgaatggttcgaccacaccggctcgatcatggatatggacgactggcagaacacgcatgcgttctccatgatgatctatctgaacggttcggatatcccggaggtcgactggtacggcaaccggatggtcgacaatgacttcatcctgatcttcaacgcgcattacgagccgattatgttcaccctgccggatgagcgatacggccgcaaatggcagctggtcgtggatacgcacaacccgaatgagccggcgctgagctatgaggcgggcttcatgatcaccgcccagtcccgcagcttcctcatgctcatgagcgccaaaaagcccaagaagcccatgggcctataaccagaccgaatttaagctccctctgacgagggagctcccggtgtagccgggtgagggagagaccgcagcaaagccgcgaacccctactcgcgccccttacgctcctccacgagccgagcatcgacatgattcggctgatcagcacccgttttgaggtgccgatggcggaatcctgccatatcagcgtcgaacaggccgaggactgcatgtcggcgctgctgccaaacctcaagcggtggcggcgtcaggacgagatcgatgcggtggcagaggggaaatgagcgatggcattcgactataaaaaggaatataaggacctgtatcagccgaagaggatgcccgccatcgtcacggtgccggcgatgcggttcgtcgcggtggacggtgtaggagatccgaacgaagaaggcggcgattacgccaaggcgatgcaactgctttacggcatttcgttcaccgtcaaaatgagcaagaagtcaaagaacccggccgagcacattgacgggtacttcgactacaccgtgcctccgctggagggcttatggagcatgggggagggtgtgtccggcgtcgattacgcgcacaaagccgacttctattggacttcgatgattcgtctgccggaattcgtgaccgatgaggtctttgcgtgggccaaggcatcgtttgcctccaagcatcccgaagtcgacatcaatcgtgcatatctcttcgatttcgatgaaggcgtggtcgcgcaggtcatgcacaagggcccgtacgacgacgagcccgcaaccgtggcgattctggacggctacgcgcgttcgcaaggctacgggctcgacttctccgacgcccgccgccatcacgagatctacctatccgatccgcgccgagcaaaaccggaaaatctcaaaaccgtcatccgtcatccggtagtgaaggtgggttgactttcggcgaactgctcgaagcgctcaccgcgcagtagcgtgaacaatctgccggaatccttaccggggtcaaagagcgctaccaagaactcgataagcaaaataactagaagcactggttcctctcggagagattctgcccgagcgaccttataaatccttgcgcgggtcatctttcccggtgcaggaagcatccaggctcatgtgcattgatgacgccgatggattgcagataggcgtagacgatggtggtgccgatgaatcgcatgccgtacgtcttgagatccgctgcgatggcgtcggacagaggggatgtagtcatgcctgtctcgtagatgacgtgacggccggtgaaccgccaaatatagtcgtcgaaactgccgtacgacgtctggatatcccggaatgcgttggcattaccgaccgtcgcgacgattttgcgacggttgcggatgatgcccggatcgttcatgagttcggcgatcttgttctcgtcatagcgccggatccgttcgatgtcgaacccctcgaacgcctgacggaaacgttcgcgtttgttcagtaccgtctcccatgacagtccggcctgaaaggtttcgagcaccagcatttcaaagagatgatggtcatcgtgcgaaggaactgaccactcagcatcgtgataggcaacatagacgggattgctgaggttgcaccagccgcaacgtggtcttatatcgtccatgtgctctccctatgggtcgttggagacggtcggttttagatgttgattcgatgtgtgatccagtataaacggtgtgttcggatagcggtctggatgtgcggattgtctgaaccatatttgccggattgcgggtataaaggggttagttactgcggttgcgggtatttcggtactagttaggggtgattctgggctgtaactcgacaccttttacctgcaacccactcccgcccacgggattgcacaatcggttgcaggtattttggtgtcatttgagattgggaagcggaaatcgatgtcgcatggaatcgaactgactagcaggtggggtcccaacatcacaaaagtcccttagaccgcaaggccatataggttctacggtcatcagataaaatcggataaatcgtttagcagccggataaaagaagaagcccagaatcgttgagattccaggcttttttgtttgtcgggctagcgggatttgaaccggcgacatcctgttttcgcagggtgtttctttgttgggttgaatagctttcgttgagtccaatatcgttggaaaatggcggttcttgatttttggctgtctttgttgagccgactgggattggctcaccgtgatggtcattgttactggttttttactggaatcgaccatcacgatggcagtggcgctcggcgtgtcgaaacaatgtctcgaacttgaatcacagcgggtaaaaatcgtcaacgcaagacagttgcaacgacttagaagctacgctcagaaatcccctaacaggtccttccagatcatgcccgtcgttcggcttcaggccaagccgattcaccttctcgcgcaacttatcgagtagtacgggtcgccgagctcttccagagtgggagtatcgttggtcagcttgataagctcttcggcatcctctggccaaagcatgcgtgcatccataaaacccttcaaggcagaatgcattctctgggtccaagtttggatcgtcgggatcaagataattggggacagataggtcgtttatatcgttttccttactggacatatagttgattcagtgacgctcaagacggaactatctagcccaactcctgcgtaagagttccttcggggaaaagtatgtcttcaggaagcacacgaccccctatgccgaagactctccacccctgctcttgagaaaaagtcaaggtaaccgctgcggccgcattaattgtcattcctctgccttcggctttcttgccctgaagcgattcatcggcgacaagtaaaatgaccgcaacatgaggagctggaaagcgagcattggaagtcggcacacagttcccgtaatcgcgcttgagttcatcccaatccaccttttcccagccagttgcctggggagaaatcaatgctcgcatagcttctccattcggatccttgttaagcgtgttaagaaacattaggcaaacagccatggaattgaacggagtgaagtcttctccttttacaggtaactcatcatcttgctggtctacccaatgaggtttttccttactgcaatcccttaacttcccatcaatattgcgttcccataccctaccgttgggatcgacaaaggtgcaagcgacttgcggcgtatccatatgccgatagccaagcatcggaatcgtgatgtcgaattgcaactctcgatgggctggaagaacccgtattatgtcaggtgccgagagcggcccaagccagtgcttcccattgtcaagcgttgtattcacctcaacgtcatagaccggttcgtcgctttcattgtttacgtgaataatgactttgcggacgtaagcagtaccatctgcattcggtttgctgtcttctgagatccaggaagacaccatcttggctacagcccagcgcttctctctggtctccttaagattcaggccgaataaggcaacggtggtagcacctatagtgccaatcgcttccaagcaagtccagaagtcccattgccaattaaaagaaatgagcaagtgcttgacggagatgattcccgtgcacatcagaatagcaaagacgccaatgcacatgagtgcggcagccacaagaattccaacgacagtaaggcatacggttaaagcgattgacttgcggcgattcttatcttccatctctgtgccttacttgaagcgtgtatacttatgcccctgctgatgcactatactcgcagagctagaggcgaagtcacgcactatcaacgcagggttgtagattgacgtcggaaaccgattaaacagtcccatagagtagaaggatgaacatgccagaccagcagcaagaacaaacatggaagcccactgtgccacccagccatgttgatccagagaatcaggtgcatatcgtgcagcattccatggatccgagtcattttcacaccgcgtaaggcatttcggcatgtccaagaatatggcatcatccgactcggcggaggaaccgaatcctgaagataccgatcagccaagagacgaggcggaagtcattacatctctggagtatgtgctagctgaggccaatcgccaacaggattatcgtcgtcatcaagtcgatacatctgtgcagctcagcatgcaactgataggatttgcctcccttacctctccattcaccgctctggcggcagtacacgtagagtgcttaaagtacgttgcgctgtttttcttgttcggtgctgtggcaatcggtttgattgatatattcaatccatctcgaagcgaagacgaacttcctctcaggaagttgcgtgatgaagcctgtataaagagcatgcagtctgtgcttctctatcaaatcgacaataaagtggaaaacgagaaaagggcgcgcgccgacgaagataagcgcatacattgggtcaagtgcggatacatgcttctagctatggcagtgctgtgcactgtgctctccgtcatcgattacgattcagccgctaactggattcagcaagcactttgattagcttccatacagagaagtacatgtcactgtgcgtcaaagcgataacgagaccacattttgatatgaactgattcttgttccgcatttcccctaacttgatgggagatgatggaaccatggcaaagggcacgagatatacgccggagttcaaggcgaaggccgtcaggctgctgacggagtccaggccgtcgtattcgtcggagacgaaggcgatcgaacaggtctccaaggatctggggatagagccggaatcgctcaggcggtggcgcaaccagtcggacgcgacggccgccgcggagacggaacgggccgcgcgggatgcgatggcggagctcaaacagctgcgggcggagaacgcggagctgcgccgggcgaacgagattctgacgacggcttcggcttttttcgcagcacggctcgacccgacacggcgttgaaggccgcgtacatcgacgaacacaaagggcgtttcggggtcgggccgatctgcagggtcctgggcaaatcgctggattgcgggttcctcacgccgcgcggctaccgcatgttcaggaaccggccgccaagccggatgtcgcccgccacgaggctttggcgcgcgacatcctcgagatccattcggatttcctcatggccgtgtacgggtacaggaaggtccacgcccagttgttggcgcagggctgggatccggccgaggtcggccgcgaccaggtgatgaacatcatgcgcgggctcggcatacggggcgtcaggcgtggaaagacgcccgtcgccaccaagcccgcgaagggcacggacggcaggcccgacctgatggaccgcaagttcgaggccggggcgccgaaccggccgcacgtggccacatcacctacgtgcgcatggccgacgggcgcttcgcgtataccgcattcgtcaccgacgtgttcgtcaggcggatcgtgggctgggcgtgcgtcaccaccatgaacacggaggagctgcccctgcaggcgttggagcaggcgatcgcctgggccgcgtcgcatggcgggaccgacggtctcgtccgccacggcgattaagccgggtttgttgttaagccggggaacggttcggggtcttggtggctggccgtgtcccatgtggtttcccggcttaacgttccgggttatttgagggtgtgtagttgtcggagtcgttgctcgctgagccatgtctccttggaggggtcggggccggggttggccgcatcgacggctttgcgcatcatgtcgagggtcgcgaacgcgtagaacgcgctggttgtgctcatgctttcgtggccgagcagttgcatgatgagcggtagcggcacgccctgttggtagaggtccatggcgcgggtccggcggatcaggtggcagtggacgcgttcgggcatggacgggcacgtcccgcggcgtgctctggccgccgcggttttgaggatctcgtcgatccggtccacggagagcggctggatggcgccgttcctcgtcgagtggaacaacggcctgtcgccgtcgcgcatggacggtccgggatggaattcctcgaggtaggcggccaggtgggttcgtgtcctttctcccaggggcacgacccggctcttgccgcgtttgccggtgagcgtgaccctggccggcttatccatacccacgtccgcgatggtcagtgcggcgagttcgccgatcctggcggcggtgtcgtacatgaggatcaggagcatgcggttcctgcgcgatttggcgtcgccggtgccccatgcggtcagcaacgctttggtgtgctcctccccgaggtggtcgacgggtttgcgcgcgggtggtttgacacgtatgccggccgcgtcgttgcccagcgcggtcaatgccgggtgttcgaggcccgcgtggtcgaggaacacgcgcatcgtcgtcatcctcagcatgatggtgcggtccgagtacccgcgctcggtccgcatccattcgacccaccggcccaggcgcgcccggtcgaaatgcccgaaaccgatgtggctgcgctgcgtgccttccgtggtttcgagccatcggacgtaggattccaggccgatgcggtacgcctcgacggtcttcggcgagctgccccgcaccttgggcagccagtggtgcagccagtcgcgcgcgactcgccagaagtccggttcaccggagctggcggccgttttccttgccttgctcatggttcctccgtttccgggaccacgcgttcggcgtcggcgacgaggtccgcgtatccgtccatgaaatcggggctggcgtgcacgtagtagagggtgctgtcgatgccggcgtgtcccatgtaggccgccagatagggcagcatcgccatcacgtccacgccgtcgcgagtccaccgctcgatgttcgcgaacgcgaaccggtgccggaaatcatagggcctgggccgtttgccggcttgtggccactcgagcccggcccgcgtccagacgcggcggaacaccacgccgggcatgcccggggagaccggattgccggtggaggtgacgaagaacgcgggacggtcgtctccgaagcgttcgcgggaccgttggtcgcattccagcagttcggcggcgacctcgtcgcccacgggcagcctgcggctgcgaccggccttggaatcgaccacgtcgatggaacgggccttgtggtcgacgtgcccgacggcgagtctcctgacctctcgggtgcgcagcccgcagcaggccatgagcatgaagaacgcgcgagactgccacgcccacggcgacggagactccaacgttcccgcggcccgcaggaacagggcggcctcgcggtccgtcagcaggtacggcgtcggacgcggggatccggccttccactggtcggagagcacgtacgcgtcgggatcgtgggccagtcgcatccacctgccgaagtccctgatgtacgagaaccacgagcggcaacccccgggattcgcgtcgatcctatgggcgatccatcgctccacgacgccccgctccagacgcacggccccgtgttcgaggcaatgccggtcgaacgagcgcaggacccggacgcgggtggcgccatgcctgcccatggacgccttgaagcggatgtactcctccaattcgccggcgagcgggccgacgaatccgtgttccgtgggtctcatgacgatccgccttccggcacgggcagcacgcacgcgagcattcccccgcggtgcgtggccatgtagacgcgtgtggaatcggggtcggcgtggccaagcaccgcgctgatcgtcggcaacggcgtggccgcctccagcatcctcgtcgccgcgttgcgccgcaacagcctggaaccgccccggcgtccgagcccggcgtgccgcatgacacggctgatcgcctcgtacaccgatgaatgaccccgaagcgcgacatggggcgccttgtaccgcacgaacacacggtcgtcgtcggtggcgggcctttcgtccaacagccaggacgccagcctcgcggccagcggtcccgtcatcggcacggtcaacggattgcccgtctttcgctgcaccagacctatgctcatggaatcccaatccacgtcggcgatcctcagaccgatcacatcgcatgccctcagcccgcacgtcagcgacagcagggtgatcgccgcgtccctcgacggcaccgaccgcgaggcgcacgcctccagcaagcggcggtgctcgtcgtcgggcaacgttcccgcgatcgcgtgggtcctgcgtatgccggtcaggccgatcgcgtccgccaggtcatcccgcccgagccatctgaacaacgggcgcaggtccgacgcggcgtgccgcatcgacgactccgaccagcgtgaacgcagcccggccaggaaccccagcacatgcgagccatccgaaccatccaacgacacgaccccatgagattccagccacgtgaggaacaagcccgccatccgacggtaatgccccaccgtcgccgaagccagtcccgaaccggcgagatacgcctcccaacgctccatgaccacggccaaacccggaaccaccggctccgcaagcctgctcctgcgccacttgcccaggtccaccgaaccggaccgcagatacgagtcgcacaaacgcgccagcctgccgtaatcgaaccaccgctgcctgctgaaaccgcccgtccgctcactgaaggtcgacgcggcgaaccccgcgcccaacccacgcgtgtacaccgcatccgggcctccggcgtaccgttccaacgccctgatggacttgcggtactggcctatggtggattccatataaccggccccgtaaagcgcgcggaccacctcgcccgcgacatggccaaccgtcgtctcacccatggcaaactccttcgttcgaatcaaatgggacaagacgaacataacccggaacgttaagccgggaaaccacatgggacacggccagccaccaagaccccgaaccgttccccggcttaacaacaaacccggcttaatccgagtggatgatcggcgtctcgccgggcctgggcgtggcgcacgcgtcgcgaagcatgccgttggccagggcggcgttggggctcgtgccgatcgtccaggcgacgggcatgccgtcgtggcagtcgatgaccggcgacaggtacaccttgcccgccgggatcgagaactcggtgatgtccgtgacccacagccggttcggcgcggtggcgtggaagtcgcggttcacgagattcgcgggcgcgccgccgatctcgcccttgtacgaactgtagcgcttcgcgctcttgagcacggggaccatgccgtggctggtcatcaggcgcatgatgcgcttggccgacacgatgatgcccgcgcttttgagctcgaggtggatgcgcttgtacccgtaacgcctcctgctgctcccgaacgcctcgcgcaccagggacaggaggttcgcgttcttgtccggccggcgcatggccttcaactggtagtagtacgtgctgcgcgcgatgccgacctccttcagcaggctctccgcgttcacgcccaacgtctcactgatgtccttgatcagggtcgtcttctctcggcttgtcaggttgtccgggtctgcgcccggctcttttcccaccagttccgccgcacccttcatgatcgccaaccggatctccatggcccgctgttcggcgcgcagacgctcgaggtcggcgcgcaacgtggcgatctcgccgcgcagcgcgtccggattgtcctgctgcgaggaatccccgcgttccggttccctcttcgtcaccatgagtcctttcgcgtctccgagcagttgacgcttccagtttcgcacgaccgacgaatccacacccaccgcctccgcggcctcgcgcgaactcaattcgccggacgcgaccttcaggaccgcatcccgtttcaattccccgggaaccgggccacggcgaatccggcgttcgcccggcgcgagctcgtcgatccacgaggcaagcacctctttgctcggataccccatctgacgcatcgtgcggctcgcacgccgcccatgcgtcagataatggtccacggccgcacgcttctgctcctccgtgtagcgcgcataccgttcaccacgctgcgaggacacgcccgtcccctgttcgtcgagccagtcccggtgccacatgcgcaacgcctcccggctgggataccccagctcgcggatcacatccgccgcgcagccctcgtatttcacatacaactcgaccgcgcgttgccgctgttccctcgtgtacttcgccatggccgtctcctcctcggatcacagtccaagaaaacggcaccacccccaacacgaaacaccgacttgactaaatacacgaacggaacgtccggttccgcatcgcgccgatcacggccatggtcgcgtgccacaccgtgttctccacgctggccttgtccctgggccttttcaccctgccgggcagcaccgccgccgagtaatgatccgccaacgcccggtatcgttcgtccggcacgatctcgccctcacgcggatgggcggtcacgccggtcttgaggttgtcgggcaccagccgcggcgtggagccgcccagccactcgtacatcgccacatggcagcgcagccacgtcgtctcccccatatccagcgcaggctccacgaatgcgtaccggccgaacggcaggcacgccacgaacaggtaggcggtcgcgctctccccggtcaccggatccacgatctccaatgtcggcccggcccagtccacctcgatcgtcgaaccggccttgcgctccaccctcgacgtgacgccgttggccaccacatacgactgatacagcttgcagaaacggtcgcagcccatcgacggcgacccgtcggacaggcaggaatcccggtactcggcatgcagcagcctcaacgtgacgccggtcttcgccagctcgcggtgcacggcctcccaatccggctgccggcacgcgcttgcgtgctcgttgcgtcccgggaacagcagcgcgcacacctcgtcgtcgctcttcgacgcgatgtccgcatacgagacgccggcatcggccgccgccccgagcgtctccgctacgctcgaacgcgatatgccgagcgaacccgctatggctctgcccgacacggattgcgaatgccgcttcagtatctgcttcgccttgattttccgtaccatgataggcaactcctttcaccacacgtccctcgcatggtgaaaggagcctaaccaccaacggcctccgacggcaatatcctcggccccgaaccgcaataaccgaccaactccagcaatggccctgaaccccaataacaccggccctcaaaaaatcaaatattcacttgccgataacgtaccagacgttattgcggaggtgggtgaagattgggatgtgtgaggacctgtatattatgccaatagcttaacggtcatattagcggttgcaccgatttctccctctaggaggcctctggcttcaggattgccaacaatttcaggcgaatggcatcgcgacgtgcctcgatgaaaggtttgaaattcgctaagtcgagattggtatttgctggaacataaaaacttacagcggattttcctgttcgttttgcccattctgccagtggcgtatctcccttgctttcgttttgacttccttccaacagttggaggttggggagcgtattccaattctttctgtcttcagcgaatgctcgatcctctggatttgggaatgccgattgcatggtttcttcgaacctcagcaatttatcgcttccttcttgaggccggatgaatatattttttggatataaatgatccttatggtattgaaccgctgggttgtgtactccttgcagcagggagagcacgtaccaaacgtttgcatcctcatattccagtccgagaaaatcttcaatgttctcttcagtgatagtgatgtccttacgggtattcttgaatttggttcgtatctcctcataggggaaatgttcggtggtgctgttttccttgatgatggtccggagagagtttagcaacggattggtctgtcctccgaaaacgccgcataagaagctggcatttagccagagaatgatgtcatcggcaaccttatgctcggtactgtgaacatcttctgcaaatagtgtgctgccgcatcgtttgtacaaaccagtttgcaagaaatattgaattagcgggatagctgcattttttgctcggaatgtgacatcatcaaaaccttgattatgaaggaatcggaatgtctccccgatcgcattggatagcttatcccagtgattttgcagcagtttgaccttgtctgaatcgaagttgttgattctgaatcttacatccgatgcatagctagcgaggaacgagcgcagaatgatgtcattcccgatacgaaaacccgtgtccttgaacacatcgtccgagagtatttttgttttctggcgcatgtcgggccacatggaggttgttattgccatgattagatcagctttggtcagaggtattccgccgctgtttgtcctagtaaagatgtcgaggactttgttctgatcttgttccacctgaagatagtacgtgatgagtttcttctctatgaactgactgcgcaggtctgtaagtcgttggaaagcccttttgtagccagataaattatgttgttcccagtagttgaatatgtcgtcagtactgataagagtgaggatatcacccgccggcatccaatactctgtcttgttttcgttgaatccgtccttattgtcggaaaccttaaagaacctgaatgggtatttgagattgtcgtcattctcgggtctatcgtttagcaaatctatatacagttgttgcttaggcgtggatgtctcattatctgcccatcgcttgcttttaacatgtgcgccatatgttccaaagaatccgatgtataggcttgtaagcctctgctggccatcgatgactgcatatttatcctcgagtaatgggcgtgtcatcggaggattttccgtactgaatcgttctttatagtttcggaggaattcgaagaaaggataattacgctttatatcagggtctgtaattttccaaagcatgagagtattgattggatagccttgcataatgctatcgaataatgcttcgatgcgagggatatcccacgtaaatttacgctgaattccgggtagtacatattcggcattttgaatgtgaatcattgcttcgcgaatactgatgggtttttgataatcgttgtcctgttgtatttcattagccatggacatcgcctcctgatttcatttcatcataccctaaattgtgggtagtgtttcttgatgttgtgtggaagatgaattccgctacggagcggaattcattcgggacgtgggtcgttgctcggtggctctttcttcacacacgaatgttgcttataacgtctagcttttgccaatcgcaggaactgcgacgagaatccgtgactccggagcgagaatttgacggcggccgtgtgctggtccccattgcaatacgtccggtggtacttcaacataacgagtagtttctctgcgattcagtatgaatcgtcggttgctttcatctcttctcgcaaaatctttgtagcattttgtcattcgggctactgagtctcgattcacttcgagaatcatgttattaccttcgtaaaaacagactgaccggattgcgttctgttcataccatgtatcgataattcgctgcaacattgatttgcctaatgggatcagcgcgtgtttccagtcgggtaagggaattgtttcgtctgtgcgcaagtggatgactcccgacgtagtggcaggcgctttgtatgttagcgtcaaaggccagcacgcagatgaattgctaaaagtgatgccgatggtgcgtgaagaatcgtggcatttcgttctgctggaccagccgtatcgttccgctaattcataagaccataaggattgcgcacactccataaatctgcgttgcgcggtttgttcgatattgttgccttctgtcttttcgacgcttgtgaagcgtatcctaaatctatcggactcgatttgttcagaatcgatatgcaccttattgcgcactggtttgcacttttcgctgcggacgcaagcgacccagtctccattgcgcagcagcatgtccgctatcgactccacggcatcgagtcgtgcggctgattgagatgcggaatcaaccaccacagataagggtttcgtgtgagtttgtcgattatctggtttcctgactttcatggctaccagcatcatcgaagaacaggatagacggtagatatcttcctgttcttcggcatggagttgttctcgtacacatggtaaaaatcaaaaattggcagtatgcgcagcggctcttccgtagcgttcaatggtcatcatgcatggaaccaagcgagacatactattattgccgtggtctttccatcttggcatatcgcaaacgagtagcttcacccgtgataccgagcttgcgaccaattgtttcccatgattggccacgctcatgcatgagcagtaccatctgcgcaatgcgggcatcaatgtgttccagttcggctttgcgtcgattgattagacggctgagctccagttcgggagagaagtttgggctgtcctcgggaatgccttctgctggtgattcctgagactccacggcatctgccgcagcgttgccgatttccatgagtttggcttgcacttcgggggagtagtcttcaaatttcatcgttatcaccatcctggtattgcatcgtcaaccatttcatttcataggtcagtcgggctcgcatggcgtgcacgatgacatgctcatatgttcccggaatccattcgcgttcaatgacgccgatttcatacaaaatggcaccagacgctccagtcccgacaagcacatgagtgggaggaaaacgaagaacgttgatgtcggcttcgatgccatatcggtagacatggagaatgtccgagtcggcgatgggctgttcgccatgtttccgttccctgtgtgctgagggaagaatcaaaggatcctccccgcttatgggtgcaagtatacttggcaagtccatttgtatcaactcctctgttgaacgtaaaacgtgaatcaagtgtcttgagcgtaaagaaggtagaaagcccttgtccagctgaaacggggtatgtggttctagcttgctgagttatccacaatgttgtgaaagcacggcgatactgcataaaaaatagtgaaaagagaccatgcggagtggctgcatctaattaactggccaaccacgataatcgccggtaaatatttaccgccgcccagaccacacggtatggtggagcgcatggctgattacgggaacaactttgtgcaactgcataaccacacgcactattcgctgctcgatggtgcgtcgaagattcctgatttggccaagcgtgcggccgaacttggcatgcctgcggtcggcatcaccgaccatggcaacatgcatggcgcctacgagatgtacaccaactgcgtggccaatggcgtcaagcccatcatcggcatcgaagcttatgtgaccccggaaaccgcacgtcaagacaagtcccgcgtgcattggggtaccgaagcccagcgccgcgacgacgtctccggtggtggtcttatcacccacttgaccatgtgggccgaaaacgacgaaggcctggtcaacctcatcaaagcctcgtccgtggccaacctcgaaggtcgcgtcatgcgttatccgcgtatggataaggaggtgctcgccacctattccaaaggcgtgatcgcatcctccggctgcccctcgggcatcatccagacccgtctgcgcctcggtcaattcgatgaggccctgcgcgccgccggcgaattccaggacatcttcggcaaagacaacttcttcatcgaactcatggatcacggtctgacaatcgagacccaggtcaccaacgacctgctgaccattgccaagaagctggacgccccgctgctggccaccaacgattcccactacgtacacgccgaagatgcacaggcgcaggacgccatgctctgcatcaactccggttcccgtcttgacgatccggaccgattcaagttcgacggcaccggctactacatcaaaaccgccgaagagatgcgcgaactgttcaaggaccacccggacgcctgcgacaatacgctcgttatcgccgaacgctgcaacgtgatgttcgacgaccacgaagacggcgcgttcatgccgaaattcccttgccccgaaggctgggatgagacctccctgttcctcaaaaaagtcgaggaaggtctggagaagcgttacgacggcaacccgccgctcgacgtattgaagcaggccgactacgaatgtggtgtgatctgccagatgcagttctgcggatacttcctcgtggtcgccgactacattcagtgggccaaggaccacggcattatggtggggccgggccgtggttcggccgcaggcgccatggtcgcctattccatgggcattaccgagctcgatccgctcaagcatggcctgattttcgagaggttcctgaaccctgagcgagtgagccttcctgatatcgatgtcgacttcgaccctgaaggtcgtgcgcgagtcatcgaatactgcggcgaaaaatacggcaccgataaggtcgcccagtgcgtgatctatggcaccatcaaaaccaagcaggccctgaaagactccgcccgcatcatgggttatgaattctcagtcggtgaaaaaatcaccaaggcgctgcctccggcggccaccggcggcaaagacatcagtctgcatgacatcttcgaccctgccgccaaacgttatgccgaggccagggaattccgagaactctacgattccgacccggacaccaagcgcatcaccgaagaagccaagggtatcgaaggcctgatccgacagaccggtgtacatgcctgcgccaccatcatgggtagcgcacccatcaccgacacatcgccgttgctggaacgcaccgatggcaccatcaccaccaccttcgaataccacacgtgcgaaacgttggggctggtcaagatggacttccttggcctgtccaacttgacgatcatccacgacaccctgaagaacatcgaggccaacggcaaacccgccatcgactacaccaagattccgctcgatgacgccgaaacctacaaactcatgtcccgaggagacacgctcggcgtgttccagctcgattccgacggcatgcgttcactgctgaaaaccctgaagcccgataacttcaacgatatttccgcacttatcgccctgtaccgaccgggcccgatgagtatggattcgcacaccaactatgccaagcgcaaaaacggcctgcagaagatcacgccaattcaccctgagcttgaggagcctctgaagcaggtgcttgacgagacctatggtctgatcatctaccaggagcaggtgcagtccgccgcccgaatcctcgccggctattcgctgggcaaggcagacgtgctgcgtcgagccatgggtaagaagaagcccgaagtgctggccaaggagaaggtgccgttcttcgccggtatgaaggagcatggatattccgaagaggcctcccaggccgtgtgggatattctggtgccgttctccggctacgccttcaacaaggcgcactccgccgcatacggtctgatctcctactggaccgcatatctgaagacgcactacccggtcgaattcatggccgccctgttgcaaggtgccgccaccaacaaagacaagaccgcactgtacttgggcgaggcccgccgcatgggcatccaggtgctctcgccggacgtcaacgaatcggtgtacgagtactcggcagtcggcgacgtcgtccgattcggtcttggtgccatccgtaacgtgggtgacaaggccgtggccgatatcatcgccgaacgcgaaggcccgcgcggcaagttcgtgaacttcatggacttcatccgccgcgtgcccctgaccgcgctgaaccggcgattggtcgaatcgttgatcaaggccggtgccttcgactcgattgacccgaaccgtcgcgcgctgctcaccgtgcacgaggccgccatcgattcggtggtgagtctgaagcgcaaacaggcggagggccagttcgatttgttctccgatgccgaggatgggggagcggaggccatgggcgacgcttccgtgaccgtacccgatcttgaggaatgggacaagaagaccaaacttaacttcgaacgcgaaatgttgggcctgtatgtgtctgaccatccgctctccggtatgcagtcgattctcgcgtccttgcgtgaaatgtccatcgcgcatctggttgatcgagccaaaacgatgggtgaaggacagcaggtcacgttggctggtttggtcaccaatgtggaccggcgcgtatccaagaagggcaacccctgggccatcgtgaccatcgaagacatggaaagctccatccaatgcatgttcttcggcaaggtctatgaagcggccgccgctgaacttgccgtggacgccatcgtacagattcgtggccaagtggagttgcgcgacgaaaccgtttctctgagagccacggaaatgcagattccgaccttggaagccgaggatgaacgtccgttggtcatcacgctgccgtcggtggcgttggagcgccaacgcatgatgcaactcggtcaggtgctcgctaatcatcctggttactgcgaagtacatcttgcggtgctggatgagaagggtaacgctcaggtgctcacgtttggcgatcgtttccgcgtcaagcgagatacttcgttgtttgctgagatcaagattctgtttggccccagctgcttgcctgccgcctgattggcgggtttcgcccctggcctctccctcacctggctttgctggggctccttcatcagagggagctaaggcgtgtgccaccatacgatgtgcgcgactactgtggaacgtatgggcatggagatagcggatactggtaacaacgatgacgagcaacaatggattgccacgatgctggaacggctgtctcattcgcagttccgcgccaaattcgctttgaccgacaaagaccgagcctatgcccgcaccaaaggcaaggcgaccatcgatcgtcatgcgcgagaaatgttgcgagaccgcataggcgcagccgaaccgaagaacgacggcagacagacgccatggcgcggccatccggtattcaccgctcagcatgctaccgccacatgctgccgcggatgcatcgaaaaatggcatcatctgcccaaaggccgtgaactcgccgaagcggaggtaaaccgacttgccgatttggtcatggcgtggattgaacgggaccttatcaatcatccggttcggtgaagcaccccgcatcctcagtatgcctgtatgccttcaatagttatgggccaacagccaacataggcctcgaaaaccgtagatgcaaggtattggcgaatgcggcagaacgccgaacgttgcctatagcgcgttcgtcaataatgcgacatgatgtctattcaagaagagttgatgaagtgtcaactctgccccaaggaggcggaatatgtactacagcagcggcaattatgaggctttcgcacgtccgaagaagccggccgacgtggacaacaagcatgcatacatcatcggtaccggactggcggcattgtctgcagcctgttatctggtgcgtgatggtcagatgcctggcgagaacatccacatccttgagaaggacccggtacccggcggcgcctgtgacggtcttgatattcccggccttggctatgtgatgcgtggcggccgcgaaatggacaatcatttcgaggtcatgtgggatctgttccgctcgattccctccatcgaaaccgaaggcgtcagcgtactcgacgagtactactggctcaacaaggaggacccgaactactcgctgtgccgcgccaccaagaatctcggcaaggacgcggggctcaagggcaagttcgggctgtccgacaaggcttcgatggaaatcatgaagctgttcttcaccccggacgaagacctgtatgacaagccgatcaccgatttcttcgatgatgaggtgctgaactccaacttctggctgtactggcgcaccatgttcgccttcgaaaactggcactccgcgttggaaatgaagctgtacatcaagcgctacattcatcacatcggaggcctgccggacttttccgcgctgcgtttcacccgctacaaccagtacgagtcgatgattctgccgatggtcaagtatctggaatcgcacggcgtcgaattccgctacaacaccaaggtcgagaacgtggaattcgcgattggcgggggagccggccccaagcgcgagcacaccggcgtaggccaagacaccatccagaagattcaggccacctccggcttcttcaagcgcaaccctgccagcacgcccaccaagaagcttgccgtgcgcatcgacgtggaccacgagggtgataaatcctccatcgacctgaccgagaacgatctggtgttcatcaccaacggcggttgcgtggagaactccaccatgggttcccagaactcgcccgccgcatggaacccagacctgaagcccggtggcggctgggatatgtggaagcgtatcgctgaccaggacccgagctttggccatccggagaagttctgctccgatccgaatgccaccaagtggatgagcgccaccgtcaccaccctggacggcgagattccgccgtacatccagaagatctgcaagcgcgacccgttctccggcaaggtcgtcaccggcggcatcgtcaccgtgcaggactccaactggctcatgagttggaccctgaaccgccagcagcagttccgcgaccagcccaaggaccagctgtgcgtatgggtctacggcctgttcccggacaagcccggcaactatgtgaagaagccgatgaccgaatgcaccggtgaagagatttgcgaggagtggctttaccacatgggcgtgccgaccgacaagatcgaggcgctcgcaaagcaccacgccaacaccgtgccggtcatgatgccgtacatcaccgcgttcttcatgccgcgcgcggccggcgaccgcccggacgtggtgcccgatggtgccgtgaacttcgcattccttggccagttcgccgagaccccgcgcgacacgattttcaccaccgaatactcgatgcgcaccggtatggaagctgtctacacgttgctcggcgtggaccgcggcgtgcctgaagtgtggggtagcgtctatgacgtgcgcaacctgctcaacgccaccgtcaaattgcgtgacggtgcaccggtcaccgatatgaagctcaacttcattgaaaaggccgtggtcaagaaggtgctcaagaaactcgacggcaccgatattgccaccctgttacgcgaataccgcgtaatctgacatccatctggctcccctcgactggcacgcgaagcgtgactgggggggagttgctcacaacggagtgttaagagaaagacaaaaacatgactgattctgatccccagttaatccgccacgccaccatcgacgatctggacgcgctggccgccatggaatccgaatgcttcccggccgccgaggccgccgaccgctcgtccctgcgcgcccgaatcgagacctatccggaatgtttctggctattgattgatggcgagatcgtcatggcgttcatcaacggtttcgcgaccgatcggcgcgacttgaccgatgacatgtacgaggatgccgcgcagcacaaccctcaaggtgactggcaaatgattttcggcgtggatactgcgccgaagtatcagcatcgcggttgcgccagtacactcatgaggaaagtcattgaagacactcgtgcagctggacgtaaaggcctggtgctcacctgcaaagatcggctggtcggattctatgcgcaatttgggtatgaggacgagggcatttcggagtccactcacggtgacgtggtctggcatcagatgcgcctgaccttctaatccccctttggctcccctctttgatgctgaggcgtctaaaaaacagtccggtggactgttttttagacgaaggcgagacgatagtcgagccataagggtgcgagctttgctcgtccgtaattgcgggtgagccgtccgcgtgatcggactgaggggagttgaacgtggaataaaatgttgcgacacgccggtgaacatctgatttcgttacgtgagcccataaagagccggcgtatcctgatggtaacggcgtgattcaagctgatttcgacacgccgatggaacgacgtcgtttcaacgattccttgggtttttgcgtgccttgatttgcgtgaatccggacatgcgtgtaagttattcacctgttgccgctcagcgcggcgggttccttcctctggttggtttcccgtctggctggtgtggtggtggtttgagaactcaagagcgtgtttgtactacttctttatagtcaatgattgccagttcattcctcgcctgattgcctgtcgtggtggtcgggtacccgggagggtttgatgaggggtgaggttttttgagggcgtccttccttaaggacgtgctcgtcaatttttgttttgagagtcatctattcggatgcttttcatgaagtttttttgtggagggttcgattctggctcaggatgaacgctggcggcgtgcttaacacatgcaagtcgaacgggatccatcaggctttgcttggtggtgagagtggcgaacgggtgagtaatgcgtgaccgacctgccccatacaccggaatagctcctggaaacgggtggtaatgccggatgctccagttgatcgcatggtcttctgggaaagctttcgcggtatgggatggggtcgcgtcctatcagcttgacggcggggtaacggcccaccgtggcttcgacgggtagccggcctgagagggcgaccggccacattgggactgagatacggcccagactcctacgggaggcagcagtggggaatattgcacaatgggcgcaagcctgatgcagcgacgccgcgtgagggatggaggccttcgggttgtaaacctcttttatcggggagcaagcgagagtgagtttacccgttgaataagcaccggctaactacgtgccagcagccgcggtaatacgtagggtgcaagcgttatccggaattattgggcgtaaagggctcgtaggcggttcgtcgcgtccggtgtgaaagtccatcgcttaacggtggatccgcgccgggtacgggcgggcttgagtgcggtaggggagactggaattcccggtgtaacggtggaatgtgtagatatcgggaagaacaccaatggcgaaggcaggtctctgggccgttactgacgctgaggagcgaaagcgtggggagcgaacaggattagataccctggtagtccacgccgtaaacggtggatgctggatgtggggcccgttccacgggttccgtgtcggagctaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgttcccgacggtcgtagagatacggcttcccttcggggcgggttcacaggtggtgcatggtcgtcgtcagctcgtgtcgtgagatgttgggttaagtcccgcaacgagcgcaaccctcgcctcgtgttgccagcggattgtgccgggaactcacgggggaccgccggggttaactcggaggaaggtggggatgacgtcagatcatcatgccccttacgtccagggcttcacgcatgctacaatggccggtacaacgggatgcgacgcggcgacgcggagcggatccctgaaaaccggtctcagttcggatcgcagtctgcaactcgactgcgtgaaggcggagtcgctagtaatcgcgaatcagcaacgtcgcggtgaatgcgttcccgggccttgtacacaccgcccgtcaagtcatgaaagtgggcagcacccgaagccggtggcctaaccccttgtgggatggagccgtctaaggtgaggctcgtgattgggactaagtcgtaacaaggtagccgtaccggaaggtgcggctggatcacctcctttctacggagaattcagtcggatgttcgtccgacggtgtgcgccccgcgcgtcgcatggtgcgatggcggcggggttgctggtgtggaagacgtcgttggctttgccctgccggtcgtgcggtgggtgccggggtggtatggatgcgcttttgggctcccggatcgccaccccaggctttttgcctggcgcgattcgatgcccgtcgtgcctgggggccggccgtgtgccggcgcgatggcgtggcggtgcgtggtggcttgagaactggatagtggacgcgagcaaaacaagggtttttgaatctttgttttgctgttgatttcgaatcgaactctattgttcgtttcgatcgttttgtgatcatttttagtgtgatgatttgtcgtctgggaatttgctagaggaatcttgcggccatgcactttcgtggtgtgtgttgcttgcaagggcgtatggtggatgccttggcagacaggaccgatgaaggacgtttgaggctgcgatatgcctcggggagccgccaacagggctttgatccgaggatttccgaatgggggaacccaccgaccgtcatgggtcggtaccggcttcggccggggggtacgcagggaagtgaaacatctcagtacctgcaggaaaggatattccgtgagtagtggcgagcgaaagcggatgatggccaaaccttgcgcgtgtgatacccgtcgggggttgcgcgcggggtgttgcgggatcgcgtgcgccggctccgacgggccggccggcagttgcagaaaaccatgtgtcaggggaaccgggttgaataccgggccgcagagggtgagggccccgtacctgaacgcgcatggtctgccgatcgcgtctcccaagtagcacgggtcccgtggaaccccgtgcgaatccgcccagaccgttgggtaagcctgaatattcctgtctgaccgatagcgaacgagtaccgtgagggaaaggtgaaaagtaccccgggaggggagtgaaacagtctctgaaaccgtgcgcctacaatccgtcggagcccttttgtggggtgacggcgtgcctatcgaaaaatgagtctgcgagtcagtggcatgtggcgagcataacccgtgtggggtatgcgtagcgaaggcgagtcttaaaaggcgtttgagtcgcgtgtcctggacccgaagcgggatgatctagccctgagcaggttgaagcgcgggtaagaccgcgtggaggaccgaacccacctgggttgaaaaccggggggatgacttggggctaggggtgaaaggccaatcaaattccgtgatagctggttctctccgaaatgcatttgggtgcagcgtcgggtcattacgtcccgggggtagagctactggatgcttgcgggcccgtatcgggtaccaacagcaaccaaactccgaataccggtgacgcgtatcccggcagtgagtcggcgggggataagcttcgtcgtcgaaagggaaacagcccagaccgtcgtctaaggtcccgaagcgtgtgctaagtgggaaaggatgtggagtcgcatagacagccaggaggttggctcagaagcagccacccttgaaagagtgcgtaacagctcactggtctagtggttccgcgccgacaatgtagcggggctcaagcacaccaccgaagacgcggcagtattttgtactgggtaggagagcgtcccatgaggggcgaagcggccgtgtgaacgcgccgtggacttcatgggagtgagaatgcagacatgagtagcgagagacgggtgaagatcccgtccgctggatgaccaagggttccagggccacgttcatcgtccctgggtgagtcgggtcctaaggcgaggccgacaggcgtagtcgaatggatgaacgggtcgatattcccgtaccggctttcagccgccaaaaccgaggcttggagtactaacctccgggtccgggcttactgctccttcgggggcgggatgccctggcctgttgggaccgatccttgtagtaggtcagcgcaggagtgacgcagaagggtagccggccgcggaggtggtcttccgtggtcaagcacgcagggcgtgggacaggcaaatccgtcccgcatgggtccgaggtgcgatgatgggggccttatggcccgatatccggtgatcccggctgccgagaaaagcttcggcgtcaggctcaaagccgcccgtaccccaaaccgacactggtggtcaggtagagaataccaaagcgatcgagcgaatcctggtcaaggaactcggcaaatcactcccgttccttcggtttaagggagacccccgatggtgaacacacttgctgtgggagcttttgggggtggcacagaccagggggtagcgactgtttaccaaaaacacaggtgcatgcgaaggcgcaagccgctgtatatgcactgacgcctgcccggtgccggaaggttaagaggatccgtcagccttcgggtgaagcggtgaattcaagccccggtaaacggcggtggtaactataaccatcctaaggtagcgaaattccttgtcgggtaagttccgacctgcacgaatggcgtaacgacttccccactgtctcgaccaggagctcggcgaaattgcagtacgagtaaagatgctcgttaagcgcagaaggacgaaaagaccccgggacctttactataccttggtattggcattcggtgtggattgtgtagcataggcgggaggccgagaggcgcggtcgccagatcgcgcggagccgtaaggtgaaataccgctctgttcgcattggatgtctaacctcgaacagtcatcctgttcagggacagtgcctggcgggtagtttaactggggcggttgcctcccaaagagtaacggaggcgcccaaaggtccgctcagcccggttggcaatcgggtggcgagtgcaagtgcacaagcgggcttgactgcgaggacgacggtccgagcagggacgaaagtcgggactagtgatccggtgccggtgtacggacgcggcatcgctcaacggataaaaggtaccccggggataacaggctgatcattcccaagagtccatatcgacgggatggtttggcacctcgatgtcggctcgtcgcatcctgggggctggagcaggtcccaagggttcggctgttcgccgattaaagcggcacgcgagctgggttcagaacgtcgtgagacagtttggtctctatcctctgcgctcgttggaatgctgaggaggcctgcccatagtacgagaggacctgggtggacgaacctctggtatgccggttgtcacgccagtggcacggccggttggctacgttcggaagggataaccgctgaaagcatctaagcgggaagcctgctccaagataagcattccgtggaaccttcgagttcctgtagtccccatgcagaacacgtggtcgataggccggacgtggaagccccgcgaggggtggagccgaccggtactaacggacgaaaggcaacactaacattccaacccctggcggttggaccgcatcttcctcctgcaaacgacaccagacggcaatgagcattgtctggccacaagacgaaacatcgacatatccgcgtccgctgtccggttcccaggccgccacaggccggcagaccccagcgtctgaccgtacaagagaagatttgcggcggccatggctcaggtgagacgcccggtcccattccgaacccggaagctaaggcctggcacggcgatggtactgcacccgacagggtgtgggagagtagcacgccgccgcaccacacgtacaggaagcccctcggagcacacgccccaaggggctttcgcatacccgaaaccaacaagataagacaccgacaagacataggctctcgcacctagggcgtggccgaatcgaaagcatatagaagagagaaccctccaatgacggagagtccccactttgcgtatctggaccgataaaggtctagaaattgaaattgtccggatcagcaccgttgcgcttgccggtgttgatggcggagatggcggtcatatcatcgaccgataggttgaagtcgaagacctcgaagttctgcttgatgcgctcggcatgagtggacttgggcagcacgatgataccgcgctggatgtgccaacgaatcactacctgtgcagcagacttgccgtacttggcaccgatttcggccagtactgggttgctgagtaggttaccgccggtgccgccgagcggactccacgcctcggttgcgatgcccttggcacgaagctggccaataagctcttgattggtgaattgtggggaagactcaacctggtctacagcaggcaccacatcgctatgggtcagtagctcatcgatatgatgcttttggaagttgctgacgccaatggccttggcacggccagaggcataaatctcctgcaagtcgtcccatgcctgctgccagccgtctgctggccagtgaatcagatacagatccacataatccacgcccaagcggtcgaggctttcttggaatgcatccttgccgcggcgtgcgcgaatatcgtcattccacagcttggtggtcaagaagaaatcgctgcgcggcacaccagcacggcgaataccttcacccactgaagcctcgttgtggtaaatcattgcggtatcgatatggcggtagccattctccagagccgtctgcaccgcgttcactgtagtatcaccatccggtgtctggaatacgcccaagcccacctgcgggatgacagtgccgttgttcagcatgattgtcgattgaattgccataatgcctcactagtcgtagtattcgttcaatttcccattctagaaacaagacgatgcaataagccgcgttttgctggcaaagaatgattcttttttcagcgctacgatgaacgatatgactacggaatatgtggctgcatttgatgcggggaccacggcgttgaagggtgccttagttaatgggcagggttgcattgtagctagtgcgagtagcgaacttgaccttattatcaacggcgactatcgggagcagagccccgatcaatggtggcaagctttctgctcggcctccaggcacatgattgagcaggcgcggcaatccgagtcagaattcaatgtgactcgcattcgtggcatcattttcagcggtcagatgcaggatgttattgttttgaacggcgagctcaatcccgtccgcaatgccattctgtattcggatggccgagccgaggaacaggccaagcaactcgccgagacatatcagggcggtgcagaacgtttcctgaacaccgttggtaaccggctcgaaggctgcttgccgttgcccaagttgatgtggctgcgtgaacacgagccggaaacgtacgcgcgcattcgtcatgtattgatcagttccaaggactacttgatcgcccaattaactggcgaatgcgtgggcgatgtggcggcgtgttccacagctggggccatgaatatccgtaatggccagtgggatgccgaattatgcgaggtcgcagaaatcgacatgaccatattgccacacctgcacaatccgcaagacaacattggcacagtgacggaatccgctgcacaacgcaccggtttttccgccggaactgcggtatacgcgggcattggagacgcgggtgccaccacacttgccagcggtgtcagccaccctggtcaatacaacatcaatatcggcacctcaggctggatcgccaccgtttcgcccgagccgttcaccgacaagccaggtgctgcgaatctggcatttggcgtggaagaaggcttcgtgaatgccgtgccattcctcaacgccggcgacgtgcataaatgggttaccggcgtattctccgatggcgattacgcagaggcgcatcagcttatcgaaacatccaaacccggctccaacggtgtgctatgcctgccatatctggtgggggagcgattccctgttatgaatccgaatattcgcggtgcctatgtgggcctcgatccagacaccaccaaggcagacatgatgcgtgccgcgcttgagggtgtggccttctccattcgtcaaggtatggaaagttttgacgccaaacccaccgagatttccctgattggcggcggagccagagaaaatgcgtggtgccagattctggccgatgtgttggagcatcccatcgaagtgttcgccaatgccgatattctgccagcagtggcaatggcctcgttggtattcaatgtaccagacctgctgcaatcagtatgcgaatgcactgtataccagccgaatcctgacaccgcacgcacatatgccgacgcataccggcgattcctgagcctctacccaatgctgcgaacgatggattaggaactgagcatcatgaggcaatcggcgaatttggtccgcaaacatatagtggtcaacggactggtgcaaggcgtgggattccgttattttacggtgactcaggcacgtcggcttggtgtacggggttgggtgcgtaattgtcgcgatggctcggttgagctggaagcacaaggcagcagcgacgcagtgcaagccttggttgagcaattagccattggcccgcgatggtccgaagtgagtcacgtcgccgtgcatgacatgccgattatcgatgagaccgctcgggcatttggcgtgcgtcaataacctgtatcacgaacccacatcacgcacgataatctcacgatacgggtgaacatgggcgttcctcgccgcttaggcctcgcacattgctacgatggggcgttatgagtgagaacatcatgcgaatcattgacctgcgtggtcagaacctgtcccgtgccgaactgcttgccgcgatgccgcgtgctgcaatgggtacttccgaagccaccgatttggtgcgtccgattctggacgatgtcaaagaacgcggcgccgctgccctgcgcgacttcgaggagaagttcgatcacgtgcgtcccaagaacctgcgcgtgccggtcgaggcgatcaaggacgccctgaccacgctcgaccccgaagtgcgcgccgccatcgaggaatcggtgcgccgcgcccgcgccgtggccgccaaccaggtgccgaaggacttctacaccgacctcgccgaaggcgcccgcgtggccgaacgctggattccgattcagcgcgtcggcctgtatgtgcccggcggcaaggccgtctacccgagctccgtcatcatgaacgctgtgccggcccaggccgccggcgtcgaatcgctggccatcgccaccccgcccgcccgcgacaatgaggaaggcctgccgaacaagaccatcctcgccacctgcgccatcctcggtgttgacgaggtatacgcggtcggcggcgctcaggccattgccatgttcgcatacggcgtcaagggcagcgagccgcaggacggcgacatcctgtgcgatccggttgacaagatcaccggcccgggcaacatcttcgttgccaccgccaagtcgctggtctccgcattcgtgggcattgacgcggttgccggccccaccgaaatcggcatcatcgccgacgaaaccgccaacccgagcctgctggccgccgacctcatcggccaggccgagcacgatgagctcgccggttccgtgctgttcaccgactccaccgagattgccgacaaggtgcaggagagcctcaagtaccgcgtgccgcgtaccgagcacgccgagcgtgtccacacgtcgctgtccggcacccagtctgccatcgtgctgaccgacggtctcgaccagtccatcgacgcggccaacgcctacgccgccgaacaccttgagattcagaccaaggatgccgatgcggtcgtcaagcgcatcaagaacgccggtgccatcttccgcggcccgtactccccggtgccgctgggcgactacatgtccggctccaaccacgtgctgcccaccggcggcaccgcccgcttcgccgcaggcctcggcgtgcacaccttcatgaagccggtcgaagtcatcgaatacgacgaggaaggcctcaaggccctcgccgcccgcatcaacgccttcgcggtatccgaggacctgcccgcccacggcgagtgcgtgctctcccgcttcgtcaaggatccgtatgacaaggccaccctgcgcgagcaggagaaggaagccggtctgcgatgagctcgattcctgcaaacctgccgctgcgcaacgacctgatcggtgaggagccgtacggcgctccccagctggacgtgccggtgtgcctgaacgtcaacgagaacccgtatgcgccggacccggccgtatgcgacaccatcgccaagcgtgtgcgtgaaatcgcccccacactcaaccgatacccggaccgtgagcacatcgaattgcgtcaggcattctccgattacctggcccgcgaatccggtacccgtctggacgtggacgagctgtggggtgccaacggctccaacgagatcatgctccagctgttccaggctttcggtggcccgggccgcaccgcactcggtgccgacccgacgtactccatgtacccggagtacgcccgcgacaccttcaccggttggaagctcgcccaccgcaacgccgacttcacgctgaacgtcgacaaggtgcttgaggccatcgccgaggtcaagccctcgatggtgctgctcactagcccaaacaacccgaccggcaccccgttgccgatggaggatatcgaacgtattctcgccgcctgcgaaaccgctgaagtggtcggcgcgggcgagggcgtgcacccgattctcgtcatcgacgaagcgtacgtggaattccgcaagcccggcaccccgagcgccgtgagcctgatcaaggaccacccgaacttggccgtcagccgcaccatgagcaaggccttcgccttcgccggtgcgcgagtcggctacctggccgcgtccaagggcatcatcgactgcgtgcgtatcgtacgtatgccgtaccacctgtccgccgtgactcaggccgccgcactggccgccttcgaacacaccgacgagcagctgagccgtgtcgagcacctgcgcgaaacccgcgaggccaccgccgcatggctcaaggaacagacctacaaggaccagccgcttgaagtggccgaatccggctcgaacttcctgctgttcggcgggcacttcgacaagcgtgaagccatcttcgacgagctcctgaagcgcggcgtactcatccgcgtggtcggaccggacggttggctgcgcgtgtgcatgggcaccgacgaggagatggaaaccttccgtaacgcccttgttgaagtgcttcgtatagtggaagcagcataagggacgtttctttccgattgcggcgagacccgaagcgattcgagtcccgccgcaatccaatatgacgaatcacacaggagacatgatggcaagaaccgcgcacatcgtccgcgaaaccagcgaatcacacatcgacctcgaactgaacctcgacggcacaggcaaaaccgatatcgatacatccgtgccgttctacaaccatatgatgaccgcgctcggcaagcattcgctgatcgacctgaccatccacgcccacggcgacaccgacatcgacgtgcaccacactgtggaagatacggccatcgtgttcggcgaagctctgaagcaggctctcggcgacaagaaaggcatccgccgctttgccgacgccaccgtgccgctcgacgaggcgctggccaaggccgtggtcgacatttccggccgcccgtactgcgtgtgcagcggcgagcccgaaggctacgaattctgcatgatcggcggccattttaccggctcgctggtccgccacgtcatggaatccatcgccttccacgccggcatctgtctgcacatgcaggtgctcgccggccgcgacccgcaccacatcgctgaagccgaattcaaggcgctggcccgtgcgctgcgcttcgccgtggaaatcgacccgcgtgtagacggcgtgcccagcaccaagggagccctgtgatgaccgacgacaagttcgatccggacgaatcgcacttctccgacgaggagcttgaggctgcgctcgccggattcgagaaagaattcgcggacgattcggtatccggcgatgccagtgataccagtgatgccgataaaacagcggacgctgcttcagcgaagtccgattccgacgcgaatgatgatacggctgataaggcttccgctgattccggccggcctatgaccgacgacgtcaccgggtccgttgcggatgcggtgaacgaggccatggccgatgtggtcgacccctcgctcggcttcgacaacgaactcgctggactgttgggtaacaaggcgaaggtggcgctgatcgttacccgtcttgcctccgccgaactgttggccgcgttctgccagctgtcggacatctccgccgcatgcatcggtgccaatcagggggccgtcgcggtgctgaagaatctggacggcgacggcccggaagccgcagccaaggacctgaccaccgtggtatccggcatggccgtgattcttgcagtcaatcgtgccgacaagctcgaagtggccatgtacgtgcagggagaggccggccagagtttcgcgccgcccgtgctgttcacctccacaccgcgcttcgtcgaggacctgatgctcggcatcgtaaccctgaaccaactcaagacccaagggttcgaagtggtggattccgctggactcgaccatgatcaggcgatgcagattctcgccaaccacactaggcgcggacgtggcgggcgcggctcccgcatcgaatagacgccaaccaaaccagtaggggataggagagcagatgaccacagcggttgttttcgattacggtttcggcaatgtacgttccatggtgcgtgcgctcgccaatcttggcgtcgacaccaccctcacctccgactaccggcagtcgttggaggccgacggcctagtcgtgccgggcgtgggtgcgttcgccgcatgtatggaaggactgaagaaggtcgacggcgaccgtgtgatctatgatcgcatccgcgctggccgcccggtgctcggcgtgtgcgtgggcgagcagatcatgttcgaacacggtctggagcacggtgcccatgccgcaggcatcggactgatcggcggttcggtgaacctgctggacgccgacgtggtgcctcacatgggatgggacacgatcgaggccgcccccgattcggtgctgctcaacggcgtggagaacgaacggttctacttcgtgcactcctacgccgcgatggaagtgaagccggcggatacgtcccgcttcgacatcgatctgagcgattcgcccgaacgcgtgagctggtgctcgtacggccgatcgcgctttgtggccgcctacgaacacggcccgctgtccgccacgcaattccacccggaaaagtccggggacgctggctcccagctcctcaagaactggatcgccacgctgtaaaaaagcatgaagctccctctgacgagggagctcaaattgtgtataagtaactgaagaaaggctcttcttatgtcgttgactctgctgcccgccgtcgatgtacgcgatggcaaggccgtgcgcctgcgccaaggcgaatccggttccgaaaccgattacggttcgccgttcgaggccgcccgtacttgggttgaggccggtgccgaatggattcacctggtcgaccttgatgccgctttcggtacgggcaacaatcgcgatcagctgcgagaaatcgttcatgagctcggcgaccgcgtgaacatcgaactgtccggcggcgtgcgcgatgacacttcgttggacgcggcccttgaggccggtgccgcccgagtgaacatcggcaccgccgctttggagaatccggattggaccgcctcggtcatcaagaagtacggcgaccgcgtggctgttggtctggatgtgcgcggtcacacactggcggcgcgcggctggacgcgcgaaggcggcgacctgtttgagaccatgaagttccttgactccgtgggctgctcgcgttacgtggtaaccgacgtggctaaggacggcatgatgtccggcccgaacattcaattgctgagtgaagtcgctgaacgcaccgacgccaaggtcacggcttccggtggtatctccaagctggacgatttgcgcgccatcaaggaactggctgaaattggtgttgattctgccatcctcggcaagtccctctatgcacgtgcgttcacgctccaggaagcgcttgaagtagcgaagtaggcaaaggactcgccttagcgagactgttaatctaccttcgctcagctatcgcttcactcagacccctcccacggacagcccaatgggctgtccgcttaacggctcagcaagggaggtcgccggatttgaggagctttttgaagacggcgtagtcttcatcattctgttcggcgtagctgacggcgaatgaggcgatggcctgatcgaattcgtcggtgccacccatgtaattggcgatcgcaatcgaatcgccggtgcgggcgtggggcgtgcgccaacgaccatgcgcacatgcgtgacagatcgctcaatcccgaagcgttgagattgtcgatatcaatcgaccccttgccattccacaactggcgcacgtaatagtcgcgcggtcggccatcctcggccataaagctcgaccaacccaacagcacatcggccgtattctgaatcagcttctgcccctgaaccacgcgctcaccgtgcgtggcgtacggcgacgcgccgcagtaatgctcgagcacggaatacgtggcctccttcatctgaatcatcatcggatcgtcgatatcacgcgcgatccacaccgacgtccacgcgcgctggcccaccgagcccacgcccaccaccttgcgggccgcatcctgatagcgcaaatgatcgaacacccaacggcgatcgtcgtacagggaatgccggtagctctcgaacagcgtgtctatacgtgcctgcaacgcatccaagtcggcgtaatcatccagctgattgatcggcaccagctcgggcggattggatttgaacctgagcttgccgctctcataacggcacagtttggccgccgccgcgtcgttatccttcagcagcgccttcatggccgcctcacgcagcacacggctgcgtttggaaccggtggtctcgaagcggtcgagcgtctcctccacgtccaggtgctcataccacgcgtcaaggtaatccatttcggagaaccacttcatgcgtgtgcggtacgtgtgtacgcactggaccacggcggcgcgacggtccttctccttgattttgttggcgcgtccgcagatctccaccgaggcggcgagacgtttcagatcccattcccacgggccgatagcggtttcgtcgaaatcattgatatcgaacaccagacgggcggaaggggagcggaaaatgccgaaattgccgatatgcgcgtcgcccacgcactgcaccggaatgccagtgactggcgtggaagccaggtcattggtcatgatgagcacggtgccccggtagaaggtgaaggggctggcgctcatacgcttgtaacgcagcggaatcagatccggtacgcgaatcgcggactgctcctccaaaaggctgatcgcctcacgccggccctccttgaccttccatatggcatgtgcgtccagcggcgccttggtacgagtggcgatgccggcgcgcgaacggtcgcgcgggtcggtggcctgcgtccagctggtcacgtcgacgggcggattggcggatggggtgagatgatcttcgctcatagtcactaccatagtgccgtgccggcatgggcctgaaccatgcctgacatgcggaccggggcatgttgatgaaatctcgcgactcgcaggtgacgaacagtgagatgttaacgcccttcgtaacacggttatggaacgataggcgactatggataaacagcaggagtttgcgctgcgcacggtcgaagaacgcgacgtgcgctttattcgtctgtggttcacggacgtgttgggaacactgaagtccgtggcgattgctccggccgaactggaagccgcgtttgaggagggtctcggcttcgacggttccgccatcgagggcatgacccgcgtgtccgaagacgatatgatcgttcaacccgatccctcgacgttccagatcctgccgtggcgcggtggcccgcaaggtaccgcccgcatgttctgcgacattctgaccccggacggcgagccttcgctcggcgatccacgtcacgtgttgaagcgcacgctcgccaaagccaaggacaagggcttcacgttctacgtgcatccggaaatcgagttctacctgttcgaaagccaggacgactggtccaaggccccgaccccgatcgacgagggcggctacttcgaccacgtgccgcgcagcccaggcatggacttccgccgtgccaccgtgaacatgctcgagcaaatgggcatctcggtggaatactcgcaccatgaggcggggccaggccagaacgagatcgatctgcgatacgcggacgcgctcaccatggccgacaacatcatgacattccgtacggtggtcaaggagatttccttggagcgtggcattcacgccagcttcatgcccaagcccctggccgacgcgcccggttccggcatgcacacgcacctgagcctgttcgaaggcgattccaacgccttctacgaggccggtcaggagttcaacatgtccctgaccgcccgccagttcgccgccggcatcctgtaccatgcggccgaaatctgcgcggtcaccgaccagtacgtcaactcgtacaagcgcctgtggggcggtaacgaggcaccaagctacatctgctggggccacaacaaccgttccgcgctgctgcgtatcccgcagtacaagccgggcaagggcaactccgcgcgcatggagttccgcgcgctcgacccggtggccaacccataccttgcctactcggtgctgctggccgccggtctcgacggtatcgataagcagatgcagttgggcgagcctaccagtgatgacgtgtgggagctcaccgacggcgaacgtcaggctatgggcattcagccgctgccgcgctcgctggacgaggcgctgaagatcatggagaaatccgacttcgtggccgacgtgctcggcgaacacgccttcggctacttcctggacaacaagcaccaggaatgggaggagtacaaccagcaggtcacgccttacgagctgaagaagtatctgccgaagctgtaatcgcaagcgttgcacatgtgccaaaccccgtcgatgattggtcatcggcggggttttctatggcgtgtcgtggtggtgggtagcgggcagaggcgggaaaagtgttatcgctgagttgatacgaaaaaacgattgacataaccgacgaatcagcttgtagtacgagcgagagcactcaagagagcacccatgacgaacgcacctgcgaacaccgcgcgtaccggccggcacttgggtggccgatacctttggttggcgtgtcacctttgccttggtctcggtgctcaccgccgtgctgatggcatcgatggcagtgtctctgccacgcaactcgcatccggcgaagatcggtttcctgaggcaattccgcctgttcttcgaccgccgcatccagctcggcgtggcggatgtggtcttcggcgcagccgcctcctatgtcttctacacgtatctttcgccgatcatgcgcgacgaaatcggcgtgcccgaacgctatatcagcatcggcttggtgatttacggctgcgcctgcctgtggagcaacctgtacggcggcaagctggccgacaaaggtcatggcgtggaaccattgacccacattcgaccgatctactgcgtgcaggccgtctgcctgtgtctgctggctttcgcctcgctgctggcggttggcgccacgaccctgctgcgtccatacgtcgaacgctgacagtgttggccgagtccaatcggacaagaccggtcagctgccgttatcagcttcgcggcgaaccgaaccagctggtgtagataagcgcgaagttgcggttgccataactggagcaggaatcgccggtaccgttgccagcggccagtgcggcgatgttcggctggtagggcgtatagatgtagagcagggcggtcgccttgttctcgatatacacttgtgcgccgccgcatgccgcgttcggatgatattggatgtagttgagattgtgcgccgtatacccgtactgttcctcgtgctcgagatagtaacggtaccgcttggccgcgccatacacctgccgaaagaatccggcataggcgggatcgcagtcggcggtatccggacagttcaaccccatcgccgccataagctgatagtcgctgggatcgacggcagtgaccagatgctgctccttctgcatcacggtgagcagcactttctggctcaccttgcaggcgcgggccgactggtcgatgattgtcgccgccgactcgcctttggtgcctgtatagtccgcgcacaggccttcgcctgactcgttcgatgtgtcgaaggtcatcgcggccagcgagccaccttgtgtgtccaaaaacgattggacttcggcctgactcatcgccgaaccgttgaagaactgaccatccgaaataatattgcccggattgaaatcgtatgttcgcgtcagttccagctgtgccgcctcggctgcgcgaacctgtgcccgccagtttgtgaaacgaaccagcccggccaccagcgctacgacaacgaccaccgccaccgtgggaatcagcaccatcttgatacgggtcggccagttcgccttacgccaggaacgcttcagagcattgatcggaccgtgcctacgattgcgtttcctgttccgattgccgaggcgtccgcgcacttgcccacgctgtgatgacggcttgcgcgtgcgctggcgcgtggcctggcgacttgtttgccgtccggtcacgccagcgctttcttgatacggttgagcgaagccggccccttggtgccaagctcctgcgcccatagggacacgtagaactcttcaagcatccaacgggcctgttcggcctgcttcatcaatgcctcatgcttcgggccggccggctccgccttggcacgggccaacgccttatcaaccacctgacgggcctcgtcggcctgccaagcccacttgacatcacggttcttatcggttttcgccttattgagtcggctcagatcggctctcaaatatcggctcaacgacttcagcgcatccgggggagtgcgcccgatgaatccggggtagacgagcgtggcgatatggtcgcgaatcgactgcaacaccgaaagcatcggcagatcagccttgccgccagtggccttgtcgacctcggcataagccttgagcacggcgatcacgtcatgcgccacctgatagacggtgtcctcgtacacttcgcgcacatcgagcaccgcattggctaacgcctcatcgtccgagagcctgtcgacattcggcatcagccgtttgaccgtggccagctgcaggtcttcgaccagatccttggtggacttgtacggagcagaagccagcatcaacgcctcggtacccagccagcgcgacgaaatgcgttcggccggcaatcgcaacgcatccaatgcgccacgccagagcatcgtggcccgggactcggtggtggcacccgccttatgcaacaggttcgcctgactgaccagcttgccctgttctccagcctgatcggcctgcttcttgaccatttgacgggccgacgcctccgcctgcgcggcgaacttgcgttgcagcgccttcagatccttggacacacccagcaccttgatggggccgcgcgcatgccggcgtccacgagggtgcttgccggccggcagttgctgctccaccgagaacgtgactctgagatacggggaaagacgctcgaccagttccggccccaacacttcgggatgaatctgcgcacccttggtggcgatggccgccttggtgaacacatgtgccagatcgggccagccaacggtcgtgccatcctcatccaccggcggcagattcggcttctgctgcgagcccgagcccggcagatccgggtaatgctcgtcgatccagtcacgaatcgcacgcgcggcatccggggccggcacgaactggacgcgcagctgcttgggcagcgccttgatcatcgacaggatcagctcatccaacagacccggcacattccatgtgaactggtcgggcgtgatacgcgagagcgccttcaacggcacatgcacggtgacgccgtcggccgggtcggccggatcgtacacgtagctcagacgcaggtcgatgggttggccgtccgatccggtcgtatgccaatggtcggggtaatcgtccagactcaccgaatcgctggatgccagacgctccaccttggccgggtcgaaatcaagcagattcggctgacggtcatgctcggacttccaccatttcgccagatcggccacgctggtcacatcgttgggaatgaccgcgttgtagaagtcgaacagatcctcgtcggacacggtatccgccagctggcgggtgcggctcgcatcatcggcggcatcctcgagaatgtcgcggtttttgcccacgaagtcgtcgtaactgaaacgctgctgaatatcgccctcgaccagaccctggcgaatcaggaagtcgcgcgcctcaagtggattgatgcgtccccactgcacggcacggtcctgtacgatcggcagaccatacagcagcacgcgcgcggtggccacagccgagccacgcgaacccgaccagtgcggctccgcatacgtggtgcgggtcaattggccggccaacggttcggcccacgcggggtcgatggccgccgaatagcgggcccacaggcgagaggtttccaccagttcggtgctcatcacccatgacggggtcttcttggccacggcggaagcggggaacagggcgaaacgggtgccgcgtgcgccctgataatcgttcttcgactgcttctgggcgcgtttcatcgcacgggcgcgcgccgaaccggtcagccccgcgaaatcggaggccttgggctcgcgcaccacctgcatgcccatcatcgacagcaatccggcgagcatcgacttgtggatgccgtccgcatcccacgcgcagcacagcgaatgcgcggcctgctgattcaacggcagctggcggatctccaagcctgggcgggaggcgggcagcgggtcgccgaccttgaacttcagctccttgcacatctggcgtagctgggagacgagatctttccactggcgcatcctcagccagctgaaatactcggttttgcagatacggcgcagcgcgttgttgctcgggtcgccgtctgcttggaacacgcggtcccagatattcagggccgtcaggaagtcggaggtctcatccgcataccggttgtggatgcggtcggcatcctcacgcttgtcgtccgggcgttcacgtgggtcctgcaagctcaggaacgccacgaccacgagcacctgggccagaagattcggcgaaccggttttcgcggcctcgataaccatacgtcccagacgcacgtcgatggggatgcgcgccagctgacgaccggtatgggtgagcgtcacctcgccgcgcttgcggccgatggccttgagctcggtgagctcattgaaaccgtccgacacggccttcatatccggcggatcgatgaacccgaagttcgtgacgtcctcggccgtgcgggccacgcccaccgacagcatgtggagtaccacggcacccagcgaggtacgcaggatttccggctcggtgaagcgcggacgggtctcgtaatcctcacgcgaatacaggcggatcgcgatgccgtcggccacacggccgcatcggccggacctctggtcggcactggcctggctgatcggctcgatcggcagacgctgaacctttgcggtcttcgaataccgggagatacgggcggaaccggggtccaccacataccggataccgggcacggtcagcgaggtctcagccacattggtggcaatgacgatgcgctggtgaaggtgcgattcaaacaccttatgctggtcggcggcggacagtcgcgcgaacagcggcatgatctcgatggcatccggccggcgcatgtcgtcggcgcgcgggccgtaatgatgccgcagtgcggcctcgaactcgtggatgtcgcgctcgccggaggcgaagaccagaatatcgcggggaccgcgctcgtgggaggagtgaatcaccagctcggcgcaggctcgagccacggcggtaggcatatcggtgatgccgtcatcggcataggaggcaccggaccggccgcggggccggtcggaatcggattccgcgatggcgctggccagctcgtcgtaatcggcgtcgccggggcgggcgcccaccgcgaatcccggcacttcgcgcatcaacgcgggcgcggtgccaagcggctcgtagaccacctgcacggggaaggtgcggccggaaacctcgattaccggcaccttctcatgcaaggcgtgctcgaaatgctcctggaacttgaccgaatcgatggtcgcggaggtaatgatgagcttcagatcgcggcgctgaggcagcagtgccgtcagatagccgagcagaaagtcgatgttaagactgcgctcatgcgcctcgtcgatgatgatcgtatcgtatcgggtgagtttcggatcgcgctggatctgggcgagcagaataccgtcggtcacgaccctcaatcgtgtgccgggcgagctttcgtcggtgaaacgcacctgatagccgacctcgtcaccgagcttcacgcccatctccgaggcgatacgttcggccaccgtgcgtgcggcgatacggcgaggctgggtgtgcacgatctgcttgccgtgcgtgccacggccaagctcaagcaggattttcggcagctgtgtggttttgcccgaaccggtctggccggacacaataacgacttggaaacgtttgaccgcgctggctatctcatcacgcgcggcagatacgggaagttctgcgggatactcatatttcatgacgaacttcaatgatacggaagcccttggagctcgcgtatttgctcgcagtgaacccctcgccgagcgcatcgtccagccaggggatcagcgaatcggaaccgagattcttctgcactacgagataggcggcaccgcccaccttgagcttcggcagccaagccataagcaatgtatgcagcgcttccttgccgactcggatcggtgggttcgaccaaatcacatcaaacgtgaggtcgctcggcaccgtctcgcagaacgccggctggttctcggcaggcaggggagtgctggactcgtccacctgagccgtatgaatgttcgtgtggccgttcgcctgtgcgttggcatgggtcaggtccaccgcgcgctcgttgacatccaccgcccacacgttcgcttcgggcgactcaaacgccaatgtcagggcgatagggccccagccgcagcccaaatccagaaaatcgccggtaagcggcggctcgggcgcatgcttcagcaataccgacgtaccgaggtccacgcgcgagccggagaacacgccgttcgacacctgagcggtcgcctcatggccgcgcaacgttacgttcaatgtgcggcgcacatccttcgatgcgggttccgcagagaaatactgttctgccatggtcgctccatttctgcgggattcgccgctctcgtatgccgacctgtatcagccggcctatgccggtacgtgccgatctatgccagcatgtcacctcatgtgatgataataaaggaccatagaagaatcgtggaccattccaaccaaacgaggcgcacttgaccgacaacacccagtacaccgacatcaaccgcggcaacaacgacgttacccctgaaggtgtgctggccgagcagtccgaagtgttgctcgacgacagccagcgcgcgaccggctggcatgaggacgccaaccaggaatgggaggagcgcgaggcccgcaacgagctcaagcatgtcgccggtctcggcgagctgcaggacgtcaccgaagtcgaataccgcaaggtgcgtctggaacgtgtggtgctcgtcggcgtctggtcgtccgccgtcaccacgcaagccaaggccgaggaatcattgagagagttggcggcgctcgccgaaaccgccggtgcggtggtatgcgatggtttgctgcagcatcgctccaagccggatgcagccacgtacgttggttccggcaaagccaaggagattgccggcatcgtggcgcgtgaggaagccgatacgattatcgtggacgacgacctgccgccgtcacagcgccgtgcattggaggacgccgccaaagtcaaggtggtggatcgcaccgcggtgattctggacatcttcgcccagcacgccacctcgcgtgaaggtaaggcgcaggtggagttggcgcagctcgaatacatgctgccccgactgcgtggttggggtggttcgctgtcccgtcaggccggcggtcgcgcggccggcgcggatgcgggcatcggatcgcgaggcccgggcgagaccaaaatcgaaatggaccgtcgtgtaattcgcacgcgtatcgccagactgcgccgtcagattcgtgagatggccccggcacgtgaggtcaagcgcggttcacgccgtcgcttcggcctgcccacagtggccgtggtcggctacacgaacgccggcaaatcctcgttgaccaaccgtctgaccggttcggccgaactggtggaaaacgcgctgttcgccacattggacacggccgtgcgccgcgccaaaacccgcgacggacgcgcttacgcctacgtggacacggtcggcttcgtgcgccgcctgcccacccagctggtcgaggcgttcaaatccaccctggaagaggtggccgaggccgacgtgatcctgcatgtggtcgatggctcccaccctgacccgttctctcaggtcgacgcggtcaatgacgtgttggcggacatcgaaggcacggcctcgattccgcgtattctcgtattcaacaaggccgatcaggcggacgaggcgactcgtgaacgactcgccgcgctgcagccagatgcgttcatcgtctccgcctataccggtgagggattggacgagctgcgtaccgcggtcgaaagtctgctgccggtcccgcatgtgcatgtcaacgctctgctgccgtataccgctggctccctgatctctcgtgtacgcgaatacggcaaggtagacaaggtggagtaccgcgatgatggcatacagcttgaagcggacgttgatgcccatcttgccgctcaggtggtcgaacagtccattgactaacgtgataaacatcacagtatattcgtgagcactaacaaccgttgaaaacattaccatacggttgtcaaacagggtggtgtgccggtagcaaaacgtcttagcgggtttatagagtgaagacgttagttacaaggcctgccattcatcagcagaccgcctttgaagagaggttcatccatcatggcggaaactaccgttaagcccacgaagcttgctgttattggtgccggtgccgttggctccaccctcgccttcgccgctgcccagcgtggcatcgctcgcgagatcgtgcttgaagacatcgccaaggagcgcgtggaagccgaagtgctcgacatgcagcatggctccagcttctacccgaccgtgtccatcgacggttccgacgatcctgagatctgccgcgacgccgacatggtcgtcatcaccgctggtccgcgtcagaagccgggtcagtctcgtcttgagctcgttggcgctaccgtcaacatcctcaaggccatcatgccgaacctggtcaaggtggctccgaacgccatctacatgctcatcaccaacccggtcgacatcgctacccacgtggctcagaagctcaccggtctgcccgagaaccagatcttcggttccggcaccaacctggactccgctcgtctgcgcttcctgattgcccagcagaccggcgtcaacgtcaagaacgtgcacgcctacatcgccggcgagcacggcgactccgaagtcccgctgtgggagtccgccaccatcggtggcgtccccatgtgcgactggaccccgctgcccggccacgatccgctcgacgccgacaagcgcgaggagatccaccaggaagtcaagaacgccgcttacaagatcatcaacggtaagggtgccaccaactacgccatcggcatgtccggcgtcgacatcatcgaagccgtcctgcacgacaccaaccgcattctgcccgtgagctccatgctcaaggacttccacggcatctccgacatctgcatgtccgtgccgaccctcctcaaccgtcagggcgtcaacaacaccatcaacaccccggtctccgacaaggagctcgccgctctgaagcgctctgccgagacgctgaaggaaaccgccgcccagttcggcttctgataaaaaatcgctgtacggagcgcctttcgcaccgcgcaagactcgacctacctttgtaggccttcaccttgtgcggcacgaaaatcgcacacgtacagcgattttttataccctgctgaatgctcccgttgggagcattttttattcgtggagttcgttggaggagggggagctatagccctcgggctcgagctggaaggtggtgtgggggaccgagaccgggaagtgctcgcgcaggcaatcctgcagttgggtgaggattgtggcggcatcttccatggtgaggtctttgtcgactaccacgtgggccatcagaatcggcatgccggtggacaccgtgctggcgtggaggtcatgcacggcaagcacatgcggcacgtcttccagatgttcgcgtaccttatcgaggtcaagtccatccggtgtttcctccagcagcaccttgaccgcgttgtgcagcaacttgatggcgcgcggaatcatcatcagtgcgatgacggcaccggccacggcgtcgaagccattccatccggtggggatcattaccagggcagaggccaccacggccaccgagccaagtgcgtcattcatcacctcgaggaacgcggccttcatattcatgttgtcttcgcgctgcgaggcaaggatgaaaatcgagatgatatttgcggcaagacccagaatgcccgcgaacagcagcaagccgatatcgtcgatttccgctttggaaccgccgaacagacgcatgccggcctccaccaacgcatagatgccaacgatgagcagcaccacggcacctgcggcagcggtgagcacctcaagcctggcccagccccaagtacgagtgttgctgggcttgcggcgcatcagtatggcggtgattgtggatgccgccagcacggacatgtcggtgagcatatgaccggcatccaccagcagggccaatgagccggttaagacagccgacaccacttcgatgaggaagaccgaaccggttacggtcaacgtggcaatcagcctacgctggtgcgcggcagggtttacggatgtggatggtgcgggtgcatgggtatgagccatatgtactccttcgctctatcgagttgaaaccgcttctcatttccatttgcgatatggtctgaatacgacgaaaccccggcgcgaggccggggtttcgtaagctgtgcgtgactatagcacgaccagcgcgattcggtgcacgctgatcagctggtggcgaacaggctacaatttgcgcagcacggtgaccaccttgcccataatcgtggcatgtgtgccgtcgatgggcgagtatgcggggttgtgcggcatcagccagacatggccgttttccttgcggaaggtcttcaccgtggcctcgtcgtccagcagagcggcgacgatatctccgttgacggcggaattctgttcgcgcaccaccacatagtcgccatcgcagatagcggcatccaccatggaatcgccgtggacttccagcatgaacagggtgccggagccggtcagccgttccggcagacgcatgacgtcgtccacatgctgttcggcggtaattggcacgccggcggcaatacggccaacgagcggcacatcgtgtgattcggcaatggcttcggcggggaattggtatatctccgccacattactggtgctggttgcctcttcgctggcttgggagggcttttcggcattcggggcggatcctgccaccacctcgatggctcgacccttgttcgcgttcatgcggatgaagcccttgtcttccaaaacttgtagctgatgcttgaccgaagacggacttttgagcccggcggcatttccgatttcccggaaagagggggcgaagccttgttcgtcgatatgcgtgcgaatggcgtccaacactttgcgctggcggtcggtcagggtggactcgtccggcttctgcttgggggagaagggaatggtgctcacgtcagggctcctttcgttacgtcaccagcataacgtgttgttcgtgtgaaatcaaacatctgttcgagtttcgacttgaccgtgtcgaacgtttgtgccattataagaacagttgttcgatagaacatctgttcgagagaggtggtcgtgatgactggttcaatggtgatggccccggcccgtagcgcacgtgtagctatgcagcatgctggaacgttccaccggaatgtgcgtgggaagattatcgcagtgatggtcgccttggcgctggcctggtgtggtttcggcgcgcttaccgctcagcgggcccaatcggatacgggggccacgcaggtgaccagttatatcgtgcggccgggggatacgctctggtcatatgcttcggctatcacgcctgctggtcatgatgtatcggaaacggtggatgagctgattgcgttgaacaatcttgagtccggatcattgcaggccgggcagcgcattattgttccggttgagtaaatgaaacccgagcggcatggtttttccgcccgtacacgttattctggggagcatgcattgtcctttttgccagaaccccgacaccaaagtcattgatacgcgcattagcgatgacggtcattccatccgtcggcgtcgcgtatgcccgaaatgcagcaagcgttttaccacggtggaaaccagtatgctgctggtcactaaacgttcgggtggcgtggagccattcagtagagacaaagtgatttccggcgtacgcaaagcttgtcaggggcggccggtcagagaagaggatctgaagctgctgggacagaaagtcgaagaggatcttcgctcccgaggccttgccgaagtcacctcagatgaagtgggcaaagccatcctgaaaccgttgcgtgacttggatgtggtggcgtaccttcgattcgcgagtgtgtaccagaactttgcaggtctggaggatttccaaagcgccattgatggtttgcgtgaataatatgcgaatgccatgcaccgtgatatgcgagtgattcgcaaaccatggtgcgagccaatcatgaagcccagcacttatgaaagagacccgtcatgatgacgggtctctttcatatcaatcgaggatgagctgcgtcagctgatgacacgcatgcgaatggtgccttcgatgttgcgcagtgcttcaagcgtggcggcgctgggcttctgagccacgtcggtgaccacatagccaagttcgccttcggttgccagcgactggaaggaaacgttgatgttctcctcgccgagcacatgattgacatgagccagcacaccaggaagattgtcgtgcagatgggcgatacggcacacacccttgcactcaccgaggttgatctgtggtaggttcacggacaaggaggtagaacccttgaaccagtaatcctcaagacgctgagagacgaaatggccgatggattcctgagcttccaaggtggagccgccaatatgaggagtcagaatcatattgtcttcattggccagtgaggtctcgaacggatctccgctcttcttcggttcaacggggaacacgtcgaccgccgcgccagacagatggccggaatcgaggtgctgcttcagagctcccagatcggcgacgaaaccgcgcgaaaggttaatgaaaatcgcgtcctgcttcatgtgggcgaattggtcttcgccgaagaatccggtgttcgacttgcggccatccacgtgcagggtcacggcatcggactgttccagcagttcgttgagggtgtcgcaacggtgggcattgcccagtgccagtttctcctcaatgtcgtagaacaccacgcgcatgccgagggcctcggccagtaccgacagctgggagccgatgttgccgtagccgatgatgccgagggtcttgcctcgcacttcatgcgagccggaagcggacttgtcccacaggccatgcttgatgtgatgcgtgtgtgcgggaatgcggcgcatcaagcagatgatgtcgcagatcaccaattccaccacggaacgggtgttggagtagggagcgttgaacacggcgatgccacgcttgccggcatgtgccagatcgacctgattggtgccgatgcagaagcagccgatggcgcttagcgtaggacgcgcatccagcacgcgggctgtgacgttggtcttggagcgtacgcccaccaagtccacgccatccagcgcatcgatgagttcgtcctcgctcagggctcccttcatggtctcgacttcgaaaccgtgatcacgcagcgatttggccgcatcggggtgaatgttttccaataacagtgctttgggcatgcttcataccttatatgttcagggacttttcgtccgcttttgtccgaactataaccagtttctgggtcggcctggtcattgccacgtacaggtccgaggcggcgaccaggcggctcggcgcgtcatcctcgatgagaccgggctcgaccaccacgacggcatcgaactccagacccttgaccgtttcagtgccgcagacgctgatttgctcatcccattcgggctgctcgatgagccttgcgtattcggccgggtcaagaatgacagccagtttgcggcgcacggcatcgcgcaccggggcgatgagattatccggacagatgacggcgatgcggccggtgccgtctgccgaaacgaattgttcggcaagctgcgccgcctgctcggccgtcgtttccagcaaggacgacatgtcgggcaccacattgcgggacaccgaatcggggatggtgcgcaccgcattgaccgtggagatgtagaggccttcctcctcggcaaatcgtgaggcaagttcggaaacttcctgcggattacggtagttgatggtcaactcgttcaaatcccagtggctttcgccgaacaggcggttcatcgatttgctccagcgtcgggtgccacccagcgccgaagtctgcgccacatcgcccacgatggtgaacgagcgggaggggcaacggcggatcaacatacgccagtccatggcggtcaattcctgcgcttcatcgaccacgatgtgcccgtaggtccattcacggtcggccgcggcccgctgcgcggtcagctcagcgtcgtccccgttcatctggtcgagcagcatctgactggagacgatgcctccacccagaccggtcgcggccagagtgtctttggcatactgctcttcggcggcacgacgtgcgtcggcggcggactggcgggccaccgccttgggatcggggcccagcatatccattgcttcgtcgagcagcggaatatcggagcgggtcaacggggagcctttggggcgggcaagtgccgcgatgtcgttgtcggtcagccaaccagccagagacttcagacgttcgggatgggcgaacagctgatcgatgagccatggggcggtcatcggcagccagcacaggttcagggtcttgcgaacctgctcgttcatacgtagcagcgacatcgcgcggttcagctccgcctgatccggcgtgtaatcaagctgttcggcataacggttctgcatgctggtcagcatcgaacggataaaggtctcgcgggccttgttatgaggttgtcgggtgcgcttcgcgtccgcctgcgcctgctcgatatcagtggccagcattggtacctgaatgccgctaatggttactgtcggcagagcagcgggaacacgcacgcgtgcggcgatggcattggccactacggaggtcatgcgtcgatcgcccttgagcttggctgcataaggggagtcgaccgccgtggcggtgatgccgggaatcagatcgctgatggtgcgtgagaccacgccggtctcgcccaaggagggtagcacctgatcgatgtagtgcaggaacgccgagctggggccaacaaccagcacgccggaacgttccagcgtgcgccggtgcgtgtacagcaggtaggcggcgcgatggagcgccacggccgtcttgccggtgccggggccgccctgcaccaccacggcgcgattcatgtcggagcggatgatgcggtcctgctcggcctgaatggtggccacgatatcggtcatcttgccggtgcggcgtgagctcaacgaagccagcagcgcaccctcgccggtcaatgtgccggcggaagacgcctggccgacctggtctgaatgcacgtcaagcacctcatcctcaacgcccacgacttcgcggaaactcaaggtgatatgcctgcgcatcacgatgtcgccgtgattggaaggggtcgcctcatagaaaggacgtgcggcttcggcacgccagtcggtcagaatcggctcatggtccgggctcgacaggccgatgcggccgatgtaatgacggtcgccgttcttggcatcgaggcggccaaacaccagccgatcctcaacgctgcgcaattgcgtgaggcggttttcgtacattgtggcaaaggagtctcgttcgctgcgttgcgtgggggatccgtgggagccggcggcgcgtacggtgtccaggcgttgccacatttcggctcgcagatcatccaatcgtccataggcgcgatcgacggcctgctgctcttcatgcagctgggaggcgtaactcgacatgctgttctcttcgttccatttccgtggggcagaaaaacttaaggcattcaaatttaccgcacaccccctacgtcagtgatgcggacaacccggaataggtgaattcagcgtgaattcaccatgctgctcggtcggtggggtgcgcgacgtggattgaatgtgcggagcgtccattcgtgcgacagtcgtggccgacacgcgcaatccatcggtaattgccctaaaagggtgagcaaatcgtgcatgagtggggagaaatggggaatcgtggggtagagtggtgagccagttggccgaagtgtatcccacgtaacgatgaaggaggtggagccatggttgccgatcagacgattcgcgacgctgatgccaacgcacaaggctccaccactatggccgatctcatggctggtctgccgccattgcttctcggaacatatacgccgaagatcgatgccaagggccgtatggcgcttccggccaaattccgctcccagctggggcagggcctggtcatggcccgaggccaggaacggtgcgtgtacctgctgccgttcgacgaatttcgacgtatcgcctcgcagattcagcgtgtgtcggtgggaaacaaagccgcccgcgaatacctgcgtgtgttcctttccggtgccgtcgaccagcagccggacaagcagggccgcgtgctggtgccgcagatgctgcgcgattacgccaatctgggttccgacgtcgtggtgatcggcgttggcacccgtgccgaactgtggaataaggacacgtgggagtcctacctcgccgagaaggaagagggatattccgatattgctgacgatgtgttgccggaggtggaattctgatggttgatgtggcgaatattcatctgccggtattgcttgacgattgcgtgaacctgatggcacctgccctggaacatgagaacgccatcgcagtggattgcaccctgggccttgccggccattccatcgccttcctcaaggccgcgcctcaggctcggctcatcggcattgaccgtgacagtgaagcgctggggctggccaccgaacgtatggaacgggaggggctcgccgatcgattcattccggtgcatgccgccttcgatcagctcgatcaggtgttggcggaccaagacatcgaacgcgtggacgccgtattcatggatctgggattatccagcctgcagatcgacgaaaccgatcgtggcttctcctattcgcatgatgcgccgctggatatgcgcatggacgtcagccagccgttgacggccgaacggattcttgccacctatgatgcggcggaactggtccgcatattcaaggaatacggtgaagagcgtttctcgcgtcagatcgcccgcgccatcgtggcgcgtcgagacaaggaaccgtttaccaccaccgcacagctcaaccgtctggtcgatgaagtggtgccgcaagcccaccgcccggcgggcaatcccgccaaacgcgtcttccaggcgttgcgcattgaagtcaacggcgaattggacaagctcgcctccacattgccgcaggccgcgaaccgactgcatgtcgggggacgactggtggtggagtcctatcattcgctcgaagacaaaaccgtcaaatcgttcatggcacaagggctgcgagtggatgttccggctggcctgcctgtcataccgccggatgcccaaccgtttttcacggatctcacgcgaggtgccatcaaggccgacgaacatgaaatcgcagccaacccgagatcggcttcggtgcggttgcgggcggtggaagtcagccgtgagattccgtcacgatggaggaaacgctttacgcaaaccgcgcagggcctgaatgacgtcaagatacaaggctccgcgtctccgggcagagccaaaaacacggcacgaattcgtacaaggaggggataacagcatatggcaactgcacgtagcattcgatcgaacgcggctccagcctcgaaccgaccgcacaccaagcatcagtcctcctcccgacctgagctgcgggtggtctccaacccgcgtggaaacgagcagggcaatgtcgtcggacgggtcatcgaatggaccagaacaagaagcgcaccgctggtgcacgtggccatcgcagtgatcttcctcgtcggcaccttgttcggcgcgctgatgctgcgtacccagatggtgcagaactcgtttgaggcggcacagatcgaaaccaacatcaacagacttacccaagatatcgaagacgatcaggccaaactcgatcaattggtcgcgaacctgcccgacaaggccagcgacatgggcatggtcccgcagcagggatcagtgtccatcgacttaagcggataccagtccaacaaaggcggaacccagtgaacaccattcgtcgcatcgtagagttcgccaaggtcaagaccttcgcgttcaaatgcatcgccatcggcgccgcattggcgttggtggcgtcggcatgcgtgattcagctggcctccacccagctcatcggcggccgtcaaaccgcacaagcggccacggctaaccgcaccctgaccgtgacgttgagcgccaagcgtgggcgtatcctcgacgccaacggctccgtgctcgctcaaagcgtggagcgttatactatcgtcgccaatccggaggctgcacaggagttcgagccgattacttgcaatgacaacacccgtgattactgccacgaaattgacggcaaacccgtgggcgctaccggagcggcggccgtgggccgactgctggccaaagtcctggatatgaacgccatggaactgggcgctgatctgtccggtaccgggcagtatgtgattctgaagaaagatgtgactccgcaggtcaagcgcagcatcgagtcgttgcacctgggcggtattgtctggggtgagctgagcagtgaacgactgtatgcggatggcgatctcatgggcgcgctgcttggcggcgtgaacgacaacggcgatggcgtcgccggcatcgagcaggtcgagaacaagacgcttaccggaaccgatggccatgaaacctaccagcgtggtaatggcggcgaagagattcccggcaccatgaccgaatcggtggcggccaaaaatggcgacgatgtcaccctgaccattgaccgtgatgtgcaatggtatgtcaaaaaggtcttgaaggaggccgaatccaagtatggtgcagcgtgggcgatcgccgtggtgcaggatgtccagagcggggagattctcgcactggccgatagcgatgaagtacaggctggtaccgatgcggcgaagatgagcccgtctcgggccgtgtccgaaaccttcgagcctggttcggtgggcaaggttatctccatgtccggctatctgcagatgggactgcataagatgagcgatcaattgtcggtcccggaccacatcacacaggagggccagacctacaaggactcattcgaccatggcactgagcgctggacgctcgccggcattctgcagaactcatcgaacgtcggcatgattatggccggggagaactatccggatgagcaacgctacgagtacctgaccaaattcggcatcggacaaccgaccggactgaacctgcccggtgaatcgagcggtctgctcaccaacccttcggcgtgggatctgcgtacgcgcaacaccatcctgtttggtcagggctacaccgtcaacgccctgcagctcaacaacgtggtggccaccatcgcgaacaagggtgtcaagcagcagcagtcgatcatcaaatcaaccaccgatgccaatggcaagaccactgagaccaagaagggcgaagccacccgcgtggtggatgaaaaggtcgcatcggacatgatgaatgcgatggaatcagtggcggaaggctacaacaagttcgtcaaggtcgatggttaccgcatggccgccaagtccggtaccgcagaggtgcagggctcggatggtacgctctcgtccattatctccgattattccgtggtgattcccgcggacaacccgcgctatgcggtcaccgtggtgatgaaggatccgaatggtgtgttcggcggtctgacggccggccctgtttccgcacagatttgtgagttccttatgcagaaatacgaggtgcctgtctccagtccacgcaaaaatgctattccagtcacgtggtaaggatcaggggagaaaggcgatagcccatgagtgcagtgagcgaatccatcgcccagcgggtgaccctgggaatgctggtcgaacggtacggttttgaagtcgatccacccttcgccaccaatgtcaccattacctcactcagcgatgccgtggacaccgtgattcccggctcgctgttcatctgcacgcatgagcaggaacccgatgtactgcatgccgcacaggccggtgcctatgcggcgttgctgccacgcgcgtccaaagggcagatcgccaatgccgatataccgttgctctacggcgatttcgacgatcgcgtactcggcgatctggccagcggtctggccggcggaccgtccaatgccatggcggtgttcgcggtgaccggtgcggatgagcaggccgtcgacgcaggcgtgtcccagctctccgaattcctgcacatgctgggcaatccggtggcggtaatcaccgcatccgggtccacgtcgatgacacgtaccatgaacctgaactatcctctgggcatcctcgatatgcagcgcgcgctgtccgtgtgcgccgaagacggtgtggcggccgtgatcatcgccatggatgaccgcacgttggccgagcatgcgttggaatcggtgaacgtggatgtactgggcacggaggatgtcaacgcaagcgcaagcttgaacgaattgaagacacgctacgcattcgttgcggaacatgacatgtccatgacctcgtcgacacccgaatcggatgaaatggctgcggattcaccggcaatgtatgaccgcgtccgactcgggcacatgtccttggccatcgccatggtgctggccgccggcgtgaggaaaaacaacatacgcagtgccctgcatgtggccaataatctcaattaagtccgtggatacgggacgaagcgtaatcgtaaaggagtttgaaacaccatggttccgatgagcgtggaggagatcgccaaggccgtcgatggtcgattgatcggagacgccggttccgagtctcgagccaccaatacggtcagcgactcgcggcaggccggccccggatcggtgtttgtggccatccgaggcgagcgtgtcgatgggcatgactttgtggcgaaaaccgctggacagggagccacggtggccatcgtcgaccatgaggtgaagtccgatggccttccgcagatcgtagtgaaagacacggtcgacgcccttggcgaactcgcccgatacaacatcgttcgccgccgcgagctggacggcgacttcgacatcatcggattgaccggttcggtgggcaagaccaccaccaaggatctgctctcctccctgcttgccaccgtaggtccgaccgtggctccggtgggatcgttcaacaatgagatcggcctgccgctcactgcgttgcgggtcgatgagcacacccggttcttcgtggctgagatgggtgccagccatatcggcgaaatcgcgcgactgacccgtatcgcaccgccgaacacggcaatcgtattgaaggtcggcgtcgctcaccttggagaattcggctcccgcgaacgcatcgcacaggcgaaaagcgaaatcgtgcagggattgcttcccggaggcaccgcggtactgaacgccgatgacgaacacgtggttcccatggccggcctggccaacggcgacgtgctgtggttcggcttgggatcgtcgcaggagcccgaggtgcgggccattgatgtcactgccgaccggtccgatcatgctgaattcacgttggtcgatgcggacggcaaccatacgccggtgcatctgggcattcctggacgtcacaatgtgatgaacgcgttggccgccgcaaccgtggcgatgcgttacggtatggcacccgaaacggtggcacggattctggcctcgcagcacaccatcagccctcatcgcatggcattgtccacggtgaatcgcgaggggacttccttcacgctgatcgatgattccttcaacgccaatcccgactccatgaaagccggcctgaacgggttgaaggcttggaactcaaatgacggcaaggaaccgttccgtgtggcgctgctgggtgccatgctggaactcggcgtcgatgaaacggcattgcacacctcgatcggcacgtatgcggccgaattgggcatcgacgcgatcatcgcggtcggttccgcccaagaccaacatctcgatgcactggcacaggctctggcggacggtgcccgtcagagccaattcgcgtcggtggattgcgtacacgacatcgatgcggccgaacagctggttatcgacttggctcgcaaccatcccgacgctgtggtactgctcaagggatcgcacgcgtcaggcctgagcgctttggctgaacgctgggcaaagaactgacctgataaccaccccaagaaaccgacaagaaagagaagctgcacgtgattgctctgatcattggaatgctggtgtcgctcatcgtcaccttagtcggcaccccgctgctgattcggctggtccacaagctgcactatggccagtacatccgccaggatgggccgcagtcgcatctggtcaagcgcggcacccccacgttgggcggcgtggtcatcaacttcgcgattctgctcggttgggcatcctccgcactgtaccgatacctgcgttcgggcgacgtgccctcctggtccgcggcgctcgtactgttcgccatgctgtcgatgggtctgttgggctttatcgacgacttcgccaaggtgcgtaagaagcagaacgaaggcctatcggtgggcggcaagttcatcggccagttcatcttcgccaccatctacgcggtacttgcgctgctgattcccaccaaatcgggattccccagtgcgcaggcaggcatcagcttcatcgaacagccgttcttcaacttcgacttcgccggccgtgccgtagccatcatcctgttcgtcatctgggtgaacttcctgatgaccgcatggaccaacgcagtgaatttgacggatggacttgacggtctggcggcaggttcgtcgatgatcgccttcactggttttggcatcatcgcattctgggaaagctaccacatcaagggcggcagccatggcggatattcctatgccgtgtccgatcctctcgatctgaccgtcatcgccgtatgcgcggccgtcgcctgcttcggcttcctgtggtacaactcgaaccccgcatcgattttcatgggtgataccggttccctggccttgggtggtctgttcgcagccctgtccatcgccacgcacaccgaattcctgacggtggttctgggcggactgtacgtcatggaagccatgagcgacgtcatccaggtcgggtacttcaagatgacccacaaacgtgtattcaaaatggcgccgattcaccatcatttcgaactggagggttggaccgaaaccaaggtggtggtgcggttctggatgatcgaactcatcttcgtgctgctcgccctgacgattttctacggcgactgggtcacccgctccggcctgctgttcagctagcggaaatctgggtggattatgctcacccacggaattcctatatcaggaggaacaatgcaagtagcggataagacagtggtgatcgccggactgggggtgtccggcacctcgttggcggaggtattgagggaacgcggcacccacgtgattggcgtcgacgagaggaagcccgagaccgatctccactcctttgatgacgtggactgggaccacgtggactacgtcatgtcgtccccggtgttcaacccccgcaccccgttcgtgctggaagcccaacgccgtggcatccccgtgatgagcgaggtggaattcgcatggcagctgcgtgtgaataacgagcgcaccggtactccggctccatggatcggcatcaccggcaccaacggcaaaacctccaccaccgagatgacctcggaaatgctcaccgcctgcggactcgacgcgccgaccgccggcaatatcgcctccggagacatgagcatgagcctgtctcgttgcgccaccaatccgcagcacgacgtactgtgcgtggaactgagctccttccaattgcacttcaccgattcgctggcacttgactgcgcggcgatcaccaatatcgccgacgatcacctcgactggcatggcgggcgcgagaattacgccgccgacaaatccaaggtgttccacaacgccaaacgcgccatcgtctacaatgcgcaggacgccaaagtcagcgaactggcggccgaggctcagactgccgaaggatgccgcaaggtgggattcacgctcgaggcccctcaagccggccagatcggcattgaagatggctggatcgtggacaggagcggcgtggccggcggcgcagtaggagagtcggtcagactggccgccatcaccgatttcacgcatctggcagagccggacggctcactgtacccgcatctggtggccgatgcattgacggcattggcgttggtgctgggacttggcgctgatcgcgataccgcgttgaaggcgcttacctcgttcaagccgggcggccatcgcatcgaaaccgtggctgaggccgcagtcgagggcggctctgttcgttttgtggacgattccaaagccaccaacggccatgcggcacgcgcctcgctgtccagcttcccggccaagtctgtgatctggattgccggaggtctggccaagggcagtcgattcgaggacctggtcaaggaccaggcacacaccatcaaagcggccgtcatcatcggcaaagaccagcagccgatgatcgaagcgtttgccagccaagctccggacatcccggtgaccatcatcaatcccgaagacaacgataccgtcatggatcgtgccgtcgaagcctgcggtacgtataccgccgccggcgacatcgtgcttatggctccggcctgcgcctccatggaccagttcaagtcctacgcggatcgaggcaatcgattcgccgccgcagccaagacgtggagcgaggtgcatggcctccactgatacccataagcgtaaggcatacagggtccctgacaagcccgcactcgaaatcactgactacacgggttggcgaagcttgctcaacccgctatggtgctaccacggcttccgcatggccgtggtggggctgacatgcttcggcctgatcatggtgttctccagctccacggtcaccatggccgcactgggcaagtcgccgttccttcagcttctgaaccagggcgcgttttgcctgatcggcttggtgctgggcttcgtggcattgatgatgccggtgacgttctggaaacggaccggcgtgctctttgtggtgggtgcctgcctgttgcaggcgctgacctttactcctttgggtatcgacgtctatggcaacaaaggttggctgaacctcggcttcaccactatccagccggctgaattcatgaagttcgcgatgtgcatatggctgccctcgtcgttgcatgcctgcagcaagatgtaccacaagaagggaatcaaagcatatgccgcgccgttggtgttgtatgcgataggcgtggcgctggtgatgggcggcagggacctcggcacggccatgattctggtcttcatcggaggcgtggcctttctgatcgtcgggttccccggcaaatggatgggagtcggcgtattgggcgcggtggttatggtcggtgcattggcggtttccagcccgaaccgcttgcgtcgtattctggccacatatggcgattgctcggccgctgacgcgcagagcgtatgctaccagtccattcacgccaagtacgccatcgcctccggaggttttctgggattgggcatcggcaattcgcgggagaaatggaactacctgccggccgcccataacgatttcattttcgcgatcatcggcgaggagaccggattcgtcggttgcgccatcgtattgctgttcttcgcgattctcgcctggtgcatgatcgtcatcgcattgcaggtcaccgatcgttatgttgccatggtgctgatgtgcgtcgccatttggatcgtgggccaggccatggtcaacatcggcgtggtcgtgggtgtgttcccggtattgggcgtgcctatgccgttcgtctccgcaggtggctcatccatgattatgtgcttgacggcggccggactggttgtgggacttatgcgctctcaaccgcagataaaacagtcgcgtcagagcgcgtaagtagactcggtaatcatgaatcaaggcacaccacatatcgttcttgctggcggcggtaccgccggacatgtcaatccgctgctcgcggtcgccggggcgattcgcgacatcgaacccacggcacaggtcaccgtcatcggcactgcggtgggtttggagaaggatttggtgccggaggccggctacgagctcgacaccatcgaaaaagtgccgttcccgcgtcgccctaacctgtacatgctgcgcttcccggcaaaatggaagcgagaaaccgccaaggtgcgctccattcttgaaacgcggcatgcggatgtcgtggccggattcggcgggtatgcttccgcccccgtctacgccaccgcacacaagatgggcattccgattgccatccatgagcagaatgcgcgtgccggcatggccaataaactgggcgctcgttgggccgatttcatcggtaccgtgtacgagggcaccggtctcaaaccgcgtgccggagccgacgtcgagcgcgtcggtctgccgttgcgcccggccatcgcctccctgaccaaacgcatcggtgacgaccgtgccgccgtacgccgtgaatcggccgcgcagcttggcgtcgatccgaaccgtccgctggtgctggtcactggcggatcgctgggagcgcaaagcctgaaccgcgccatcgcctcctccgccgcagacctgttggcccacgcacaaatcatccacttgaccgggcgaggcaaaatcagcgaagtacgcgaactggtcacggcctcggccggcgcggacgtgcttaccggcatcggccccgaatcggccggacaaggtgactaccataccgccgaatatctggaacgaatcgatctggcctttgcctgtgccgacttggtgatttgccgtgccggagccggatcggtatccgagctggctgcactgggcctgccggccatttacgtgccgctgcccatcggcaacggcgagcagcgtttcaacgccgagccagtggtgaacgccggcggcggccttctggtcgcagacaaggacctgaccccgcagtgggtgcatgagcatgtgcccgatctgctcgccaatcacgaacgacttgccgaattcggccgcaaggcatgggaatacggcatcagaaacgctgccgaaatcatggcccggcacgttctgcaattagccgaaccatccaagtagtattcagatatcattccgtgcgcgatactgaccaattccgttccgcagcacgagatacggtcataatatagggtgctggaatccctaaaggagttttgaattgtctcaagatcagcccatagtgcttgaccctacgtatgcctcattcgatgctgcggcccgccctgcggatctcggcgccacccatttcatcggtatcggcggtgccggtatgagcgttctggccgaaatgctgcacgccgaaggagtcgcggtggacggctccgatcgcgcacacagcgccaaaaccgaccgacttgaaacgctgggcatcaccgttgaattcgggcagcgagccgaaaatgtcgcccaggccgagaccgtggtctactccagcgccatcaaaccggacaatccggaaatcgtcgcagcacacgcggcgggcaagcgcattgtgcatcgcagtgacatcctcgccctgctcatgaacggcaaacgagccgtcaccgtggccggagcgcacggcaaaaccaccaccagctccatgctgtcccacattctggtgaacgccggtgccgatccaagctacgccatcggcggctttatccaaggcccggacggcaccacgctggacggcggacacgcgggcaaaggcgacatcctggtggccgaagctgacgaatcggacggcagcttcgccaaataccatccgaccatcgccattatcaccaactgtgaagccgatcatctcgaccattacggcgacgaagcccactaccgtgccgcgttcgttgcccacgccggccgggccaccggtcacgtgatcatcagtatcgacgaccccgacggacttgccgtgctggaggccctgcccgccgacgtgaaatcccataccgttgcctacggcactaccgcgcgtgagtccctgcccgatttgggcggtgccgcgtatgtctggatcgcttcggaaagcgagaccgctggcagcggcgtcgaacagctcaccctgcatctgccggccgcggtgacggcgggggagccggtgtctcagagcgttgccctgaaggttcctggcgtgcacaatgcgcgcaatgcggccgccgccatcagcgctgccgtgctgctgggcgtgagccccgcagacgcggccaaggcggccggcacattcctcggtgcggcacgccgcttccaggtgcgcggcacggtcaagcaggtcactgtagtggacgattacgcccatcatcccaccgaaatcgcggccctgctggatgcggcccgacgccggtaccccgattcgaccattcgtgtgatcttccagccacacctgttctcccgcaccaagttcttcgcgcaccagttcgccaaatccttagccaaagccgatgacgtcattatcaccggcatcttcccggcccgtgaaaagcaggccgatttcccggacatcagcccctccaccatcgtggacgcggctgcgggactcaaggatgcttccgtaggcacgtggattcagccggttgaggatatgtgcctggccgccaagatgatggccatgcgcgcccaccacggcgacgtgatcttcaccgtgggcgcgggcgacatcaccgacatggatcaggtgctgctcaccgcacttgaggcccatcgggaaagctgcgagtgatgtccgggcgcacggtcagatccgggggcaatgacaacggctcacgtcgttcgtctgggagctcccgcaagccgcgcaccatcggttcacgcggaaacacgggtcgctcgtcgaagtctcgcgctccccggtccgtgtcttccggtcatgagatcgacgagccggagatcatcgacgatgtgacggtagccaagggccaggccggtgccttcgtcgatgcacggcggttgcacagcgaggattacgttgccgaaacgctgcatcagaccaccggctccctaggagtcgcatcacgcccgaaagtggtgaatttcaccgaacgcgccaaagaacgcaagcgtgcaaacgtgcgcgtcgttgcgttacgcgtgttgattgcggtcgtcagtgtggctgtagtggcggggctggcatggctgctgcttttctcgtcggtgtttcgtctggaaaccagcgagatcggcgtatccggtgccaacgaatgggtgagtgcgcagaccatccatgtcatcgccgataagcaggctggaaagtcgttgttcctggtctccgcccatgaggtcacagagcaactcaagtccattcccggcgtcagcgaggccaaggtctccaaacagttccccaagtcgatgagcgtggaagtcaaggcgcaacggcccgcggccatgctgaaaagaggcgataccctgaccgcggtggattcccaggcgcgtgtgttgaactcggtgaagaacgccaacgtggatggcatcccggtgatcgaggtcaaggatatagacgccagtctcaagaaccgttcggtgaaggagacgctgacgattctgggcgcgttgccggaatcgatgcgtaagtccattaccaaggtcaccgctgagacgcaggattcggtgactaccacgcttaacgacggtgaccgcgtaatcatttggggcgactcttcgcaactgaagctgaagttggcggaagtcgaggaaatcgacaagaacatcaccgctggcacggctggctttgccgggaaacatcagattgatgtttcctcatcccagaagcccatcatcaagtgacggcgatttcgttggcttcgttggttccggggcgatgttcgctgctggcgatttgcgcgagtagcgccatagggtgtatgctgaaaagtccggccgaaaagccggaagcttgataactcaagattgggggcgatcggtttcgacggtgacctgttcgctgcagggaagcgtgccgagaacgccgggtccgctcgtggatgaccccggcaaaagaataagtgctaaatctaaccgcactgagttcgctctcgctgcctgatttttagtcaggattaaccagtgagcagccgctccgttcactcctccttgtctttgggaggatgttgagcgtcgtttagaagacttgctgatgcagttgagcctcagggctgcatcgggactttaactgcggatatgctcgccatcagttgtctgcgacatcgatgggggcagaaaaatcgccaacttggccagcagactacgcacgtagaagactgtgggctcggtcatcggaccggggttcaattccccgcgcctccaccaatccgcttcggcggaaacaagccgcttggctttacgaaagtaaggctgagcggctttctgttattgctccgttgattccttgttttcccgctattctctcgtgtcggatatgtcagttggacgaacttgcggggaagaaacgatttagacttagttcagggctgccgattgcacgatgtgtagaggctattatgctacgccgtaatcagggaggatatatgccgctggaattggtccgacaggatattacgaagatgaaggtggacgccatagtcaatgcggcaaacacgcagctcgccatgggtgggggagtgtgcggcgcgatattccgcgctgcgggagtctcgcgcatggctgctgcctgcgatcggtttgctcccattcataccggtgaggcggttatcactccgggattcaatttgccatcacgctatgtgattcataccgcaggcccgatatggcgagacggcaagcatgatgaagaacgtctgctgcgttcgtgctatcgcaattcgatggaactcgcggcacggcaggggtgtgccagcatcgccttccccttgatttccagcggtatctatggatatccgaaagccgaggcccttcatgtggccctcgatgagattcgccgattcctgggcgacgcagccgactccggacacgatctcgacgtatacctatgcgtattcgacaaaaccgctttcgaaataagcagcagtattgacaaacgtcttcgcgcatatattgatgattattatgtagcggagcatgaagatacgctaggaagcagaacgtatgagctgcttgctctccaacggttttcggataataagccgaaggcggatagggccgtaccttccggcgtcttggacatgccggatttcctgggcgatatgggtgaaacgcctgtctactcggcgccgtcggcagctccatcgccgaaatccgccgggcatgtggataatgcggtgctctccaatctggatgaaccttttaacatcattctcttgaggcttatcgacgccaaaggatattccgacgtggaggtatataaacgagcgaatatcaatcgtaaactgttctctaaaattcgctgtggcgatggctatatgcccagcaagaaaacggttttggcactggccattgccttacggctgaatattgacgagacgcaagatatattggcgtgcgccgggtatgcgctgtcgcacagcgtgaaattcgatgtgatcgtggaattcttcatcgtccatgagatgtttgatgtattcactattaacgagatgttgttccgatacgatcagccgttgcttgggcaatgatgcggagcggtacgctcgtctcctgacctgctgccgatacgcggcatattgtcgcttgccaagcgacctaggactggtcccatgatgcgaagctcattgatatcgccgacaatccggctggcgaatgagcgaaaggattcatcatgggcaagaacgacaatggcaataacggccgtacggaactggtgttcgtcgtcgacagaagcggatcgatgggaggtctggaatcagacaccatcggtggcttcaacagcatgctgtccaagcagcgaacaattgccggcgagtgcagggtaacgaccctactgttcgatcatcgaatcgaaaccttgcataatcacctcgacatccgcgaagtgaacgatttgacgagccgggattactgggtgcgcggtagcactgcgttgttggatgcgattgggctggccattgaccgcatgatcgtgacgcaacgacatactgcggcagcgtaccgtgctcaacatgtgctgtttgtcatcattactgacgggtatgagaacgcgagtcgtcgatattcgttgcatcagatcaagcagatgattacctatgagcgtgaacgctatcattgggagtttgtgtttctgggcgcgaacatcgacgccgaacagacggctggtgattttggtatctcaccgcgatgcgccactgattttcatgccgatggacagggaatcaaagcctcgtttgaggccgttgcctgtgccgcgaccgccgtgcgcggaggtgctgaccttgatgacctcagcgcgccggactttcttggtggtgttcgtgatgactatcggtctcgtcgtcgaatgaagcggtaaacgatgaactgcagtgcagatattaccggtcaccagtcggtcgtgtacgttaccggctggtgactgcacacgttgtactgtagggaaccatgaaagtcgtattgcaacgagtatccgaagcgtccgtggacgtggtcaatgaattgggcacgctggatcccacgttcgagccgcagcagattggcccgggattcatgattctggtgggcgtcaccgatgaggacggcgacaagcagatcgcctggttggcccataagattctgaatctcagggtgttcgaggatgcgcagggcaagatgaaccgttcgattcaggacatcggcggtgagattctctccatctcgcagttcacgttgttcgccgacgtgcacaagggcaatcgcccgagcttcatcaaggccggcaagcccgagcatgccgatctcatgtggatcaagttcaacgaggcgttgcgctccgggggagtgccggtgaaggaaggtcgtttcggcgcgcatatacggatcggactggtcaatgacgggccggtgaccatcgtcatcgacaccgaaactgatatgcctgacgggtcccgctgagccaagcgacaagtacatatacgaaaagccctgtgcggatcattcgcacagggcttttcgtatatcggcttcaggaagccgcagccaggccgatcgtcaggccttgacggctgccttcttgccttcaatgatggccttgtatccaacgccgatgaccagcacgtagatgcagccgacggacatcacgatgatggcgccgagctgggcactcatggcgtcggccagggcacccatgatgggcgggaagatggcgccgccgatcaggcccatgagcatcaggccggagatttcgttctggcgctccggacggtacatcagcgcgtgggagaggaagagcgagaacacgttggagttgccgaagccgaccagggccacggccacccagaacagggcgaccggcgggttggaggtgatcgagcagaagatggcgaagcagacggtggaggcggtcatgatggtgccgcacaccagaatgccgacgcggttggaaatcttcgagagcacgatgccgccggtgaagcagccgatcatacgggccacgaagtagaccatggtggcggtggcggcgatttcggtgaaggtgtcgccggtgtgctcggtgaggatacgcggcgcctgggcgttgatgccgacgtccacgcccacgtgggccacgatgccgaggaagcagagcagcacgatgcggtcggagaacaggagcttgaagcagcggccgatggtggtggtgccggcgtcgggggcgggttcgtcgatcttgtcgatggcgagcagcacgtagccgacgatgccgacgaccagatagatcacgaacagtatccaccacatgccgagctgggtggcgccccagatggcgatgtacggggcgaacagggaggcgaaggacttgacgaactggccgagcgtcagggtggaggcgagcttgtcgcccttgacgaacacggtgagcagcgggttcagagacacctgcatcaaggtgttgccgataccgaggaaggcgaaggagatgacgatgagcaccagacgtgcggtgccggatagggccacgtaggcgatgatgggcagtgccatggcgaccagcgtcacgagaatggaccacagcacggtcttgcggcggccaatcttgttcatcagcatgccggtgggcacggcgaagatcaggaaccagaagaacaccatggtggtgaacaggttcgcggtgccgttggccagattgaactcagccttgacgtagttcgtggcggtgccgaccaggtcgacgaagcccatgacgaagaacgcgaacatcacaggcgcgatttttacgagaccggcgttgccggtcttggtggtttcgctactcattttgaattccctttttctctatgaatggacgtacgacagatctatcggtcaatggatgatgactagtgaatagtgatggttccgttatcggatgtcatcatggcgttacatgatttggcagaattcgatgacctcgtggttcggcccaagcacgttgaagtaacggatgccgttgctccagaaggtgtcgatgtgctggatggagccttccacgaagttcaggccgagcttctgggcttcggcgaaggacgcttcgatatccgtcgaatccagcgcgaagtggttgatggcgccgttttccataggcgtggggttcatggtccacacctcgagggtcaggttgttcaggcgcaggaaggtgcagcggtcctcaccgttgggatagatgccgaggcattcgaagccgagacgctcgtagtaggcgatggtgccttcgaggtccgtggtcggaatgccgacatgctggacgccggtgacggtgtcgcgaatggacatggtgactcctctgaacaagatggctttgccggtatagagcggcaaagccatcgggaaaatggggtgggagtggattacttgccgatttcagccagatagtcgggcatctcggccgggtactcgggccaggcaccggcctgggtgcagacgaaggcggcggtgttgacggccttgcggtgggcttcggcgagcgtgtcacccagcaggatgcgtgcggtgaaggtgccggagaaggagtcgcctgcgccgacggtgtcgttcacctcgacgcgcggggtgtccagcgtggagacctcgcccttgcgggagatgatggtggagtaggcggagccggcggtcagaatcacgtagtcgaggtcgaattcctcgaggaaccagcgggaggcgtcttcaccggaggtgccgcgaatgtcgaacatgtcgcgcagcagcaggagttcctcgtcgttgatcttgaagacggtggccaccttgaggagttcctcgataagctccttggagtagtggtcgccgcgcaggttgatgtcgaagaacttcatcgcgcccggcttggtgtgcttgagcagctccgtgatggtggcgtgcgattcgggagagcgcagggccaaggtgccgaagcagacggcgtcggccttggagaccacgtcgatgagctggcgggtgtacaggatgtgatcccaagccacgcccttgacgatggtgtactccgggataccgttcttcagcgcgacttcgacggtggaggtcggccaggcgttgcgctgaagaacggtgttgatgccggcctcgtcggccttggcaatcagttcgtcgccgagttcatcctcgccgaccgcgctgatggcccagccttcggtgccgttcttcatcgcgtggtaggcgaagttgacgggggcgccgccggctcgcttgccgctcggcagcatatcccacagcagttcaccgaggctcagaacgatcggggtagtcatggttggtttcctttcctttgtttcctttatcgggtgtttcgtatggaaaatcttgtgatgtcggcgcttggtttaggagacgtcgaagaacaccgaggggtgttcgaggaattgggtcactgccactgctgcggcaccggagaccgccgcgtcggcggacaaggtggataggctgatggaagtggaggcattgatttcggggatggcccgttcggccaccgtggcgcgcacctcatcgagcagtatcgggccggcttcggacacgatgtcgccgatgatgatgtgctcgggattgtatccattgaagatggtgacgcatccgtagccgacgtatcgggcgacttcgcggacaatggcgattgccgcttcgtcgccgtcgccggctttggcgaacagggcgcgggcggcttcggtgtgggtcatatcggccgcgccgggaaccacggtgccatcggcgatgagcgtatcgtgaatggcgggggtggagcagtagcgttcaaggcagccgacgttgccgcaatcgcaggggcggccgttgacgtcaatggagatgtgtccgatttcggtggcggcaccgaggaagccgttgatgaggcgaccgttgtcgatgacgccgaggcccacgccttcgccgaccagataataggcgaggttgtcgtcggcgtgcaccgacgggtcgaagagataatgtgcgagggcgccggcgcgggcgtcctgttcgatgaacactggcacgcggaaagcggtggcgaattcgtcgatgaagttgattttgcgccagccctgcatgttggacaccacggcggtgcggcctacgttacgcagataggggccgggcactgccatgccgatggccacgatggatgggtcgttgtcgagcagttgttcgacgcgctggtggatggtgacgatggagtcgttgatggtgttgtcgcacaccgtgggcaggttttcaaagctcagggtgttgccgcacaggtcgaacacgccgatctgcaccagcgagcgggcgaatttgatgccgatgatgcggaagtgcgtggtgttgagcttgagtccgatggaacggcggttcttggagccttccagatcgccggtctcttcaatcatgccggcctcgataaggcgtgcggtgattttggtgatggccgcgggggtgagttccagtgccttggcgatttgcgcgcgggaactgatgccgttgtgatacaggtgcttgacgatgcgggagcggttggattcggagacactggcctgggaagtggcgtgggtggtgtttgttgccatcggtcttaagtcctccttgtctgcaccgctgcgagttgttccgctcgtctttgaatctgaacttgattaagatattaacgctgttaattgattgacgcaatcaatatgtcattcggcgtgtcgtgcatgtgagtgtcgtcttgggtgaatttgttaagatagttgtcaatagtcagatgtacactgatatcaagcgaaacgttcgatgaagaacaggggaggactgatgtccgaaaacactatgaacaatctcaaaatcggtgttgacgtgggcggaacaaaaatcgaagctgtgctggttgacgcaatgggcacggtattgggttccgcccgtattcccgccagacatggcaacgatgccgtgatcgaagacatcgtcgctgtagcgcatcaggcggcgggtgagcgttttgacgaggtgagggccatcggtgtcggtaccccgggcacggtggattcggccagcgggcatgtgggcaatatcgtgaatctcgacgtggtctcgctggatatggggccgttgatctcgcagcgttcgggcgtgccggcccatgtggaaaacgacgtcaacgccgccgccgtcggcgcggccaccgtgttgggcggtgcagatggcatggccggtaccattgcgttcctgaacttcggcaccggactggctgcgggcattgtcgaaaacggcgtgctgatgcatggctatagcggtgcggccggcgaaatcggccatatcccagtcgaacctcatcgcctcaagtgcccttgcgggcaatacggatgcttggaaaccgtctgctcgggcgcatccgtgggacgtctgtggcccaacgccgacccgccgatgcccgacctgattcgtcgcgcgaaaaagcgggaggccgaggccgtcgatgtgctggacatggtagtgcgcgccatcggcgacactatccagattttggcccaatccgttgacccgcgactgattgtcttgggtggtggcatggccaaaaccggcgaaccattggtcgaggtgatcacggctgagctgcgccggcgcgaatcgcaatgccgattcctcgaaacgctggacctgccggcccggctgcgtctggcacctgtcggccaaccggtcggagccatcggtgccgccatggcggcgtagcctggcatagtgccggggcatggaagatgaggcgtcggatttgtctccgagaccgcatcttccatgcggtcctatatcgctttatgtcgtgctgtgccgcgctgtgccgcgctgtgccgcgcttggccttgcgcgtttcgttgccggggtgaccggcttttatttggccaagtgttggaagaccacggcgatggcctcgccctgtacggtgatgtcaggtccgcattcgcagcgccgaatcaccgtgtgtttgtggaaggacgaggatgtggcggcatccagatattgctgggccgcgccgatgaacgtcgcgttgatgatgttcggctggccatagacgcatacgtctgccatatccaaaaggcccacaggcatggccagggcttggccaagatagcggcccgcccgagcaaggatattctgatgctgctccacgtctgctgcgctgagttgcttcttcaatgcggttccggaaatcatcgtctccaagcaaccgtgcttgccgcaagggcacggcggcccgtcaagatcgatggaaatatggccgagctcgccagccgcgtgcagttcgccgattaccggcgtgtccgagagcagaatcgccgaaccgatgcctctttcgatgcgcacgaaaagcatattcggcccgccttggccaaagaaacgttcggtgagcatggctgcggtggcgtcgttgctgacgtttacttcaagtccgaaatgttcggcgattggcgtggacaggtcgagattgttccagccgcgcatcgtggaggagcggaccacgccgttgtctaccacgccgggggaggcgactccgatgccgatgacctcgccatcggacatgcccagcatcttctcaatgagctcgatgatcacatccacggaaacgaatgagccggtgttcagggtgacttcggcgtgacgcagcggctggccgagcagattggtgactgcgccgtgcagcaggtgctcctgcgtcaggtcgatgctgatgatgcgcagtcgatcgatatcgatgctcagcagtgtgcctcgtttgcctttgccgccgctgggtgcctgaccggtctcgcgcagcaatccttcctccagcatccgaccgaccacatcggaaacggccacgcggctcaatccggtgcgtcggccgagctcggcgcgcgaatactggttggtggggaacaacaacctgaagataagttggcggttcttgcggcgcacatcggcgggggaagccttggccgcatggtcgtcggtcgttgtgttgagaccgagatatgacatgtttcctcctgcctgatggtgagcgagtggacggcgattgttgttccatacacagcttagacggtgaagcgcaatttcgtcgttgaaactgttatgaaacttcactaataaattccagtgtacctgtgtgaagcgtcaggaaacaccgtgagtgttcataaggtccaaaattgttagtatcattaacaaatagcgaatcaccaatcggcgctacgccgaacggtggttggaacgccgcgcggcacccggacgtgacaaggatgttgccattatccgcaagacgggcggcggtacagcgactcgcatcgggcgggccgcacggaactggaggaaaccgatgccggaaatcatcattgtcaagaacgaagccgaggccggcgagatctacggccgttgcgtggcggacctgatcaaagcaaagccggacgccgtgctgggcctggccactggctccagcccgctggccgcctatcaggcgctcgccaagatcgtcaaggacgaggccattgacgtttcgggcgtgcgtggtttcgcgcttgatgaatacatcggactgccgctgacccatcccgagtcctatcatgcgaccatccatcgcactgtggtcgaaccgctcggcctggacccggccaaggtccatgtgcccggcgacgtacttaacggcactccgcttgaagacggcgacaagatcgcgctggccggcccggcctatgatcgtgccatcgaagccgctggcggcatcgacgtgcagatcctcggcatcggcactgacggccacgtcggcttcaacgagcccggttcctcgctggcctccggcactcgcgtcaagaccttggccgaacagacccgcatcgacaacgcgcgcttcttcgacaacgacatcaaccaagtgcccacccactgcatcacgcagggtattggcacgatcatgaaggcccgtcacctcgtgctgctggcgttcggtgccggcaaggccgaagccatcgaggagacggtggaaggcggcttgtccgcgttctgcccggcttccgcgctgcagatgcacccgcacgccacgattatcgtggatgaggaggccgcctctcgtctgcgccacaaggactactatcgctacgcctacacccacaagccggcctggcagggcatctgagttatcgtgtgctggctcccgccagcgggagcgcatgagcggtaaggagaacaacatgtctgataggaatgagatagtctcgcgcgtgaccgcggcactggagggcaagccggctccggtggcgattcgcaacgcgcgcaaggtggatgcgtgcggcgaacggcgcggatattgggtcgtctccgatgccgccggcgtcatcgtggcggccggcacgggggaggaggccttcgagcactactgccgtacggtggggctcgacccggccgatcgcaacgcggtcatcgacgccgaaggccgtattctgacccccggctacgtggacatccacgcgcacggcgcatgggagaagagcttcgacgacgggtcggatggcatcgatgtggcgcgggccggccacgccgtgcacggcaccacgcgccaggtgctctcgctgatcaccaatcccgtggacgtgatctgccggaacatccgcaccgtccgcgccaagatggagtccggccgccccgacatcctaggctgtcatctggaaggtccgttcctggctctggcccgcaagggcgcacatgacccggaatgtctcaaggatccggtacccgacatcgtcgacgacatgcttgaggcttcaggcgcggcgaacggcaagattggctgcatccgccagatcaccatcgcccccgaactaccccacggcatctccgccatccgccagttcgccgctgccggcgtggtgccggccgtgggccactgcgacgccgactacgagaccgccaaagccggcttcgacgcgggcgcgggcatcatgacccacatgttcaacgcgatgaacggcctgcaccaccgcgagcccggtccgattccggccgcggtggaggatccgcgcgtcaccatcgagctcatcaacgacggatttcacgtgcaggatccgatggtgagcctctccttccggttcgcgcctcatcgtacggccttcgtaaccgatgcaatggccgcgaccgactgcccggacggtgcctacaagttgggtgcgctggacgtgaacgtggtcgacggccatgcgcgtctggtctccaacggcgccatcgccggctccaccctgctgctggaggtcgccgtgcgccgtgcggtgtgcgaactgggcttcagcccggtggacgcggtcgaggcggccactctgacgccggccaaggcgttcggcttcgaccggccgaacccggtcaccggggcgccgatcggcctcatcgcccccggcttcgccgccgatttcaaccttgcggacccggccgactggacggtcgaacaggtgtggtgcgcgggccgcaagctcaagtagcagtaggccgaccggttgacgaatggaaggcattcgtctacgaacatggtcacatggtgagatgatagtatatttgtctcaccatgtgaccgttattcacgtcgtaatacaagaatccgtaatactgctcgataccgcataaaaccggccttggtcgccacaagcgaaacataagtcgatgactatggaaacgcagaggtaacacatccgcaccatagtcaggcggtaatccacgcccgcagtgatgacgtggaaacaagttatgagagaggattcctgttgaattccaagaagattctggccgccgccgtctccgtggccgccatcgcatccctgaccgcctgcggcggtgtgaaggatgacaccaccgcaggcgccgattccggcaacgccatcaccatcggcaccaccgataagatcaccagcctggaccccgccggctcctacgacaacggttcatacgccgtgcagatccaggtgttcccgttcctgtacgcccaggactacaacacctccgaactgagcccggacatcgccgccgatgacggtacctggaacgatgacggcaccgaattcaccgtcaagctcaaggacggcctgaagtttgccaacggcaacgacctgaccgcttccgacgtcaagttctcctacgatcgcatcaagaagatcaacgacccgaacggcccgagctccctgctcgccaacgtcgaatccgtgaccgccaaggacgacaccaccgtggtgttcaaggattccgtgccttttgacgtgactctgaagcaggtcatgtccagccccgccggcccgatcgtcgatgaggataccttcgacgccgacaagctcaccgacgccgacaccatcgtctccaagaaggcctttgccggcccgtacacgctgaccgccttcaagatcaacgagtccgccgcctacgccaagaacgactcctacaagggcctgaccccggccaagaactccgccgtgcaggtcaagtacttcgccgacgcctccaacctgaagatggccgtccagcagggccagatcgacgtggccaaccgctccctgagcccgaccgacatcgaggacctctccaaggactccaaggtcaaggtcgtcaagggcccgggcggtgaggagcgcttcatcgccttcaacttcaagattcagccctacggcgaatcccagcccgatgccgacgccaacaaggccaaggccgtgcgccaggccgtcgccaacctcatcgaccgcgaagagctctccaccaaggtctacaagggcacctacaccccgatgtactccttcatcccggacggcctggccggtcacgatgacacgctgaagtccgcctacggcgacggcaacggcaagccgagcaccgagaaggccaagaaggtcctcgccgacgccggcgtcaccaccccggtcgacctcaagctccagtacaacaacgaccactacggctccgtctccgccgacgagtacgctgccctgaagtcccagcttgaggcaggcggcctgttcaaggtcgacatgcagtccaccgaatggacccagtacaacaaggatcgtgtggttaccgacgattccgacggtgtgtacccggtctaccagcttggatggttcccggactactccgacccggacaactacctgtccccgttcttccgcgatggtaacttcgtgaacaacggctactccaacaaggaagtcaacgacctgatcgtcaagcaggccggcgagaaggacgagtccgctcgtggagacatcctcaagcagattcagaagctcgagaccgaagacctctccaccatcccgctgctgcagggtgcccaggtcgccgtcaccggcacctccgtgaagggtgtcaccctcgacgcttccttccgcttccgctatgcctccgtcaccaagggctgatccagcatgagctcccctctttgagggggggggggagctgtctgccgacggcagactgaggggagtccaactcgtatgactcccttcagtctgcttcgccgccagctcccctcggagaggggagcctttattgctttatataccgattaccaacaccaaggagcatcgcgtgtcagacagcgccgcagcgacctccagcaccactccggcgaaagccaagacgaagaagaaccgactgtcaggtagtttcttccgcttcgtgctgacgaggttccttctcattattcccaccgttttcattctggtcaccatcgtgttcttcgtgatgcgcgccaccggcgacccgatttccgccgccttgggcggccgcctgacacccgccgaactccagcagcgcatccacgcggccggctatgaccgcccgctgattgtgcaatacgtcgactatcttggcggcctgctgcacggcgacctcggcacgacgctgaccgataaccagccggtgatcagcattcttacgcactacggcgccgccacattcgaactggccttcctcgccctgattgtggcgctgattgtcggcatcggcctgggccgactcgccgcccgcaagcgcgaccgtgccgccgatgccggcatccgcaccttcgccatcctgtgctacgccaccccggtgttcttcctcggcctggtcctgaagctcatcttcgctgtctggctcaacatccttccagcctccggccgctccgacctgaactccgaaatgcagttcacccgtctggtatcgccgactggcttctacatcatcgacgccatccagctcggcgacatgaacgtgctcgtcgacgtgctgcgccacgccgtgctgccggccgtcgccctaggcctcctgaccgccggcgtgttcatccgtctggtacgcaccaacgtcatctccacctacaattccggctacgtcgaggctgcccgctcgcgcggcgtctccgaaaagcgcctgctcaacaagcacgcctggcgaccggccctgatcccgatcatcaccgtcatgggcatgcagatcgccctgatgctcgccggtgcggtcctgaccgaaaccaccttcgaatggaagggcctgggcttcatgctgtcccagtacctgaaggcccgtgacttcgtggccgtgcagggcatcgtgatccttatcgccatcatcgtggccgtcgtcaacttcctcgtcgacgtcatcgccgcgcttatcgacccgagagtgaggtactgagatgaccaccgcatcccaagacaagatcaccgtccccggtgacgaccgccttaccaagctcaacgtcagcaccaagacgccgttctggaccaagatcccgatcatcaaggaactgcgcgtggcggtcggctggcagaagggcatgctgatcaccggtctcgcgatcaccgcgttcttcctgctcgtggccctcttcgccccgctgatcgccccctacggccacgcccagatcaaggccgccgacggcacgtccttcccggcgcaggccgcaccctccgccgaacacatctggggcaccaccgccgccggattcgacgtgttctcccgtgtggtgtggggcgcacgcaccgccgtcatcgccatcgtcgtggccgtgctgctctccatcttcgccggcgtgctgctcggcctggtctccggctactacggtggctgggtggaccgcattctggtgatgatcgccgacgccgtctactccttcccctcgctgctgctcgccattctgatggccatcatgatctcccacggccagtccggcctgtggagcggcattctggcttccggcatctccatcaccgtggtgtacatcccgcagtatttccgcacaattcgcgccgaagtgatccgcatcaaggaatccgcgtatgtcgagtccgcgcgcgtggtcggcgcctccacctggcgcatcatgaccaagcacctgttcaagaactccacccgcacgttgccggtgatcctgacgctgaactcgtccgaagccatcctgaccctcgccggcctgggcttcctcggcttcggcatcgagccgaccgccgccgccgaatggggctacgacctgaaccgctcggtttccgacgtgaccgccggcatctggtggactgccgtgttcccgggcatcgccatcgtgctcatcgtgctcggcatcacgctcgtgggcgaatcgctcaacgatctggccgacccgcgtctgcgcgcccgcaagtccgccggcgaagtggtcggatcgatcgaagacacgtccgtcgacccaaacgagaagccgaccgcacgcaacgaggtgattgccgaactcgacgcgaacgtcgacccgccggccaccgtcaccgaccatgacccgaccatcgtcgcctccgaatggaccggcgagggcaagccggaaggcaaggagtgagagatgagcgaaaacaacaagaatctcgccgatatcaaggacctgtccgtctccttcatgaccgacgccggctccatcaaggccgttgaggacgtgaacttcaccattccgcgcaagaccgtggtcggcgtggtcggcgaatccggttccggcaagtccgtgaccgcgcgctccatcatcaagctgctgccggagacggccaccacctccggtgccgtctacctgtccaagcgcgatggttccgattcgctggacgtgctctccctgagcggcgaacagctgcgcgaagtgcgtggttccgaggccgcgatggtgttccaggagcccaattcggtgctgaacccggtgtacaccatcggctggcagattgaagagggcctgcgcgcccacggcatgaaggacaagaaggaactgcgcgccaaggccatcaacatcctgaagaaggtcggcatcccggatgccgaaacccgcgtggactactacccgcaccagttctccggcggccagaagcagcgcatcgtcatcgccatggcgttggtgctgaaccccggcctgattctggccgacgagcccaccactgccctcgacgtgaccgtgcaagccgaaattctcgacctgctgcgcctcgcccgtgacgagttcgacgcctccgtgctcatcatcacccacaacatgggcgtgatcgcggacatcgccgaccaggtggtcgtcatgtaccgcggccacgtggtcgagcagggcgacgtggagcagatcttctaccatccgaaggacgactacaccaagcgactgctgggtgccgtgccgcgcatcggtcagaagctggtcgtgcgcgaccgcgagggcaaaccgatcgagcgcaaggccgattggcgcgaacagccgatcgccgtcgaggccaagaacctgaccatcacgtacccgggccatctcatgcagcccgacttcaaggccgtggacggcgcgaacttcaccatccaccgctccgaagtgctgggcctggtgggcgagtccggttccggcaagtccaccaccggccgtgccatcgccggcctgcagaaggtgtccggcggctccctgaacgtgctcggcatcgagatgaacggcgtcaaggagcgtgacttcaagcccaagcgcgcggacattggtttcgtgttccaggatccgggctcctcgttcaacccgctgatgaccatcgcggagaatgtggccgagccgctgctcgtgcaccacaagtacggttccgtggccgatgccaagaactatgtgggcgatctgctggagatggtccagctgccgcgcgcctacatgaaccgtttcccgcatgagctgtccggcggccagcgccagagggcgtctttggcgcgtggtttggcgttgaagccgtcgctgctgatcgccgatgagccgacttctgcattggacgtgtcggtgcaggccaaggtgttggagctgttcaagcgactgcaggcggaaatcggcttcgcgtgcctgttcatcacccatgatttggcggtggtcgatatgcttgccgaccgcatcatggtgatgcataagggccagatcgtggagcacggcgatgccgaccagattatgcagcacccggagaacccgtacaccaagaagctgctggcctccctgcccgtgcccgacccgcgcgaacagcagcaacaccgcgcccacctccacgagctcctagcccaagaggcgtaatcgcatagcattggagctccctcgtcagagggagctaactttatatccgctagtactgctgcccatcgaactggaacagggcgtgggcgtcgccgtgttttttgttctcgatgtaagtatggaacagctccagccgctcgctcgtgctggccgccaggggagtgggcaggtcatccagatcgaaccagccgacgctcaggctttcctcgtcgcctacgaacggctcggcattgccgccgggcttcagggcgcacaggaacgaatgatccatgtacatggtgttgtcgccattggcgtaggtcagtaccttgtttgacgaggtgacggccaccaaatcggtgacgatggcatcgatgcccgtctcctccttgatttcgcgcaccaccgtgtccgccggctgttcgcccggctcgttgatgccgtagaccatcgcccattcgcccgtgtccgaacgacggcccaacagcagttggccatgttcgttcagtacacaaccggtcacgccattgagccacaacagatcatggccgatcttcttacgcaattccaacacaaattccggagtggacacattgcctccttagtagaaaagaagctccctcatcagagggagcttaggttacttcgcttgggcagcctgctcggccatccaggcttcgacgtcgtcgatctgcttcgggatgccggcggaaatccattcggggccgttctcggtcatgagcacgtcgtcctcgatgcggatgccgatgccgcggtattccggtggaatcagcagatcatcctcgcggaagtacaggccgggctcgatcgtgaagatcatgcccgggcgaatcggcgcgccctgataggactcgaaacgggcctgcgcgcaatcatgcacatcaagacccaagtggtgggccacgccgcaggcgagccaacggcggtgctgctggccttgcggggacagcgactcctcgacgctcaccggcagcagaccccaatcgtgcagacgctcggcgatcacacgcatgcaggcgtggtggatgtcggagtaggtggcacccggcttggcggcttcgaaaccggcctgctgcgagtcgagcacggcctggtacagacgcttctggaagtcggtgaacttgccgttggtcgggaaggtgcgggtgatgtcggccgtgtacagggaatcgacctcaacgccggcatccaccagcagcatgtcgccggtcttcaccacaccggtgttgcgcatccagtgcagaatcggggcgtgggggccggaagccacgatggagtcgtaaccgacggcgttgcccagttcacgggacacggcgttgaacgcgccttcgaggatacgctcggagcgcggcttgtcgagcgcggccggcagtgcggagagcagacggtcgaagccatgcttggtggcgtccacggccttgcgcatttcgttgatttcgtagccgtccttgaccatgcgtgcctcggcggcgaactcgtgcagcttgtcgtcggatgcggagttcttgtccggatcggcgaaaccgttggcctcgcggatggattcaaccatcgaagtgatttgcgggtcggtttcgctgaccacgcgcacgcgtacggcgccggcttcggcacccacgtccttggacagggcgtcggccagctgggcgatgtcgtgggtttcgatgccggtcatcgcctgcatctccttgaggccagcacgcgggccaacccagtattcgccgtagtgggcggacatgaagaagtcctcggtggaattgtcggcgcgcggcgccacgaacagttccggagtgtgcgtcttgccggcggcggcttcgggggagtcggggtcgaccgggttcaggaccagcacggcgccggcctcgtaatcggaacccagaccggtgtagtaggcgaacgtggtgtccgggcggaacatgtaatcgcaatcattgttgcgcaccttcggctggccggccggaatgaccagacgttcgcccgggaaggccttgcccagcgcctcaaggcgggctggcgtgaacttggaggattcgagaggattggtctccggatcatcgtcggcccagccggacttcatgaactccttgaatgcggccgactgcgggcgcagcgagcggttgttcacgcggtcgctcatcgactggttcgcgcccggtgccgtagcgcgctcttcggcctcatattccttgtccttggcggtgatcacttcacccattgccactctcctgtatgtagttgttgtcgaatcatcgattcccacctcatattagtcggctttatgcgatgtgccacgattgacggctgacggtaaaaccaagtacggaatttggacggtcttccggacatgcccatatggcgagtgcggcgggctggaatgcgggcccgtttattgttctcggtagggaaggagaggggcatgggcttgggctggagcttgccgattgatattgacatattctgtgggctgaatccatgtgaacccatgcgatgaaggtttatcgcgtcgcgggactcactgctatgcggaggtctccacctgaggcaccccggctttgatcagttttacccgcagcggagtacgttcgatgacgtcggcgtatgtgaaatggacgatttcggtggcaccggctcgtttcagtccctcgtcgcgtgcgcgttccttggccaccacctcctgaatgctgcggttatcggtcatggctgggtccacgtatttttgtgtgccgtcgtattcggccactatcacgcgcccgtcatcgagcttccatacgaaatcaacgcggtactcggtattcgtctgtgggtcggtcaccgttacctgaatacgcggcgtgaggaagcgatcttcgatgatggtgcctcgcgcgagggattctccaccattctcgctcctttcgtttgcatagcgcagcaggcggaatactcgggcataatcgattctccattgaacgcagtcggcggctatctcttccttggttattcccttggcaagggccgagtcaaagatcggtaacgcaaaccgaaaatcaaggtctatagcggcctcgaccaaggttctagccggtgatatcagggataggccggaggcctcgtaatgtgtcttcggattgttcatatcgggcatatagacatgtcgtaagcgctgatggcattgacgagatccatgatcggaagtcacgatggttatgcagtcatcatgcaaatgccattgatgttcgaatccataggcacttactgccaccaagccgccaaaaacccactgaggatgctcttgcgcaagagcgcgggccatatgcaacgttcgctccggcggcgtcaaaccatcccagtatgcagtatttgcataaagactgggaatgccgtcatacactttcaacaactcaccactctgggcacggcggcgtagagcggtctgttccgcttcatttcttgaatagacgcatctcagctcattctgcgcggctgatatgagcgaggccactgctttgtgtgtcttcatgacgtcgagcgtagccggaacgaagcagcgtaagtatgaatttcagccattgtggttctagcctcggagcttggctgtcttggagcgagatactcccgataatttcaaggtattaggccgctaattcggaatagtggataacacacaaaacttatccaccatcagtaatgttattcgaacaacgtgctttgtggattcgaacaagatatcatcggcgaaggcggatgtagctggtagagggcggcgaattgacggttaacggtgcttatgctttgtacgccgtcggtgctggttcagatattggctggcttctgtctgagtgtggaatctagcgtcggcgtgagtccaatggttgtatcgtggccgacgatttgctgcgatttattggcggcatagatccagggcttggacggctgccgacggtgagagcagtcataacagtgaatgagcctctgcgagttcaaaagatgatgtagaggacgtttgtgagagtcgtttccggggcaaggcatggtcgattgacgacgttgaaatttctcaacgacggcagaatggcatgccttggcgaggagacgacactgagaggcgatggagtcgggattaatccaggttttggccagccaccgactcgcaagagcatcatagcgtcggtgtaccgccagaagctggcactgtaccgacgctgaatagcatcagcgtcgccggacatacaagttttggattgcagccgactaagaatgagatgccgacggcaagagccgcattgcaactatatgagacggcttcactgtgcgtggctgcaggtagagactgcccgcgcggcggcgacatatgagacggtttcactgtgcgcgcacgataaaccaccccggcggctaggatagagggaattgagggagtgcggctccacgcgtgaaggcaagaatcccgaaccatgcggggcaaacctgtgcaaggggagcttcctgcgcatgcggaagcggaatatatgcgggcatgcgtagacatgacgagaatggcgcgaacacgtaagtggcatacgcactccgaacggcgcaacagcaacacgagcagaggttagaagaggatatgtcattcgagcatccgaatcggaacaatgagagcatgcgggacgtcgaactggacatcatgagccgcccgccggagcataacaccaccaatctggatctcgaccggatgaacctgatgctcgacatcctgggccacccggagcagtcgttccgcgtgattcatatcaccggcaccaacggcaaaggctccaccgcacgcatggccgaggccatctgccgtgcctacggtatgcgcaccggcctgtacacgtcgccgcatctggagaagatcaacgagcgtatcgccatcgacggccagcagctgtccgatgacgatttcatcgacatctgggaccagaccaaggatctcgtggccctggtggacgccaagatggaggagcaaggcaagccgaagatgagcttcttcgaggtgctcaccgccatggccatctggaagttcgccgacacgcccgtggacgtggccatcgtcgaggtcggcatgggaggcctgtgggacgccaccaacgtgctcaacgcggatgcggccatcatcggcccggtggacatggaccacatgcagtggctgggcgacaccgtcgaacagatcgccaccgagaaggccggcatcatcaagccgaactgcaccgccatcatcgggcctcagccgcatgaggaagccgtcatgccgattctcgccgaagccgccgaacgcaaccacgccatgctcgtgcgcgacggctacgaaatgaccgtgtccgaccgtatggccgcagtcggcggccaggtcgccaccctgaccacgcccaacggcacttacgagggcgtgccgatcgccaagttcggcgagcatcaggcccacaacgcgcttgccgcgcttgccgcctctgaagtggtgattccggtcaacggtccgctggacggcgacttggtggccgaggcgttgagctcggtcaagattcccggacgcatcgaacagatccgcacctcaccgaccatcattctggatggcggacacaacgtgaatgccgccgaagccctgcgcaaggccatcgaggaaagctacgacttcaagcagctggtcggtgtggtcgccatgatgcgcgacaagcaggtcgaggaatatctgggtgttctggagccgatcctgagctccgtggtggtcaccgagaattcgtggcgcgagcgtgtgatgccggccgacgagcttgagaagattgccgtggacgtgttcggtcgtgaccgtgtgatcaaggaagcgaacctgcctgacgcgattcagaccgccgtcaatatggtcgatgccgaggacgagctgggcgtgggctacggccacggcgtgcttatctgcggcagcttcgtcaccgccggcgacgcacgcctgatgcttgaggagcatgccagccccacgatgaggcaggctatggccgttcatcagccggcagttgacccggacgattcggatcagccggcagacaaggccgaggatgaggccgccgacaacctcgaggattcggtgagcccggacgacttcgacgtgttcgacgtcctcggcctcggcaaggaacaggccagtgacgccggtaacgccggcaccggcacggccagcgccgacacaggcgccgtcaccgacgattccgccgacgtccggtaacccgcatccaaggcatatcggatacccggacacccggcatacggaaaacagtctcacgccatgtatctcaaggaactcaccctccgcggattcaaatccttcgcctccgtcaccacgctgcgcttcgagcccggcatcacggcggtggtcggccccaacggttcgggcaagtcgaacatcgtcgacgccctgatctgggtaatgggtgagcagggcgccaaaaacctgcgcggcacttcgatggaggacgtgattttcgcaggcacgtcctcccgcccgccattgggccgtgcacaggtgagcctgaccatcgataattccgatcacacgctcgatatcgattacacggaagtcaccatctcccgcaccatcttccgcaacggaggctccgaatacgcgatcaacggctcgcaatgccgcctgctcgacattcaggaactcctctccgataccggtcttggccagcagatgcacgtgatcgtaggccagggacgattggatgcgattctgaaggccgacccgtccggccaccgtgcgttcatcgaagaggccgccggcatcctgaagcaccgcaagcgcaaggaacgcgcgttgcgcaagctggccaataccgaaacgaacctgagccgactcgacgatttgctgggggaaattcaccgtcagctcggccccctcggacgccaggcacgcatctcccggcgcgccgacgcgattcagatatccgtacgcgacgcccaagcccgcctgtacgccgaagacgctcaacgctcgatgagccgtcgcgacacggtacgtcaagagcttggcgctgtgcgtaaccagctggccgtcgcccaacgtgaactcgcccaagtcaaagtacgcatcgaacaggtcgaggcgttgagctccgaatccagtccggccatcgccaaggccaaccaatactggcatgaattctcgcagacccgtgaacgactgaacgcgctcgcccagttggccgaagagcgcagccggtcactcgccggccagatcgtcaccaacttcggtgaggatcccggcatgcttgtcaaacgagccgaggaactggagtctcaggcagcggcacaaaccaaggccgtggccgatgcgcgcatcgcactcgacaaggccaccgaggaacgcgccgacgacgagaaaaagcttgcctcagtccgccagaccttgacggaactgcgcaaaaccgcacaggaacgcgatgcgcaaatcgcccgactgcgcgaactcatcgcccgcgaggaatccgccgtacaactggcgaccagccgcgccaaggattacgcctcccaacgcgactcgctgacttcccagcgcgacgatgcccagcaacagctggacgcattgcgcagcgaagcggactccattgccgacgatgacggtgccgcattggacgccgcacgtgcaacgctcgccgaatgccgcgaacgactgaatgaacgcgccgataagcagcgcgagatacagtccaagatcatctcgctcaaatccaaggccgatgcgcttgccgacacgctagacagccgcaatgcctccggatcgttggagcgcgatacggacgtggcctcgcttggccgactcaccgacttcatccatgtggccgaaggctgggaagaagccgtggcccacgcgctcgaccagtatgccagcgccatcgtggtacccgcggcaggcaacatgttgcacgccctcgaacgcgctcgggaagataagctcggcaaagccgtggtgctgaccgcgagcattgccggcgatcccgccacagagccgggcacggagtcggaggagagtagcgccgagaacgcgggggccgctccgcaatcgggcaacgcgctggcagcactcgtcaccgcgaacccggatgccgagaacccggcacagtccgaagcggtcgtgcgcaccgtgcgtctcctgctggctgatgtagccgcggccggcaccgccgacgaagcccaacagattgtggcattcggcgaagccatgcgggccgtcaccaagaacggcgagaccttcacacacggcgtggcggcggtcggcggctcttcaatctctcaatcggacctgtctctggccgcccgccgagacaaagcattggcacaggtcaaacagttgaccgcccaagacggcggaatggctgagcaagtggccgaggccaaaaccaagcgcgatgaagcggctcgactcgtcgaccaggaatccgccaaacgcaccgaagcccggctcaaagcccagcaggcggagaaatctctgaaatccgccacagatcgcgtcgcatcgttcacccgtcagctcgagcagctggataggaaaatcaccgagacccaagagaattgcaacgagcatcagctcaagcttgacgacctcaatcgcgctttggcatcggcccagcaatccacagcggaacatgccgatttcgacgaactcgatgaacgcgaacgcacgctggagcgcgaactgaacctgactcgcgagcatgaggtcgccgcaaaaatcgcgtggaccgaagcaagccgcaaaggggagtcactgagccgacaggccgggctgctgcgggacaacgccaaagaaaccgccgaacgccgcgcccgcatcgaggcgttgaacgatcgcagacgcgagcaggccgcacacctgcaaggcgtggccgatgacgcgcgagcagtggccgccatggtagagcatacgctgcatgacgtggccgccaaacgagacgagctgcaggccgccgcctccagccatgacgaggaactcaaggccctgcgcgcgcagcgcaaccagatcgagcccaaggtcaccgatctgaccgggcgcgaacatgccttggatgtaaaccgcgaacggttggccgccgaatccgggcagctcatgcaaaaagtgtccgacgaactcggtctcactttggaggaattggttagtgattacggccccgaacagccggtgcccgtgctggatgatgagggcaaccctgtgccgttggatgagacggaagctgaggctgagaccgaagagggagaaaccgggggagagaccggcaccaacggcgattccgaccgctttaagaccgtgccgtataaccgtcaggagcagaagaagcgtctcgataaggctcgccgcgatctggccgcactcggcaagatcaaccctttggccaccgaggaattcgaagcgcttgaggagcggaacaagtatctcaatgatcagcgcaacgatgtggtcaaatcacgtgacgatttgatgcagctcatcaaggatctcgattccacgatggtccaggtattcaaatccgcgttcgacgataccgccgaggcattcgagcagatgttcgccacgctgttcccaggcggcaccgggcgactgcgcctggaaaacccggaagacatgctcaccaccggcgtactggtcgaggccagcccggccggcaagcgtgtcaaacagctgagcctcctgtccggcggcgaacgttcgctgaccgcgctggcgctgctgttcgcgattttcaccgcccgccccagcccgttctatgtgatggacgaggtcgaggccgcgttggacgacgtgaacctgacccgtttgattaatgcgttcaatgagctacgcgcccatgcgcagctcatcatcattacgcaccagcaacgcaccatgtcgattgccgatgcgctttacggcgtaaccatgagagccgatggcgtaacagccgtggtgagtcaaaaactcgaacgataaatgaatggttcccgctgacaggaactggtgccacaggtgacagagggcggtccatatcgaaagaccgccctcagtttcgcttcgttcgacagctcccgccagcgggagcggggtggtattagcgcaatgccttgcgcacgccctgtacagtctgcagagtcttgtagaagaccttcttgatgggtacgtcgcgggcgggggccaccggggtgatttcctcggtgaacttgcacttgaactcgttaagccccttgagcgacggcgcgaaatcggagccgatgcccatcagatcgtattcagtaataccctgcgagcccaggatgcagcattcggaatacagcagcttgtcggtcacatgcagacgcataacctcgttgcgcatgccggcatagtagcgcaccgcatgtgtgccgttcacggtgacaatcgaccatgccaccacacggtcttcaatacgtgcggcgaacacacggcaatgatcggcacccaacgcgccgatcatatcggagtagtcgctcatcggagcaggcgtgaatccatcgcgctggccggtctcgaccatcacatcgtaatattcggagaaatcggccagcgccttatccgtctcatcggcaacctcggccgggcactcacgtagagacttgcgcacgtcacggcgtccacgacgcttcatccgagccagaatctcatcatcgccaccggtgacgtcgatgaccacggtctggtcgtacggcactgtggacagcaccttctccgtaccatcggcgaaccaggtgtcgatacgcaggaacgcgatgttcttgtcggccttcttgacggtgtccacgatggcgtcgacgacctcgcgctcctcagcctcggtgggcttggcgacccacgccggcccatgcatcgagcgcagataatgataaccgtgcgtctcaaaatcgataaaggagatcacggcgaccaattcaccatcacgcttgatcagataatcgccccatggtgtgcgtccgtcgatatccgcctgaaaaccagaccaaaccttggtctgttcgataggcaacgtgatgccggccttctcggcctcggcttccagtgtggctccgtcaactttctccaacgtgatcattacgattcagctatcctttttcgttcgtatccgtatgtcgtgtttctggtttggtcgtattgcgcgtgatctgatgtgggccaatcgggatccgatcaggatctgattggccggaatcccgtcacaagccaaacatgcgttcgaccacgtgatcgtcgccgtcgaacggcacatgcttgtgatggtccttgatccaacgctcgttgcccttgccgatgatcagcaggatgttgaatcggtcggcgtgcgcacgggcatcgtagatggcgttggtgatggccgtcggacggtcggaaatcaccgtggaggccacatccttgttcgtgatgtagccttgcatttccatgcagatgtcgatgaacggctcggtgtccgtatcttcggcggtgaaaatgaagttcgcgatgcggttctcggccgcctcgacgatttccttacggcgatcgtaggccttgttgccggccgatccggtcaccagcgtgatacgcgggttttcctcgccccaacgctcgtagacgaagtcaagcagcgcggtgacggatgcgtagttgtgcgcataatcgacgatggcgagcgtgttcgactgcgggtcgcggaactgttccatacggccggcgatacgtacggattcgatggcgtgcagtgcgtcggcgtcatcgagcgatacgccagccgcatgggcgatggcgatggccgccgccgcattgaggtagttgaagtcgccatcgatggacagatggtagtcgccaagggcctgatctccgtcggcgatgtggaaggaggcgtgctccgggtcggcgggccaggcgacgacgtccgcactggtgccggcattatccgcgtcatgcagggcgaaggtggttgcgccgatgccggctgccgccgcgtcctcccgcaacagatcggcgtgcagactgtccgcgccgagtaccagcgacttcgcgttggcgatgatctggcgcttgcaatacaggtaatcctcgaacgtggggtgttcgatcgggctgatgtggtcgggggagatgttcaggaacgcggccacatcgaaagtcaggccatagacgcggtccaccttgtacgcctgggaggagacctccatcaccagatactccatgccgttatcggccgcctcgcgcatcatgcggaaggcgtccatcgattcgggcgtggtcagatcggactcaacgtaggtgtggccgtcaaggcaattatcgaccgaggagaacaatgcggccttgccaccggagacggcgttgataagcgcctgcgtgaagtacgaggtggtcgtcttgcccttggtgccggtgacgccgatgaccgtgagttcgttctgcggatatccgtagaacgcggcggacagcaggctcatcgccttgcgtgcgtcgttgacgatcaggccgggggcggcggttgcggctgagtactcggtttcggccacgtatgcggccaggccggcttcatcgatgccgttcagatactcggccttgaatcggcccttgcagcacagcagggtgcccggcgtgaccttgcgggtgtcgtaggtgatgccggcgaacggttcatccgccgaagcgatacgggccgggtcgtcggtccagacatccccttggatgatttcacgcagcagatggtgttccttgagcaggtcagcggccgaagccaaagtcaaagccataattgtttctccctattatctagccgatacgccattctacaggtggggtgcagcgtgttgtggctcacacgtcatcgaccacgatatgggcacatgatttgattagaatggtgaaacgtgacgacaagcgaagcaactatgcaatccgggcagtcagccggatcgggcgagtccatggcagccaagcgcgccagatttgaacagctcgccatgcccgccgtcaatgcactgtaccggcaggcgatgaggctgaccaacgatcccgatgacgcgcaggatctggtccaggacaccttcgaacgcgggttcaaggccttcgactcattccagccgggctccaacttcgaggcgtggatgaccaccatcgagcgcaatgcctacttcaaccagtatgccaaggccaagcggcgcccgcagcgtgccaacgactccaccggtgaatacgacgactgggacatttacgatgccgccgaacatacgtcggacgggctcaagtccgctgaagaggaatatttggacgccttcgcgcccgaggaaatcatggccgcgctcgccaaactctcgccggaacgccggcaggtgttcatcgacgccgccatcgacggcaagtcctaccagcaggtggccgatgagcagggcgtgaaaatcggcacggtgatgagccgcctgaatcgcgcccgcacgcaactcaagcgtgagctcgcctcgtatgcgaaagagcgcgggtacgtgactggttcgtcggctggttcaccatccgcgaagttgggcgaaaacgttggtcgaatcgccgattccggccataatggaagtagtgaacaaactgttggtagcaatggcgacacgcaagccgcagtgagacatagtcatgcgactggcgcccgcacgccacaacagtcaagcaagctttcgggaaaggagatctgatgaacgatcagccggtagagcgtactcgccatatctccataacccgtacgggggccgatggcatggtcagccagaccgaagtgcatatcacggcggtgcatcatcgttcagtggataccggctcggcctctgcgtcggtccaggcggacgtgcatatcgttacggagggcgactgttttgacccccgtacctgctgcgacgagcgtgaacaggcgttgattgccgcgttgcgtgcctacttgcgcccggatgtggcacccgaatgtctgatagcccggctcaaggccacgcttgatcactgctgcggcgaagataagtaacgacatatacaacaaggcccgtctgatgtatcatcagacgggccttgagcgttccataagaaacgcgaagaatcaggcgttaggacgcttgccgtggttggcggccttcttacgacgattcttgcgcttacgtccgcgcatgcccatgatggactcctttgctgcagtaaaaaaaataagccttcggaattatgccacatgagcacgacgtgatgcaacacgggtgtccatgtggcgatgagcgtcaggcttggctattcggtttttcagatttgttcggcgtggaaggtgaccacggtggtgtagtcatcgcccggctcgagcacaaccagatccttgccggtgcggaaggcgtcggcgtaggcggtcatcggttcgacggccacgccggcctgacgagccttctcgccgatttcgttgccggtgcacacctgccaggagttgatggtcttgtcgccagtcagcgtgaccttgatgccgtcggggcgggtgaacacggcggaagtgctgccgtcttcaccgcggttggtgatatcggtccaggcatcgtcgaagccacgtccctccagcgtggggttatcgcgcaggtcgaagatgccggaaaccggctcttcaccggtgggcagcaagtgttcgtctacggtcacgtgggtgtcgcagtgcagctcaagacggcagggctcgttgtcggcggtaatggcctgaccggtggcgtgcttgccgttggccagccacgggtggatgccaaatgcccacggtgccttcacgctgtcgttgttgtgcacggtgaaggtttccgtgagaccgttctcgtcaagtgcataagtggcggtgatggtgatatcaaacgggtagccggcgatgtcgggggagcgccaggagagcgtcacgtgtgattcctgcaaatcaacgagctcccacatgtagcggtaggcatagccgtgcagggaggattggcggtcgaactcgtcgatcggcatctggtagtcttcgccatcgaaagaatactgaccattggtcactcggttcgggtacggtgccagcacccagccgttgcagcagggaatgaccttgttcgggtcgaaggggacgatgaggtcttcgccgcgccacttcagctcgcgcaggctggcacccagttcggtgacgacggcactccattcgccggacgagatgacatattggttaccagtgcgaggcttcaaagccatagtgcacactcctttgtggaacaaattgttatcgctcacaatcgtatcgcataagtcccaagacgcggcggcacataaggataaaaaattggctcccctctggaggggagccagcgtaacagaactacttctggactacttcgtagcggaccacagtggtgtagtcgccgttgggggcgagcgtcaccaagtggtcaccagtgcggaaggcattggccggggcggtcatcggctcgacggcgatgccatacggatgctcggcgaacggtgcgccagtggcggtgtagcactgccaagcattaatcgtctcatcgccaatgattttcacttcgataccgtccgggcgggtgaatgtggtggtggtcgtaccatcggcggcacgctccacgtcaacccaggcatcatcaaaggcgcggccttcgagcgtcgggccatcgttcaggtcgtagataccggtaaccggttcggtgccggtgggaatcagcgcctcgttcaccgtcacatgactggcggccttaatctgcaggtggcaggcggcggagtcggcatcgcgttcggcggcagttgcgccctgcttgccgttggccagccacggatgcaggccgagagcccacggtgccggttcgtcgccatcattgcgggcattgacggtcgcggtcatgccgttgtcgccgagttcgtaggtgacggtcacggtcacatcgaacgggtatccgtccaagttggggaagcgcagcgaaagcgtcacggcgctatcggtcaacgattcaagcttccacatgtagtggtaggcgtatccgtggttcgcattgttgcgcggtgcgggatgatattcgttaaccggcacgcagtaatgcttgccattgaaatcgtattcgccgttttcgatgcggtttggccacggggccagcacataaccgttacaggtgggggtcaggtcgttgacgccgaacgggcagaaaatttccttgccttgataatcgaatcggcgaatcttggcgccgagttcgcagatgacggcggaataatcgccatagtgaatcgaatactgatttccggtgcgtggtgttttactcgtcatggaatcactcccgtagtgaggttggtgggccggtagctcctgctatcgctggccccagtctagcgcgtctcctctatcgaggcggggattggcgatatgcggcatataataaacaattcgtataaacacggtagcaatacgtggagtgacgagtctcacaccatcatgcgagaagcacgtggattccttggaaaccggtgatttgtgggagacgcggaaaagttgtgacggcagattcctgtaatccctgccttacactggaaaacactattgacgttcaggaggttccgatgaccaaaagcgttgtgctcgctgatccgcgaggcttctgcgcgggtgtggaccgtgcgattcttaccgtacagaccattctcaaagccgcggaggcttccggaaagcggacgcgcgaggatgggctgcccccggtatatgtgcgccggcagatcgtgcacaacaagcatgtggtcgaggacttggccgggcaaggcgcggtgttcgtccaggaattggcggagattccggatgctgctgcccaagcgggtattccggtggtgttttccgcccatggcgtatctccggtagtgaaggcggaagccgaacgtcgtggcatgcatgtggtggatgccacctgccctctggtgggtaaggtgcaccgtgaggtgctgcgtttcgtgcgcgaggggtatgaaatcgtctatatcgggcataaaggtcacgatgaagcggtcggtgtagtgggggagagccccgaacacgtgcacttgatcgagcatgaatcggatgtcgattcgctggattttgcgcccgacaccaagctggtgctgctctcgcagaccacgttgagcgtggacgagaccgccgataccattgccgcgctgaaggccaaattcccttggattcaagagccgccgagttcggatatctgctatgccacgtcgaatcgtcaggctgcggtcaaactggtggcccagcagtccgattgcgtggtgattgtcggatcggccaactcctcgaattccgtgcgactgatggaggtggcgcaggagggcttgggggagcgcggcaaagcgtatcgcgtggatgatgccagcgagcttgacccggcatggttcgagggtctggaatccgtaggtatctcctcgggtgcctccgtaccggacgaactggtgtccggtgtgattgacgctctgcaaaacttgggtttcaccggtatgaagtccgtcgaaaccatcaaagaaaacatgcactttgtgctgccggcggagttgcgcaggaagaagtagtcattcttggctcccctccgtgaggggagccaagaacggtcaccacgtgccgattggtgcggcaacggcgttcaagaccttgagcaggtcctgtggattcacgcccacagacaggcctcgcttgccgccggagaccagaatttggtcgaattgcagggcgctttcatccaacacagtcttatgacgtgtcttctggcctaacggcgagatgccgccaaccacataaccggattcacgcatcgccgccttgggatcggccatagaggccttcttggcacctacggctgcagccaaggctttcaaatccatatgaccgctcaccggtaccacgcccaccacgcgttcggcaccggtgtccgccatcaacgtcttgaacacctgatgctcgtcgaagccgagcttggtggccgcctccacgccgtagccgtcatccatatggtcgttggagtgctcgtattcgtatacgtggaattccacgcccgccttctccagttggactgtcgccggagtggaacccgcgcccttatcatgcttgcttttctttgccatgattaccgttctactacgaagaaacccccgcacaaggcgggggtctcacagcttagtcctcaaacgaaccgtagcggcctagaccgcaatggttcactcggagatctcagcgaagtacagcagggtacggatcatgttggaggtgaagccgtactcgttgtcgtagaaggacacggtgcgagccagggtcacgccatcaatggtgttgacgtcggtctgggtcgggtcgaacacgccaccgtgggtgtcgccgaggatgtcggaggagacgatgccctcatcgttgtagccgtagtaatcggtgtcggagaaggcggccttgaaggcggcgttgatctcgtcggcggtggtctcggtgttcagcacggtggtcagctcggtgacggagccgtccggaacctggacgcgctgggcgtggccctgcagcttgccgttcacggacggaacgaccttgccgatggccttggcagcgccggtggagtgggcgatggtgttgatggcggcggcgcgcaggttgcggccggtcttggtgccacgcgggccatcgagcagcatctgggtgccggtgtaggcgtggatggtggtcatgaagccggccttgatgccgaacttctcgtccagcagcttgaccatggcggccatggagttggtggtgcaggaaccggcggagacgatcacgtcggaagccttgaggatgtcgtggttcacgccgaacacaacggtcggggtggtgtcatccttggccggggcggagatcaggaccttcttggcgccagcgttgatgtgagcctgggacttctcggcggaggtgtagaagccggtgcactcgagcacgtactcaacaccgtcgttcttgacccacggaatgttgttggcgtccttctcggcgtagaccttgtattccttgccgtcgacgatgatggagtcttcggtggccttgacgtcaaccggagtgccatcgtcatgacggaaggtgccgtgggtgctgtcgtacttcagcaggtaagccaaggtagccggggtggtcagatcgttgatggcggcaacttcaatgtcaccagcctggccgccgcgagcctgcagctcgaagatgcgacggaaggcgagacgaccaatgcgaccgaagccgttgataccaatcttaactgtcatgtaattctcccttgtagggtggccttggcgcgctttggcacaccgggccattgtttaccaacagttgctactgtaatgccgactctgtacacatggcaacgtttcagcgtgcgttttgggcaaaaatgccgtattttctgtgagcgctcacaattcggattgcccgcaaccgacatgtgtttttcctctcctttggaggaatgtctcgaatcatcatgagcaagcgcgcggcatgcaagtcagcgaaccagcagcttggacactgcggtgtccagctcgccgatatcgccgccaaattcgtggaatcgactcacctgaggcaacgccacctcgatggggaaggtgacgatcagtgtgccgtgctccacgctgatggccgcgtccacgccgtcgcggaactcgttgctgcccccctgcaccaccgtattggtcagcgtgccgtctttaagctcgtatttcagccctggttcgttcacgccaagcgaaacatcggagtgggagaacgccgacaccatgcggccgtcctcgggcaccggatgcgcggggaacgaaagcctaccatcggtgatggccgtgacgatgagcccgtcaccatacagatacccgcttgccccatgccgggccaataatgccatcagttgaatgccggaaatcgtatggtcaatgcggccgcccaaaccgccatagacatggaattcgcggcaacccgccgaccaaccgaccttcagcgcggagagcatgtccggatcgtccttcagcgcgggcagcgcgatggtgcgcacatcggtgcggggcggccggccctccagcgaatcgaagtcgcccaccaccacattgggcacgatacccaactggcgcgtatggtcgagcccgccatcggccgcaatcacatacgcgccggccggcaccacgggcgtgcccgcatagtattcgcccgcaccaaaaatcacgcatacctgagtcatgatgcctactgtagccggtatccacccatcggccgggaaaatgctgataggctacgcatcagaacagtagtcgataggcgcacaggcaggggagcggagcgatggcacagatcaccgaggcaagcgaacggccgattctcaaatcaaagatattcctctacatcaccgaattcttctccggcatgtccgctgatctacttcatctcgatcaaggccaagcgcatcgcctgcgtggtcagcgccgtgatcttcgtggccacgtcctgcgtctcgcccctgaccggcttcgcgttctgggaaaccaacctggcctatgagggcgagtccatctacaactacctgcaggtcaagaacctctccgaccgcacgatcctgtccaccaacgtgctgttcggcgtgcagtccgtcacgatgaaagacaaaggactgacaggtatgtactacgacacggccctggctgcgccggcgctcgccgacaatgccaattccgcgctgatcctcggcatgggcaccggcacctacgcccgccagctgaagcagtattatccgaaaatgaacatcaccggcgtggagattgaccagaagatcaccgatctggccggcgaatacttcgatgagcccgccgacatccccgtgaccacgtatgacggccgagcctggctcgccgcctcgcatgacaagtacgacgtgatcatggtcgatgcgtatcaggacatcaccattcccttccagatgagctccaccgagttcttcaccatggtcagagagcacctgaaccccggcggcgtgatggtggtgaacatgaacatgatctcggacggccaaggttcgatcaacgaggcgttgagcgataccatcgccagcgtgttcggcaatgggaacatactgacggccgacgtgccgaacaccacgaaccgtgaactgttcgccaagaagccgggttccggctccgaagagaactccatgcagcaggcctccaaggcgctcaacctgcgtgagaccacctacgagcgcaccggcagcgaagatctcgaatggtatatggaagaggtcgcctctcgattccggaaggtgaacgaaccggactcagcgtcgactattctcaccgacgacaaggcgccggtcgaagtactcggcatgcatgccatcgatcaaatcatcgccgatgagaccggcccatatcggcagattctcaaagacgaaggcttcggcggtctgctgcgcgccgtgcagtaggttcgacacacggaccgcgaatgtccgggcgtatggtagactttctatttggcttgagaaatcaagaaagcggggcaaccccacctggaagcctttcaaggcctcgggttcaaggcaaacagcctagcgattgcgatatacaacgcgtaatcaggaatgacgcaaagaactgatatgcgtctgcagaagctgagcgcatattggcgcgggctttggcttgccatgaacccaaagcattgaacaggactccagcaaaggccctcgccacggaattgaagtagaggattggagtcatcatcagcgacgaaccacgtattaacgacgagattcgcgtcccgcaggtacgcctgatcggcccgaagggcgagcaggtgggcgtcatcgcgacttccgtcgcgctgaacctggccaaggaggcaaacctcgatctcgtcgaggtggccccgaacgcgaagcctccggtcgccaagctcattgattacggcaagttcaagtacaacgagaagatcaaggctcgtgaagctcgccgcaaccagagcaccgcggaaatcaaggagattcgtttccgcctgaagattgacgaccacgatttcgacgtgaagaagggccatgtgacccgcttccttaacggaggcgacaaggtcaaggtcaccatcatgttgcgcggtcgtgagatctcccgcccgattggtggcgtggaactgctgcagcgtctggccgacgatgtcgaggaatacggcaccgtcgagtccaagccgaagcaggagggccgcaacatcatcatgacccttgcgccgaagggcaagaaggtgcacacccagtccgagcagcgtcgtcgtggcgccgagtcccgcgccgagcgtcaggctcgccaggcggctcgtctcgcggccaagcaggagtctcaggctcaggccgcggccgacgcgcagtccgcgatttctcagaagacttccgacaagaagcaaaccagcaaggagggcagcaatgccgaagatgaaaactaattccgccgcttccaagcgcgccaagatcaccggcaccggcaaggtgaagcatgtcggttccgccatgcgccacaacctcgagcacaagtccgctcgcaagcgccgtgaactgtccgccgacgatgtgctgcgcggcggccaggccaagaagctgcaccagcttctgcagaagtgagcatagggcttacccggaaataacaagactttagaaagctgaggaatagattatggcacgtgtcaagcgcgcagtgaacgcccacaagaagcgtcgcgttgttctcgagagggcttccggctaccgtggccagcgctcccgcctgtaccgcaaggccaaggaacagctgctgcactcctttaactacaacttccgtgaccgcaaggctcgcaagggcgacttccgcaagctgtggatccagcgcatcaatgctgccgtccgcgctgagggcatcacctacaaccgcttcatccagggcctgcgtctcgccggcatcgagctggatcgtcgcgctctggctgagatcgccgtctccgacccggacaccttcaagaccatcgtggacgccgccaaggccgccctgcctgaggacgtcaacgctccggttgaggcctgattgcttgaagtcgtgacttcacactagaaaccccgcttccgagcggggtttctttgtaccatgggcactatgaccaacggattcaccagactcaccgagcagttcctcgtccacatcggcgtggagcgagggctcgccacggccaccgtcaccgcctacgaatccgacatcgccaaatacattgattggctcgaaacccgcggcatccacgaaccggacgccataaccaaacaagacgtcgaagactacatcgccgcccttgaccaggcgggggagtccgcccgctccaaagcccgaagactggcctcgatccacgaattccaccgtttcgcgctcggtcagcacgcggtgacggcggatgtttcggccgcagtcaaggcgcccaaaggcgccagcaccctgcccgacgtactcaccgtggacgaggtaacccgtctgctcgacgcggcggcagtcggcggctcaaccgatccggtggtattacgggacaaggccctgctcgaattcatgtacgccaccggctgccgcgtctcggaagccaccggtgcgaatctggacgacatcgacctggacgagcacatcgcgcgactcatgggcaagggctccaagcagcggcttgtgccattgggcagttacgcatgccgggccatcaccgcatacctcaatgcggggcgtggcgagttggaacagcgctccagcgccaagattcccgagaggcgcgcactgtttctcaacaaacgcggcaagcgcatctcgcggcaatcggtatgggaaatcgtcaaagcaaccggggagcgggccggcatcaccaaaccactccatccgcacaccttgcgccattcctttgccacgcacctgatccaaggcggcgcggacgtgcgcaccgtgcaggaactgctcgggcacgccagcgtgaccaccacgcagatctacacgcacgtaagccctgaaaccctgatcgaaacgtatctgacctcacatcccagagcgcggtgagacacaccattttgcgacgcgtccgcccatagcggaatcgcggcgggggagcaccaaagtcggccggaaattcaaggcgtgacaatacagtacataacagcgaaccgtcagccaggaagaggtattcatgctgcagatcaaatcgatctcgaagcgctataaaaccggtgatttcgttcagcaggcgcttgacaaagtcagcctgaacctacgcgacagcgaattcgtcgcgattctgggtccctcgggttccggcaagaccaccttgctcaacatcatcggcggcctcgaccggtatgacgacggcgatttggtgatcaacggcatctcgacgcgccaatacaaggatcgcgattgggattcgtaccgcaaccacaccatcggcttcgtgttccagagctacaatctgatccctcaccagacgattctgtcgaatgtcgaactcgcgctgacgatttccggcatcggcaaggccgaccgtcgcgaacgtgcgcgcaaggcgctggagaaggtcggactcggcgaacacatcaacaagaagccaaaccagctgtccggcggccagatgcagcgcgtggcgatcgcccgcgcactggtcaacgacccggacatcgtcctggccgacgagccgaccggcgcgctcgattcggacacgtccgtgcagatcatgaacctgctcaaggacgtggccaaggaccgcctcgtggtcatggtcacccacaaccccgaacttgcggaacaatatgccacgcgcatcgtcaacctgcgcgacggcgtgatccgctccgactccgacccgttcgtcgtggacgagacggccgaacagccggccgtgtacaagacgatgggccgcgcgtcgatgtcgttcgccacgtcgctggcgttgagcttcaacaatctgaaaaccaagaaggcgcgcaccctgctgacctcgttcgccggctcgatcggcatcatcggcatcgcgctgattctatcggtgtcgactggcgtgaacacatacatcagtgacatccagcgtgacacgatgaccgcctacccgatcaccgtcgactcccagaccttcgacctgagcagcatgatgggcggacagatgggcggcgatgacggatacggcggcaagacgcacaaaaccgacggcatctacccggacgaccgcagcgtcaagcaggcgtccagcctgaccagttcgattaccgaaaacaacctgacccgcttcaagaaatacctggataattccaagagcgagattcaccagtatgtgggttccaccggcatccagtacacatatgacgtgaaattctccgtgttcgaccacgaccccgacggcacgctggtcaatgcggacggcgtgacgatcggatccagcgactctgcctcgatggcctcgcagatggcgtccacaagctcgtccggcatgtccggcacctcgtcgatcacctcgcagcagatgtcgatgctgaccggcaaaaccgatgagaacgccgcgcccgactcgttcaacgagatcatgccgggagcggacgacagcaagctcgtaggcaaggttatcaccgacaactatcaggtggtcaacggttcatggccgaagtccaaggatgaagtggtgctggtgcttgacgacaacaacagcgtgccgctgaccacgctgtacgagctcggcctgctgcccgcctccgattaccacgagatgatgtccaagctcaacgccggcgacaaggtcagcactccacaagacaagatcgactatgctaaggccctcgatcagacgctgtacatgattccggcatccgaccagtacgtcaagggcgatgacggccactaccgtttcatcggcaacgacaaggacgaaatcgaacagcgcctcgaaacggccaccaaactcaaggtggtgggcgtcgtcaaggcgaagaaggatgcttcggccacgccgttggccgctggtgtggggtacgcgcgcgctctgaccaatgatttgatcgaccgtgcggcctccagcgccatcgttaccgatcagaaggccaatccgaacacgaacgtgctcaacggcatgacgttctcgccctcggacgatgccaccaaggtggccgacgcgcgcacctacgtggcttcgctgggcgtgacgcagaaggcgaacatggccaagtcgatgatgagcgccgggcagcagtccggcacgggcgcatcggacgccgctggtgctggtgctgcaggtgtcgctggcgcggcgggtgccggcgatcaggccgccgccatggccgcgatgagcgaacagcagctcgccgacagtttcgacgcgtatatcgccacggcttcgaacgacgtgcttgtcgcgatctacgaccagtacgtgtcgaccggcacctacgacgacaacctcgccgcattcggtgtggtgagtcgtgacgcgcccagctcgatcaacatctacgccgacagcttcgaagacaaggaccacatcgccgacgcgatcaccgactacaacaacaccgtctcgaagaaagacaagatcacctacacggattacgttgggctcatgatgagttcggtgaccaccatcgtcaacgtgatttcctacgtgcttatcgcgttcgtgtccgtctcgctgatcgtctcctcgatcatgatcggcatcatcacctacatttcggtgctggagcgcaccaaggaaatcggcatcctacgcgcaatgggtgcctcgaagcacaacgtatcccaggtgttcaatgcggagaccggcatcatcggcctatgctccggcctgttgggcgtgggcttgaccgtgctgctcaatattccgatcaacgccgtgctacaccacttcatcggcaatgcggacgtcaatgccgccctgccggtgaccggtggcgtggtgctggtgatcctaagcgtggtgctcacgctgatcggcggcctgattccctcgcgtaaggcagccaagcaagacccggccaccgcactgcgcaccgagtaagcgcatcgacatagtacgagacgagatccataaacctcggaacactggaataccagcggcaaaacggtgttccgaggcgagcccggcgagtacattaggatgggcgagcaggtattcccgacaaagggggcgagggcaacgatggacgactggcgagatacccgcgataaagacagcgcattccgtcaaggaacgctgcctatgacaggaacgtatgtcgttgcacccccagcgaacccggatgttgataaggtagacagtatgcctaccgatttgcttggacgtgaatacgaaaccttccccgcacccgaaccgctgcaacagcacggtccggcgcgtgtcattgccatgtgcaaccagaagggtggcgtaggtaagaccaccagctccatcaatattgccggtgcgttggcccagtatggccgccgcgtgcttatcgtcgatttcgatccgcagggtgccgccactgtgggactgggcgtcaacgcgaataccgtggagaacacgatttacaccgcgctgttcgatatttccgtggacccacatgatgtggtgcagcacaccgcattcgagaacatcgatgtgattccggcgaacatcgatttgtccgccgccgaggtccagctggtcaccgaagtgggccgagagcagatcctgaacagcgtgctgcgcaagctcaagtcggaatacgatctcatcatcgtcgactgccagccatcgctcggcctgctcaccgtgaacgcgcttgccgcagctgatggcgtgatcattcccgtggccgccgaattcttcgccttgcgcggtgtggccctgcttatgcagtccatcgaaaaagtgcagtcccgcatcaatcccgcattggaagtggatggcgtgctcatcaccatgtacaccaagacactgcactgcgaagaggtctgccagcgcgtttacgaggcgttcagcgaaaaggtgttccacacgttcatctcccgctccatcaaactgcccgattccacggttgccgccgcgcccgtggtggtctatgcccctgagcacaagacatcaaaggaataccgtgaggtggcacgtgagctcattgctcgcggcatcgtggcgtaacgattgtttcgataaacgatgaatgagacttccctttctcggctcccctctctgagggaagctggctcgcgtagcgaggctgaggggagctccgcggaagccgaaatcagcacggaggaatccgccacttccggcttccgggtcaacctcgaagtctattccggtccgtttgatgccttgctcggcatgatcgccaacaacagactcgagctgaccgaagtttccctctcctcgatcaccgaggaattcctgacatacgtgcgcgggctcgatttcacaaaaaacatggatgaggccagcgcctttctcgatatcgcctctattctggtcgaggccaaaagcgtggcgattctgcccggcggcgaagacagccagcacgacgagcagagcctcgaagtgctgcgcgaacgcgatttgctgttcgcccgactcctccaataccgcgcctacaagcaggccgcaggtgacttccgggcgcgtatcgccgccaactccggccgattcccgcacccggcggccatggacgagggcgttgccgccatgctgcctgagctggtatggacgctgactccgctcgaactcgcccgactgaccgcccaggtcatcgccaacgcgcccgcctccgaagtgtcgatccatcagctgcacgtgccgttggtcgatctgcgggcccaatcgctggtggtgcgcgaccggctgatcgcggcattggaatccaagggcgaccagtcgatatcgttcagcgaattgacccgggactgcacttctcgtattgaggtggtggctcggttcatggccgtgctcgtgttcttcaaacaaggtgtgctgcagtatcagcaagatggtccgtttgccgaactgcacctgaggtgggtacccggcgtagccgaaatgatgagcgacgtgaacatttccgaaggtgattttgcgtaaggacggcgattggtgactgaacagattgacgcaacgaatacaaccgaacacatggcggatgccgaatcgacggctgaatccgcaaaggccgcggtgaggggagtggaggagactcaccccgaatacgtggatttcgcggtagacgattttcccggcgggctgcccgcctgtctggaagcgattctgatggtcgccgaccagccgcagaccgccaccgagctggcccgtattttggcattggatcgcaacacagtcgaagaggcattgcgagccctgcacgattactatgagggcgatgaatcccgtgacatccgcccgcgcggcttcgaactgcgccgcaccgctcgtggctggcagttcgccagtcgcgccgcgttcgagccggtcgtctcatcattcgtcaccgacggccagactgcgagactcagtcaggccgcactggaggcgcttgccatcgtggcctatcgccaacccgtcacccgagcccaagtggccgcgatccgcggtgtcaactccgatggagtgattcgctcgctcacggtacgcggccttatcaaggaagacggcgtggaccccgaatcccgcgcggccctcttggtcacctccgaattcttcctcgaccaaatgggtctgaagagtctcgacgaactaccctccctagcgccattcctcccgtccgtcgccgaaatgacacagtcgaaatcggaagatacggacgtgatttcgtagcgattggggcccgctgcctgaccaatattcgtgcgctagaccatccgatatgtgatttatggtcattgtgactataagtagtgctatgctctcaatgcagggagaacaaccggtatggaaagaggcatggcatgggattcggcaatgtgtccgagcgccgcagcgcaccgccacaggtcggcgtgtcagtggtgattctggcactcggcccggaaggcgataccggcaacagtgccgccgattccggcaacgccgcgaactcggcccattcccgtctctggttgcccctggtcaagcgcgtccgtcagccgttcctgggctgctgggcgttgcccggcggtgacctgcgctccgaccggtcgttggaacagtctgcctacgcggccctcgaatcgaccacagacctgcacccgcgatacctcgaacagctgtacacctttggaggcccgacccggtcccatggcggattgcccatggtatccgtcgtgtactgggcgctcgtcggccagaccgaggccgcgggcttcgaggacggtgacaacgtacgatggttccccgaagacgaactgcccgagctggcgttcgaccatcgccagatcatcgactacgcgctgctccgcctgcgctccaaaatcgaatactccgacgtggccacccgactgctcggccccacgttcaccctgcgccaactgcacggcgtctatgaggcgattggcggcgaacccctcgacttggcgaacttccgccgcaaaatgcttgcctcgggcgaccttgaagacaccggggagaagatgcgcgaaggccgccaacgaccggccaccgtctaccgctacatccccaaacgacctgtcgagaacggtacgccccacgaatccgatggtgacgacatcgtggaactgtccagacaaggcgagcgtgaagacgctctcgacgcgctgatcccatccgcgcgcatctgatttttcccgccgacccgcttcgggccggtatcacagacgtatataggaaaggaaccactatgaccgcactattcactgcgccgtccgttgacgagatcatcgccaagctgggcgcgcaaagcacctgcgatgcaggactgacccaggacccatggcacttcgacaccaccacacccagctacggtcccggtgcctcgatgctcgaccgtctgcccgccaacgcgccgcgccagcaggtgttgccggacgaataccgcaaggcctccgacgaggaactgcagcagcgcatctccgacgccaagcagcgtctcggctccaaactgttgattctgggccacttctaccagcgtgacgagatcatcaagcacgccgatttcgtgggcgactccttccagctggccaagaacgccaccgaacgcccggacgccgaccacatcgtgttctgcggcgtgcacttcatggccgaaaccgccgacatcctctccacgcccgaacagagcgtgaccctgcccaacctgtccgccggctgctcgatggccgatatggccaacatcgaccaggtccaggaatgctgggaccagctcggcgagatctgcggcacccagccggactccgatggcttgcagcagatcattccggtcacctacatgaactcatccgccgcgctgaaggcgttctgcggacgcaacggcggcatcgtatgcacctcttccaatgcgcacgccgtgctggaatgggcgttcgcccgcggcaagcgcgtgctgttcttcccggaccagcatctgggccgcaataccgcccgcgcgatgggcattccgctgagcgagatgccgctgtggaatccgttcaaggcacagggcggcgccgccgatccggccgattacgcccgcgccaagatgattctgtggaagggcttctgctccgtgcaccagcgtttcaccgtcgaacaggtcgaacgtgcccgcaaggcatacccgggcgtcaaggtgatcgtgcaccccgagtgctcgatgcaggtggtcgatgccgccgacggtactggctccaccgcgtacatcgtcaaggagatcgccaacgcgcccgccggatccgccattgctgtgggcaccgaaatcaacctggtgaaccgtctggccgcgcagtacccggacaagaccgtgttctgcttggaccccgtggtctgcccctgctccacgatgtaccgcatccacccggcctacctggcttgggctttggagaacctcgaagccggcaacgtggtcaatcgcatcaccgtggacgaagacaccgcccgcgaagccaaggtggcactggagcgcatgctgcgcgttcacccgtgattcgtccctggcgctcctcgtacatgaggggagctgtccgcgtagcggactgaagggagcagatgacgcaaaaacagaggaaagcaacacaatgagcaacactgaaatcgtcgtcgtgggcgccggcgtcgccggactgtccgcggcactggccgtggccggcaccggacacgacgtgaccttggtaaccaaggccgaactggtggaatcaaacacctatcatgcgcagggcggcatcgctgcagccatcttctccgacgacgacccgaagctgcatgccgccgacaccatggccgcgggccacggcctgtgcgacccgaaggccgtggacatcctcacccgtgagggtgcggagcgcgtccgcgagttcgccgcggccggcgtccacttcgaccgcgacgcgcatggacacatgctgcgcggcctggaagcggctcattcgcgcgcccgcgtggtgcatgccgggggagacgccaccggcaaagtgtttgaactggacgtctccgccatggtgcgcaagaacccgcgcatccacatcatcgagaacgccttcctcaaagatctcatcgtgcggggcggccacatcgccggcgtccacctgctgatcgacgggcaggacaaggatctggccgccgaccgggtgatcttggccgccggtggagcaggccgtatgtacccgtacaccaccaatccgccggtcgccaccgcggacggcctcgccgtcgcatggcgtgccggtgcccaggtcgccgatctggagttctaccagttccatcccaccgccatggccgtgggcgagcacttcctcgtctccgaagccgtgcgcggcgaaggtgcggtgctgctggatgagcatggccacaggtatatgaaggacatcgatccgcgcgccgaactcgcgccgcgtgacgtcgtggcccgcgagaacttccgcgtgatgcaggcgcaaggcggcaagcccgtgatgctcgacgtctcgccgatggcccgcgagaaccccgacctggccagcttcttggcccaccgattcccgaccatcgacgcctatacgcgttcgcttggcttcgactggagcaaggagccgattccggtggcgcccgccgcgcactactacatgggaggcattcgcaccgatctgaacgcccggacctccattcccggcctgtatgcggccggcgaatgcgctcgtaccggtgtcatgggctccaaccgtcttgcctccaactcgctgctcgaggggctcgtctacggacgccgcgccggtctggccgccgtcgcggacggtgacgacgcggtctgggcacccgaaccgttcctgaactccgccaccggtgccgtgttcgaccatgcgccgatcgcgctggccgcccctgccgctacggctgctgctgacgataccgccgccgacaaggtgtggaatcgtacccgcatccagaacaccatgtggcatggcgtcggcgtgctgcgcgacgaggccggactgaaaaccgccatcgccgaactcggccaaggcctcgccgccgcaaacgcccaggctgatgtaaacgccgatggtgctgcaagcagcgttgaggctttggagaaccgcaacatgctcaccgtaggctatgtggccgccaccgccgcgctcgcccgcaccgagtcgagaggcgcccacgcccgcaccgaccacagcgagccagtcgacaactgggcccactccgtcgcctacatcaaggactgacccatgctcacatcacacatcatccgcgtcgccgtcgaagcggcgctcgccgaagacgcgccctacggcgacatcacctgcgagaccaccatccccgcggacgaaaccggctcggcccacctcaccgcgcgcgaaaacggcgtgatgagcggcatcgacgtgttcgccgcagccttcgccgcacagaacccggccgtcaccgtcaccgccgccatcaaggacggcgagcgattccagcgcggccagatactcgccaccgtgaaaggcccggtacgcgacctgctcaccgccgagcgcatcgccctcaacttcactcagcgcatgagcggcatcgccaccatgaccgccgccttcgtggacgcggtgaacgccatctacggcgatgattatgacggacccgtcacccggccgcgccgctacgagcgcacccgcatcgtcgatacgcgcaaaaccacgcccggcctgcgcccgttcgagaaatacgccgtggtctgcggcggcggccacaaccatcgttacggactgtccgacgcggtcatgatgaaggacaaccatctggcggcgctcgccgcgcgcggcatcgacctggccggcgcgatccgccacgtgcgcgaacaggtgggccacaccacgcatatcgaagtggaagtcgaccgccttgaccagattcccgccgtgctcgccggcggagcggacaccatcatgctggacaatttctcgctcgacgacacccgtcgcggcgtggagctcatcgacggtaaggccatcgtggaagccagcggcaacatgagcctggagcgagtgccagccgtggccgtcaccggcgtggacgtgatctccgtgggcgcgctcacccactctgtgcgcagcatcgacctcggattggattggaactagtcatggccgatacccccaacgcatccggtgaacccggcgaactgtacctggacgccgccgccaccgaatcagtgagcccggcagtcatcgaggccatgaccccgttcctgactgaggcctacgccaatccggccagcgtgcaccagcccggcaaaaccgcggcccgcgcgctggacgcggctcgcgcatcatttgccgcggcattgggcgcccggccggatgacgtgatcttcacctcaggcggcaccgaatcggacaatctggccatcaaaggcatcgccatggcgcgcatgcgcaaactgggcttgcggccggtctgcggattcgccgaagccgatggcaaacagccggcaaattgtcgcccgcgcattatcatttccgctatcgagcacccggccgtggcccaatcggcggcatggctgcacgaatggttcggtttcgaagtcgtgcgcattcccgtggatgcgcaagcacatctcgatctcgacgcacttgaacgcgagctcgacggcgaggccagtgaacgtaccacgatggtctccaccatgctggccaacaacgaggtcggcaccgtggaacccgtggaggaactggtccgcatcgcccacgcgcacggcgtgcccatccatgtagacgccgtacaggccgccgggcagattccgattcgttttcgtgactgggatgtggacgccctgtccgtatccggacacaaattcggcacccccaaaggtctgggagcgctgctggtacgcggccgcacacccatcgaaccggtgctgtccggaggcgggcaggaacgcggcctgcgctctggcacgcagaacgtggccggtgccgtggcgctcgccatcggactcaacgaatcgaatgcgcgcatgcaggcgcagtaccgtgagttggtcgcgtcccgagacatgctcatcgacgcggttcgccgggtcgcgcctcgcgccgacctgaccggcgaccccgaacgccgtctgcccggtcacgcctccttcatcttccccggcgtcaccggggaagcgctgctcgtcgacctggacgcgcgcggcatcgctgcctcatccggctcggcctgcgccatcgggcgccacgagattcctgccacgttgctggcgatgggcctcgaaccgtccatcgccaaatcggcattacgcatgaccttccgcaagccgctgacccgcgaacaagtcgaacgcatcagcttggccatcgaagagtcctacaccgacctgacccgccattaaatctgacgccacttaccagaaaggaaacgacgtgagcaccaccacttcagcgcaacccgcgcagctcacccgcaacgagcgcctcgaccggctgcccttcaacaaggcgcaccgcaaactcctcgtcgcctccggcatcggctgggcattcgacgccatggacgtcggcctcgtctccttcgtagtcgccgccatcgccgccgacccgcacttcaacctcaccccgaccgaaaagtcatgggtgctgtccatcggcttcgtcggcatggccatcggcgcggcagtgggcggcttcatcgccgaccgcgtgggccgcaaaaccgtgttcaccgccacactgattatcttcggcatcgccaacggtgccatggccctatcttggtcactcggcatgctgctcggcgcccgactgatcatcggactgggcttgggcgcggaactgccggtcgcctccacgctggtctccgagttttcgccgaccaaacagcgcggccgcatgactgtgctgctggaatcgttctgggccgtcggctggatcgtcgccgccatgatcggctacttcgtgatcccgaacaccggcgactggggctggcgctgggcgctggccatcggcgcgctgccactgctctacgcaatcgtcacccgcgtgcacatcccagaatccgtgcgattcctcgaagccaagggtcgcgaagacgaagccgaaaaggccgtgcgctacttcgaggaagccgggggagtagccccggtaacctctcccaagggcaagccgctgccgaagatcaagacgcgcgaactgttcggctccaagtacctggcccgcaccatcgccatctgggccacgtggttcttcgtgaacttctcctactacggcgcgttcacatggatgccgtcgctgctcgccgaccagttcggctccctgaccaagtcattcggctacacgctcgccatctccatcgcccagctgcccggttacttcctagccgcctggctggtggaggtctggggccgccgcaagacgctgagcatcttcctggccgtctccgccgtggccgccttcgcgttctcgcaggccggatctgtggccctcgtgctcgtgttcggcatgctgctgtccgcctccaacctcggtgcgtggggcgtgctgtacgccgtgaccccggaaatctacccgacccgcctgcgtggcgcggccgccggtgccgccgcagcggtgggccgcatcgccgccatcatcgcgccgctcctcatgccgtggttcctgaccctgtccggcggcaacaaggccgtggccttcatcatcttcgccgccgccttcatcatcgcctgcgtcgccgccctctgcctgcccgaacgcaaaggcctcgatctcgaagactgacggaagtcgatgacgggagaacagatatttgcctgattaccggcagaacccccgcgtcccggcgaaagggacgcgggggttctgccgtttgaaggccgtaaaaacggcagaaatcccgcgaggggttcgtcgagacgcgggagttctgccgttgtgaggtgcttttctatgttccgacatagtcaaggtgtgcgagtaccatcgtgacggtttgtgtgtaggtatgaataaacacctcagagtaagtacttaagtactcgagaacgcaagtaccgaacgattacgcaaaagaatcagtattaagagaggtttcgatggcggttcgtggagatatccgtaatgtggcgattgtggctcacgtcgatcacggcaagaccaccctggtcaatgccatgcttcagcagtcgcacgtgttttccgagcgtgaggaagtgccggatcgtgtaatggattccaacgatctggaacgcgagaagggcatcaccatcctcgccaagaacacggccgtggaatacaccggtccgctggccgccaagtacggccacccggagggcatcaccctcaacatcatcgacacccccggccacgccgatttcggcggcgaggtcgagcgcggcatctccatggttgacggcgtcgtgctgctcgtggacgcctccgaaggcccgctgccgcagacccgcttcgtgctgcgcaaggccctcgaagccaagctgccggtcatcctgtgcgtgaacaaggtcgaccgccccgacgcccgtatcgaagaggtcgtcggcgaaacctccgacctgctgctcggcctggccgacgacgtgcagcacgagggcatcgacctggaccttgaccagctgcttgaaatgccggtcatctactgcgccgccaaggccggctacgcctccgtgaaccagcccgccgacggtggcctgccggacaacgacaacctcgagccgctgttcgaaaccatcatctccaccatcccggcccccgaatacgaggagggcgccccgctgcaggctcacgtggccaacatcgactcctccgacttcctcggccgactcggtctggtccgtatctacaacggcacccttgagaagggcaagacctacggcctgtcccgtgtggacggctccctcgagaacttccgcgtctccgaactgctgcgcacccagggcctcgagcgtatcccggtcgaatccgcaggccccggcgacatcgtggccgttgccggcgttaacgacatcatgatcggcgagaccatcgtcgaccccaacgacccgaagccgctgccgctcatccatgtggacgatccggccatctccatgaccttcggcaccaacgactccccgctggccggcaccgagggcaaggaccacaagctcaccgcccgcatgatcaaggaccgtctggaccgcgagctcatcggtaacgtgtccatcaaggtgctgcccaccgaccgtcccgacgcttgggaagtccagggccgtggcgagctggcgctggccgtgcttgccgagcagatgcgccgcgaaggctacgagctgaccgtcggccgtccgcaggtggtcaccaagaagatcgacggcgtgatcaacgagccgatggaaaacaccaccatcgacgtgccggaagagtacatgggtaccgtcacccagctcatggccgaccgtaagggccgtatggatggcatgaccaaccacggctccggctgggtccgtctgcagttcaccgtgccgtcccgtggtctgatcggcttccgcaccgcgctgctttccgccactcgtggcaccggcatctcctcctccatctctgccggctacgcgccgtgggctggcgccatcaccattcgccagaacggttccatggtttccgatcgcaagggtatcgccaccccgtacgccatgcagcgtctgcaggcccgtggcaacttcttcgtcgaaccgcagtccccggtgtatgaaggccaggtcgtgggtgtgaacaacaagcccgacgagctggacgtgaacatcacgctggccaagcacatgaccaacatgcgttcctccaccgctgacgtgctcgaaaccctgaccccgccgatcaagatgagccttgaggagtccctggacttcgccaacgaggacgagtgcgtggaagtcaccccggagtccatccgcgtgcgcaagatcatcctcggccgtgaggactggtacaagtggcgcgccaagcagcgccgccagaacgccgcccagcagggtaagtgatttggtgcggctgtagccgaccattctctctagctcccctctctgaggggagctaagtttattcctcaccaagtcatatccccacctatactgaaacgcatgactgtgaagagcactactgaattgcgtccgtggtcgtatcgccagaacgcgctggtcaaatcgttgatcacgattgcggcgggcgtggcttccgcctttgtgggcacgttcgcccaccgtatgggtgcggaactgaatattccgtatggtctggtgctggcgtttctgctgatcggcctatcgacatggtgcgcccgttcgcgcatgggcgcggtcggactggccctgcacctcatcgcctcctcactgaccgcatggggcatggcgctgaccaccacatccggcaaagcgctcatcgtcgccggattccaaggcgacatgccgttcttctcccaacatgccggctacatctggctgtacggcctgatactggtccaagtcgtcctgctcattcttcccgcccgctggttcgtcattcccactcattctgaatcgcgcgcgtaactatatatggcgatacattcccgggaatgcgtcgcgtatcggcgggcgtaggggattacggccgctaccatagaactttatggcacgcatgaaactgttttacttgggcccggagggcaccttcacccatcaggcggcaatgacggccgccgaccagttcgccacactcggcgacttcgacctcatcgctctgcccgacgtgcccgcgatcatgcaggccgtacagtcgcgccaaggctggggcgtcatcgcatgggaaaacaacgtcgaaggctatgtggtcccgaatctcgacgcgctgatcgacgcccccaacgcggccggcttcgcccggatcagtgtggacgtggccttcaacgccttcaccgtgcgcggccacagcatctacgactgcaccggcaaccccgtcagcgcccacccgcacggtctggcccaatgcacccggttcatcgccgaacaccatttgcagcccgaacccgcatcctccaacgccgccgcctgccgcgacctgaagcccggccgcgtggcgctcggccccagcatctgcggcgaactctacgatctcgacaccctcgccgaacatgtgcaggatttcgatggcgcgcacaccgaattccttgtcatcgccccgcgtgatgtggtccaggaactcaacgcccgcgcccacagcaatgacgccggcgacttcgaaaccatcatcaccttcatcccgctggtcaccggccccggcgtactcgccgacctgctggacgtcctgcgcgatgcgggactgaacatgaccagcttcatctcgcgcccgatcaaaggccacgacggaacctacagcttcatcgccacccttgacgccgccccctgggagccgagattccgcaccgcactggaagagatcgccggacacggcgactgggcaaaaaccctggccgtctacccacgccgcgaacgcccgaacccgccggtcgacgcctggatgctgcccgagggcggcgtccacatcaccaatcgcgcgccggaaggctggcagtacaccgaggaagcaaggaaggaactgctgtggtagatacagtcggaatcgtcggactcggattgatcggcggctcgctcgcacgccgcctgaccgagcgcggcgtgcgcgtcgtcgcgtggaaccatcgcccgcacccctacgcccaggccgaagccgatggcattttctgcaagagcacgctctccgaactcatggatgccgagccggatgtggtcgtgctgtgcaatccgctcaaggcgatgcccgcaatcctcgccgccctggccccgctcatgggcgaccatccgaacaccacgctcaccgacgtgggctcggtcaagggcatggtccgcgatcaggtcaaggctgccgggctggggaagtgctacgtcggcgcccatccgatggccggcaacgaactgtccggctggcaggccgccgacccgcatctgtacgacggtgccctatgggccatcaccgtggacgagtccacggactaccgccgcttcctcgacgtcgccgcgatgatcaccaaggacgtcggcaaccgcgtcatcgtcgtggacgacgaaacgcatgacaaggccgcggcgatgatctcccacatgccgcatgtggtgtccaccgcgctgatcaacgaactggtcgccaacccggaccgcaacatcgccgccgcgctggccgccggctgctggagggacatgacccgcgtgtccctgaccgacccggaccgcacgcgcgcgatggtcgaggaagactcgctgaacgtcgaagcgctgctgcgccgcatggcggcacgtctgaccgatatggccgaccaactgcacgctggtgccgccggcgagcaggatgtgatgggattcttcgccgaaggcgaccccttccgccggtacaaggccgccgtgacacatgccggcatcaccgctgcacaagacggtacggccaccgctgcgccgcaagccggcacaactgccgccggattcccggaacgcgagctcgccgtccccgaagccggctggcagcagaccttgctgttctccgcacgccggggagaagccatcaccggtttcatccatccgcgtcaggccatcgtccaactgcgccccgccatgtaactgcgccccgccatgtagcccgtgtgcaggttcccctcgccgcccgtcacgaagaaggctacgcgagggggatgaagttcccgcttgttttcgtgagaagaccgtgtggctccgctgttcgaaagacccaaaggagtaaggtagtctgtaccgtttttcgggaaacgcatcgaagttgatgcggtggatggttaaggggatgatgacgtatgacgttaccaaggcagattccggccggtgcccgcgtggtggtgcgcatcaccgacggcattgacccggtcgaccaccgtatgaagttccgcgactatgtggggcatgtggtttcctgggatggatacacgttggagatggtgcgtgacgccgccgccaatggttcgcgcccggcccagaacgtgaccatccatcaggaacagattgccacattgaaacccgtgccggagcggcgtaacacgccaccccggccgtaacccaaggccataaagaattcggaggagaacgagagtgtcatctacgcagttcgacggcgatatcgactccttcgtctcctatctgaagtccaaccgcggcctgtcagcgaatacgctcaaagcgtatcgcgcggatctcacggcatgcctgcacctgttcgagctgcgcggcgtgaccgatctgaacgagatcacgctggatgatctgcgcagctggatggcggtggaatcgcgcgatcacgcccgcagcagcatggcccgcaaaaccgtggccgtgcgcgggttcttcgcgtgggcctatgagcatgggctgaccaccaccgacccggccgccacactgatgactccctcgattcccagcacgctgcccgcggtgctcaccgaatcccaggccgagcaattattggatgtcgctgaacatgccgttgcaacaaaccagtacaaggacgatgggggagcggcagccgcgcccggcagcggcaaggcagctggcaagacagctgataagtcggccgataccgtaaaccgcagtgaggcacccgcccgtgcagacaagcgcgacaacgcccgagtcaccgccgaatcgcagcgcaacgccgcgattctcgaactgctgtatgccaccggcatccgtgtcgccgaactggtgtcgatggatatcgccgacatcgacttctccaatcgcaccatcaaagtcaccggcaaaggcaacaagcaacgcgtggtgccgttcggactacccgcccagcgtgcgctggagacttggctggaacaggggcggccggtactggcccgtacggcaacggatgcagtcaagtcccgtgctgccaacgccctgttcctcggcgcacgaggcggccgtatcgaccaacgcatagcccgtgacatcgtgcacagagcggcccgagaggccggagtgccggatatcagtccccacgccttgcggcattccgcggccacgcacatgctggatggcggcgccgatttgagggaggtgcaggagatgctcgggcattcctccttgaaaactacacaacgctatacgcacgtctccatcgagcagctcaagaaccgttacggacaggcctttccgcgggcatgaccactatgtggacattggttaacaaactcagcaaagactgaacctagccggcaagaacccctgaattttacatgggtgtaacaaaaaatacactgcttgtctcccaagtgcgcaaaaatgacaggtaacagcaacggggttgggtgtccgaagcggcgggaagcgtaagtgtcccgacgatgaggaaatccgaccccgttcgcatgaggcggggctgagacgtcctgcaacctaatgaataggagaaaacatatgaagaagaaagctcttgctttcgctgccatggcttgctccgtggccatgctgctgagcgcctgcggcggctccaacagcaacgctgcctccggtgacaccgctggctccaacatcatcactgcgtacaactccgaaccgcagaacccgctgatcccgggcaacaccaacgaaaccggcggcggcaagccggtcgacctgctgttctcccgtctggtctccttcgacaaggacggcaaggcttccaacgaagtggccgagtccatcaccccgaacgatggcgccacccagtacaccatcaagatcaagtctggctggaagttcaccgacggcactccggtgaccgctgagtccttcaccaaggcctggtcctacgtggccaacgccaagaacgcccagaagtgctcctccttcttctccgccatcgccggctatgacgatctgcagaaggatggcctcaagggtgacgagcagctctccgtcctcaaggtcgtggacgacaccaccttcaccgtcgacctgaaccagtccgactccgtgttcccgattaaggtcggctactcggccttcgccccgctgcctgagtccttctacaaggacccgaaggccttcggcgaggctcctgtgggcaacggcccgtacaagttctccaagtgggaccacaacaaggaaatcgccctcgtcaagaaccctgactacaagggcaacgaggacgtcaagaacgatggcgtgaccttcaaggtctacaccgacgactccgccgcctaccgcgacattcaggccggcaacctcgacgtgatggagtccgtcccggccgccttcaccaagaccttcaagactgacaagaaggtccaggcttactccgaggccggctccgtcatccagaccttcaccatcccgtcctcccttgaccacttcaagaacgacgaggaaggccagctgcgtcgccaggccatctccatggccctcaaccgcaagcagctcatcgacaaggtgctcaacggcaacgccaccgccgccaccgagttcacctccccgaagaccccgggctactccgactccctcaagggtgccgacaacctgaagttcaacgcctccaaggccaaggaactgtgggccaaggctgacgccatctccaagtacgacggccagctcaccttctcctacaacgccgatggtggtgccaagccgctttacgacgccgtcgtgaaccagctcaagaacaacttgggcatcgacgcggccaccaacccgatcccgaccttccaggaattccgtgacgcggtcaccaaccgtcagatgaagggcgccttccgtaccggctggcagcctgactacccgtccgccgagaactacctgtggcagctgtactccaccgctgctgctgatggcaacggctccaacgatggtgactacaagagcccggccttcgatgacctgtgcaagcaggctgctgccgcttccagcactgatgacgccaacaagctgtaccagcaggctgaggaaatcctcctcaacgaccttccggccatcccgctgtactactccaacgcctccggtgtggcttccctcaacgtgaagtccggctacgccttcgattggcagaacctcccgacctacaccgagatgtccaagaagtgagtctgactcactgaacggataccgctaggtagttcggaaataaagggcgaggatcgcaagatccccgccctttttgttgtgtgcggggtgcttgctcacgccatcgggaaccaagttaaagtatccactatccgaccgcaaccatggacatatccaccagcattgcccaatctcaaaccttgcgttaacgcaaatttacatatcacagtccgggcatgcggtaaactgtcggagtatttatcgaccggcgggggcgtactataccctttctggccggtctaggaaataaggagcaaccgtatgggtaagtatcttctgcgacgcattctgcagatgattcccgtggttctcggtacgactcttctggtatatgcccttgtattcgccctgccgggcgaccccgtcaaggccatgttcggagacaagcctgtcaatgaggccgtcgcagcccagatccgcgcagaataccatctcgaccagccgttcatcgttcagtacttcatctacctgaagaatgcactgaccctgaacttcggcgataccttcgccggccagcccgttctcgacgaaatcacccgcgccttcccggtcaccatcaggctcggcttgatggcgttcgtgttcgaggcgattttcggtgtggtcttcggcattatctcgggcctcaagaagggcaagtggtacgacaccgttatcctgatcgtctctctgctgcttatttccgtgccgaccttcgtcaccggcttcgtcatgcaatatgtctttggtattcagtgggcgatattgccggtgacggcaggcgccgaccccggcttccttgatctgctcatgccggccatggtgctcggttcggtgtcgatggcctatatcatccgactgacccgctccgaaatctcctccaacatcgccgaggattacgtgcgcaccgcacgcgccaagggcatgtcgaacggtcaggtcatgctgcgccacgtgctgcgtaactccctgattccagtcgtcacctacctcggccaggacatcggtgccctgatgggtggtgccatgatcaccgagcagatcttcaacatccacggcatcggcttcctcacctaccagtccattctgaagggcgaggcaaacctggtggtgtccatcgtcacgttgctcatgctgattttcgtagtgtgcaacctcgttgtcgacatgctgtacgcggccctcgatccgcgtatccgttacgcgtgatagggaggagtgagtcacatggcaaacgaaaccactgaaaacgagctcaaccagaccggcgagccaggaaccgaatacttcatggaaaccctgcccggtcaggaccgttacgtagctcctctcgacgagaccccgttgcaggacgtcgattccgtcgacgaatccgcaccggccaccagcatgtgggccgacgcatggcgaaccctgcgccgcaacccgttgttcatcatctccggcttgctgatcctgttcatcatcgtggtggccatcgcccccggtctgttcaccaagcaggatccgaacgcctgcgatctgggcaactccttgagccccgcctccgccggacaccccttcggctacgacctgcagggctgcgacgtgtacacccgcgtggtctacggcacccgtacctcactgtccgtcggcgtgctctccacgctgctggtcgtgattgtcggtaccctgatcggtgccgtcgccggcttcttcggcggttgggtcgacgcggtgctgagccgtatcaccgacatcttcttcgcgctgcctatgctgcttggcgccatcgtggtgcttcagatgttcaagacctccaagtccatctggaagatcgtgctggtgctgacgctcttcggctgggtcggcgtatgccgtatcgcccgaagcgccgtgctggaatcgaagaacctcgaattcaacaccgcttccacggccctcggctccacgcctgccagaaacctgttccgtcacatcttgccgaactccctggccccgatcatcgtcatcgccaccacttcgctggcctcctacatcgtggccgaagcaaccctaagcttccttggcgtcggcctgccgaccaccacggtgagctggggtggcgatatctccagcgcacagaccaacctgcagactgatccgctggtgctgttctacccgtccgccgcactggccatcaccgtgcttgcgttcatcatgatgggcgacgccgtcaaggacgccctcgatccgaagagccgtacggcctgagcgaggggagtggagaaacattatgactgacaacaccaacgccaagatgctggctatgcagaaagagcatggtccgctgctcgaggtcaaggatctggccatcgacttcaccactgacaccggcaagccggtgcacgcggtgcgcgatgccaacttcaccgtctaccctggccagtgggtggccatcgtgggcgagtccggttccggcaagtccacctccgccatggccgtgctgggtctgctgcccggcaccggtcacgtggtcaacggctccatcaagctcgacggcgaggaaatcgccggcgccaagcagagcgagttcgacaagctgcgcggcaccaagatgggtctcgtgcctcaggacccgatgagcaacctcaacccggtgtggcgtatcggcacccaggtcaaggaagcactgaaggccaacaacatggacgtggctcacgaaaagcgctccgcccttgccaaggctctggccggcgacgaggtcgaagtcaagggcaacgacgacgagaccttcctcggagccaaggaactgcccgagctcatgaccgaggccaagaaggctttgactgaagccggcgtgtccggcgaggccttcgacaaggccgtcgcccgcttcaccaacgaatgggttccgggctccgaaacccgttggcgcgtggccgacgacctcatcaaggccggcgtggccgacgaccaggcctggtatctggctaagaagtacgtcaccggctccacaatggatgaccgtatcgcgggtctgctgtccgaggccggtctgcccgacgccgctacccgtgcccgccagttcccgcacgagttctccggtggtatgcgccagcgcgcgctcatcgccatcggcttggcctgccgccccgatctgctgatcgccgacgagccgacctccgccctcgacgtgaccgtgcagaagcgcatcctcgaccacctgcacatgctcaccgactcgttgggcaccgccgtgctgttcatcacccacgatctgggccttgccgctgagcgcgcccagcacattgtcgtgatgtacaagggtcaggtcgtcgaatccggcccatcccttgaagtgctccagcacccgcagcacccgtacaccaagcgactggtggccgctgccccgtcgctggcctcccagcgcatcatctccgccaaggagcgtggtgaggatgcggacgctctgctcgatcaccacatcgccggcgaaagcacgctcgaaaagagcgagcacatcatcaccgtcgaccacctgaccaaggaattcaagctgccccgcaagaaggagatgttcaaggccgtcgatgacgtgtccttctccgtcaagcgtggcaccacactggccattgtgggcgaatccggttccggcaagtccaccgtggcgaacatggtgcttcacctcctgaagcccacttccggcaaggtgttctacgaaggccgcgacacctccacgttcaaggccaaggatctgctcggtttccgccgccacgttcagccggtgttccagaacccctacggttcgctcgacccgatgtactccatcttccgttccatcgaggagccgctgcgcatccacaagatcggcgattccaagtggcgagccaaccgtgtcaaggaactgctggacatggtcgagatgccggcttccgtgatgggccgttacccgaacgagctttccggcggccagcgtcagcgtatcgccatcgcacgagccatggctctggatccggacgtcatcgtgtgcgatgaggccgtgtccgccctcgatgtgctggtgcaggatcaggtgctgcgcctgctcaacgacctgcaggccgaaaagggcctgagctacctgttcatcacccacgatctggccgtagtccgccagatcgccgacgaggttgtggtgatgcagcacggcaagctcgtggagcacgccaccaccgacgaggtcttcgaccacccgcagaagcagtacacccgagacctgctcgacgccatccccggcggcaagctccaactcggtctggactgataatctgcgtttgagcgcattgtattgggttctttccatccgtggaaagaacccaatattcgtatgcgcaggtttgcatgatggttcgcgtggaacgaaaggcaaaaattggtgttttcccgatgttgtcccacaaattgtgggacaacatcaacatcaatcgatagacatgagtgttgtcccacagcagatttctcacgaagcccggaattacgccattcttagtgtggtcgataattactcatgctgtggggtgtgggacggcccgcgaaaatcgtcgattttcggatgttgtcccacggaatacgtcatacctcgtatgtgatcgtgagtggggcgtgatcggaccagcgtttgtcatacgtgggagccttgtcgatgacgaatccgcgtgcggtctccgccaactcgggcgtggcgaactggtagtcgattctccagccgacattgttgtcgaaagcgcgccctcgctggctccaccaggtgtatggcccctgaatgtcgccggccaacgaacgcatcacatccacgaactcgtattcgtccagccatttgtccacgtaggcacgttcttcgggcagaaatccggcgtgcttctcattggccttggcgttcttgatatcaagcggcgtgtgcgcgatgttgaaatcgccgcagagcacggcctgtttgccgccatgcgcagcctcgtcccgcaacgcgcccatgcgcttcagcatcgtgtccagaaaacggtacttctgttccattttggtcggataatcggtgttgccagcatgcacatatacggatgccacggtgatcgcgtagccctcaggcgttttgacatcggtttcgatccaacgccctgaatccacatcctcgctcagacctggcagcccatatcgcttgtcaagcacttccaagtcggtgagcagtccgactcccgcgcggcctttcacccggcagacctcgttcatggcatggaggttggccggtgcctcgatcttgccggcggtggcgtattcgaaaccaaattcatcgaaaatagaatcgacatcgtcttgaggcgcgcgaacctcctgtatgcaccagacatccggcgcatgcttgccggcccaatcctcgatgcccttgcgcttggccgcacgaatgccgttgacgttagacgtggtaatggtgatggtcatgcggccatactattttggcctccctacgaatcgaaccggacatcggcggccgcgatgctcagctttctctaagcctgagtgctagtgttagcaaggttgcaaccgttacatgaaacgaggaattatgggactgttcggattcggcaagaagaagagcaagaaggaagccgagccggccattgagcctgtcgatgaagacaaggtggccgccgcagaagcgaacgctgccgcaaaggccgagagcgcggagaccgtgctcgccgagccggccagcgaataccagggccgcggcgaagagcgaggcccgtgggatgtcaacgatgaggacgtgcccgattatgacgattatctggatctcggcgcctactacctgcccttcctccagggcatccagctgcgcatcaaggccaaccgcgccacccagcaagtgcttggttccaccatcaccttcggctcctccagcctggagatcgaagcctttgccgcacccaagaccctgggactgtgggatgacgttcgcggtgacctgcttgaagccaacaaggccgcttctgaagtggacggtgtgttcggcaccgaactgaagctgccggtcaatgtcaagggcggcaagaccgtgaacacgcgcatcgttggtgtggacggcccgcgctggatgctgcgtggcatcttctccggcaaggctgctatcgatccggacagcccggagaccgaggcgctgaacaagttcttcgccggcatcgtcgtcgagcgtggcgaggagcctttggcgccgcgcgatctgatcccgatgcatccgccggtcgcccccgctgagcgtaaggccgccaaggccgcggccgaagccggcgaggcgaacggcaaggaacacttcaaggacattccggacaacaagccgaagggcccgttgagccaggatcagaccaccgaggtgaagaccaccttggcccgtggcccgatgttctccgaagttcgctgatctataggaagagacttggcagacaacaaacgcaccggtctatccgcgctggccgacgccggcaatgacggcgaggacttctccgtcatcgatgccatcggcggccctcgcggcgtcatcgaatccatgctgcccggcgtggtgttcgtcgtactgttcgtggccacgagcaatctgaatctcaccattgcggtttcggccgtgttggcggtattgcaggttattgtgcgactgattcagcgccagtcggtaatgggcgcggtctctggtctggtggcggtaggcatctgcctgatttgggcatggcagactcatgaggcccgcaattactacattttcggattcattaccaatgccggctatgccgcgttgcttgccgtgtcactgatcgcgcgcgtgcccggactgggtttggtcgtcgaattcattcgcagcctgcccaccgagcatttcaaggcatggttccatgactggatggacgacaaggccctgaaacgcgcctatatgattgtcaccggcctttgggtcggtctgttcctgctgcggctggtggtgcaggtgccgctgtatctgaccaaccatgtggctgcactcggcgtgacccgcctgctcatgggcattccgttctgggcattggcgatttgggtgagttacctcattatcgccacgccgatgcaccggcataaggtcgcggctaagaagacacagactgaagtcgctgttgatgccgaactcgaaccgagcgcaaccggaaaggacgatgatgcaagctgaagttcgtatcgaacgatacgccgaccaaggccgctgcgtggcccatatcgacggtcgtgtggtgttcgtccgcttcgccttgcccgacgaactcgtgcgagtcgagcttgacgagccccacgaccgggacgaccggttctggaccggcgaagtcgtcgaggttctcgagccgtccgaagaccgagtcaccccggcatggccacttgccggtcccttggcgatgggcgggggagtgggcggcgcggatctcgtgcacgtctctttgcccggccagctcaagtggaaggccatcaccgtctccgaacagatgagccgactcggccatatcgacgtggccgttcccatcgagcgcatgcccggcgacaaggcagccggcggcctcaattggcgtacccgcatcgaaatgattgccgacgacaacggcatgccatccatgcgccggcgcggcacacacaaccgcgtggccatcgacaccatgccgcttgccacgcgcacgctgctggacgtcgccaagcgcgaacacgtgtgggagggcggctttgaacccggctcccagattcgtctttccgtgcccgaaccgcgcggcgagatcgtcgataccgcggcagcagacgacaattacgccgtacttgtggacggcgaactgcgcgccggctcccagctgctcaccgaacaggtgaccatcaacggcacgaccttcgactatcaggttgacgccaacggtttctggcaagtgcatcgccaagcgccgatcgccctcggtacgcacgtgatcaacctggtcaacgggcagctgcagtcagcggcggacgccgtaatctgggatttgtattccggttccggcctgttcaccctgccgctggccacaatgaccggtgaacgcacccgcatgctcagcgttgaaggcgcgcgtgtggccgtcaagaacgcccagcgcaatctgcgcgccatgaatctgaacgacgtggacgcccgcgcgggtgacgtctcgcgcacgctggaccatgtgccggcgcatctggccaagccgaatgtcgtagtgcttgatccgccgcgtgccggtgctcgtgccaaggtctgccgccagattgccgcggccggcgcatccagcgtggtctacatcgcctgtgatcccaccagcctcgcacgcgacaccgcgacactcatcggcgaaggctacgagctcaaagacatccgtgccttcgatatctacccgatgacccaccatgttgagacggtggccttgtttacccgctgacaggtgagcatatgacacgacgaattctcggattgctggcctgcatggcggctgtgttgtccctggccgcctgcacgccggccggtagggcggtcggcgatacccaagacagcatgccggaagtcgcccacgattccacacatcccacggatgtcacagtcggctttgtggggtcgactgacaccgccgcagacgagttcgtcatcaatgcgctgtctgatgacaaactcaatgtctactatgcctcgctcggaacatccgcaagctcggcaaacgcaactgatggtgtatccggtgaaaccgaatcttctgacgccggcactaccagcgaaaacggtgccgatagtatggatgctcatactggcgtcgacaagaatgcggccaccgcacagcagggtgttgccgatttcgtagctcgcgcggtcaaaatcgtggttatcagcggcatcgacgttaccgacgccaaccgggagagctggaaccagacgttgaccaatgcgcgtgaagccggtattccagtcgctctcattgatccaaagcatgcgcccgaagatgaactgctgtacgccgtcatccttcacctcaacaccaacagtgccgattctggcgacactgccgataccaagccaatgactattactgacgccgtgctcaccatcacgcgcgacgaaccccacgaacgcgagatcaaagtcaccgtctcctgagccgaatcagccccttgaagctgagaaagcaccctgaatcatccctgagccttagtggattgcgaaacaagacgcggtaggctagggaatatgagtgcaacaacagccgtggaaatgcctgagatcggagcgaccggtcttacccccaaagaagtggtgcagcgtatcgaaagtggccaatcgaatgcggtgaaaacctccagctcgcgttcggttcaagatatcgtgcgagccaacgtattcacgctgttcaacggcatcatcttcgccgcgatggtactggtgctgatcaccggttcctggagggacgcggtgttcggtttcgtcatcatcatcaacacgggcatcggcatcgtcaccgaactcagggccaagcgcacgctggacaggctttccatccttgtggcctccgaattcctcgtgcgtcgtgatggcaaggatgtcgaggtatctcataacgaaatcgtgcttgacgacttgttatggattcgtgccggcgaacaggtgccggccgacgggcagatcatccagacctggggactggagcttgacgagtccatgctcaccggcgaatcgcgtaccgtgcgccacaaggtgggggagcaggtgtattccggcgccaccgcggtctccggcatggcattggtcaaggtcaatgcggtcggcagccattcctacgccgccacgctcaccgcgcaggccaaggtatacaagaaaaccgtgtccgacctgaacaagggcatcaacacgattctgaaattcatgaccttcctcgtggtaccgctgtgcattctgctgattctttcgcagattcatacggtcggcggttggggcacggcactctccaccggcgaatggcggcaagccgtggtttccgcggtcgccggcgtagtaggcatgattcccgaaggcttggtgctgctgacttcgctgaacttcgcggtggccgccatgcgtctcgcccgtcacaatacgctggtgcaggagctcgaatccgtggagacactggctcgcgtggacgcgctgaacctcgataaaaccggcacgatcaccgatggcggtatcgccttcaaccggctcgtgatgctcgattccgccaatgcggctgcggaacaggcagccacgcaggccctctacgactgctgcaacgaagagcagcccaacggcaccggccaagccgtactcgccgggctcaaggcccaaggatatggggcaggtgcggttgagtctcgtgtcccgttctcttcggcgcgcaaatggagtgcggtgcgtaaatccggcgagacctggtacatgggagcgccggaggtgattatttctgcgcttgagggtgactattcgtcggtgttgcagcgggttaacgagtatgccaatgacggcaaccgtgtgttgctggttgcgcggtctacagctcccctcagtccgcttcgcggacggctcccctcggagaggggagccgagaagagcgagctggctcccctctccgaggggagctgtcgccaaaagcgactgaggggagcagttgagggagccaatgtctcggacgacccgcaactggatgtgcaggctgagccggtggcgttggtgttgtgctctgagaagattcgcgaggacgccgagcggacgctcgcttggttccgtgagcagggtgtgcgctgtcgtgtgatttccggcgacaatccagtgaccgtgggtgccatcgcccgcagagtgaaactcaccggcgaccatgagccggtggcgatggacgcgcgcgaactgcctgaggacgtgaacgaacttgcccgcgtgctcgaaaacgtcgatgtgctcggccgcgtgctgcctgaccagaagaaggccatcgtgcaggcgttgcacacgcagaaccacgtggttgccatgaccggcgacggcgtcaacgacgcgctcgccatcaaggaggcggacctcggcatcgccatgggcaatgcggcgcccgccaccaaggccgtggcccaggtggtgctggtggattcgaagttctcgcacctgccggacgtcgtggcgcggggccgtcaggtcatggccaatatggagcgcgtggccagcctgttcctcgtcaaaaccgtgtactccgcgctgatctcgctcggcgtagtgctgacgcaaatcccatacccatacctgccgcgccatatcacgtatatcggcgctctcaccatcggcatgcccgcgttcattctggcgctcgcgccgaacacgcgccgctatattccgggattcctcaagcgcgtggtcacgttcgcgctgccgggcggcatcgccaccgcgctgtcggtgctgctggccgcttgggtgctgccgccggtcatgggctggaacgtgaccggcgatgccgcggacctgtccgccctgcgcgccaccagcgccatcatcctgttcgcgatgggcgtgttcgtgctggcccgcgtggccagaccactcaacggttggcgtggcgtgctggtggcggtgttcgcggcggcgggcgtaatcggcgcgttcgtcccgttcgtggcgaacttcttcgccctgattctgccgaccggcgccacgatggtggccacgctgatcgcgttggccggttccgcgctgatcttcgcgctgtgcctgtggctggcgccgctcgtgcgcggactgacgggcaagctctcgcgtcggcattgagacggcggcgcgattgtctcatacttcaagccgacacgccagagcctcggtaacgtgcccgtaccatgtgtagcggataatcagcggcatcataagccgattcatgatttcggaggaagcatgtccttacgcgacgaccagctggctaccctcaaggcagccggcaaggacttcgattactacaacatcgccaatctcgacggcatcgatcatctgccgtactcgctgaaggtactggtcgagaatctggtgcgcaacatcgacggtgccaacatcaccgacgagcacgtcaagaccctgctcgactgggatccgaacgccgaacccagccacgaaatccagttcacgccgtcccgcgtgatcatgcaggacttcaccggcgtgccctgcatcgtggacctcgccaccatgcgtgacgcggtcaaggacctcggcggcgacccggaggtcatcaacccgcaggtccagtccgacatggtcatcgaccactccgtgcagatcgacaagtacggcatcgccgacgcggtccagcaaaacatggacatcgagtaccagcgcaacggcgaacgctaccagttcctgcgctggggtcagcaggcattcaagaacttccgcgtggtgccgccgggaaccggcattatccaccaggtcaacatcgaatacttggccaaggtggtcatgagcaaggccgaggccaacggcaacgcgctcgcctacctcgactcctgcgtgggcaccgactcgcacaccaccaccgaaaacggtctgggcgtgctcggctggggcgtcggcggcattgaagccgaggccgccatgctcggccagccgatctccatgctcgtgccgcgcgtggtcggcttcaagctcaccggctccatcccggagggcgttaccgccaccgatgtggtcctgaccatcaccgacatgctccgcaagcacggcgtggtcggtaagttcgtggaattctacggcgaaggcatcgcctccgtgccgctggccaaccgcgccaccatcggcaacatgggccccgagttcggctccacctgcggcatcttcccgattgacaatgtcacgctcgactacctgcgcctgaccggccgctccgaagagcaggtcgcgttggtcgaagcctacgccaaggccaacaagctgtggggcgacgcttccgacccggattacgtggaaccgcagtactccgaatacgaggaactcgacctcggtaccgtggtgccgtccatcgctggcccgaagcgcccgcaggaccgcattctgctgtccgaagccaagagcatgttcgagaagaccgcccccgcctacgagaccgagaagaccgtcaaggatccggtggccgtgtccaccgacttccgtggcgatttcgacatcgaaaacggcgacgtggccatcgcctcgatcacctcatgcaccaacacctccaacccgtccgtgatgatcgccgccggcctgatcgcccgcaacgcacatgccaagggccttaagcccaagccctgggtcaagacctcgctggctcccggctcgcaggtcgtggccgactacctcaaggccgcggggctgcaggacgacctcgatgcactcggctaccagctcgtcggcttcggctgcgccacctgcatcggcaactccggcccgctgctgcccgagatttccgaggcgatcaacgccaacgacctgaccgtcaccgccgtgctttccggcaaccgcaacttcgaaggccgcatcagcccggacgtcaagatgaactacctggcctccccgccgctggtcatcgcctacgcgctcgccggcacgatggacttcgacttcgagacccagccgctcggcaccgacgcggacggcaacgacgtgtacttgaaggacatctggcccaccaatgccgaggtcgccgccgtggtcgacggcagcgtgagccgcgagatgttcctcaaggactacgcctccgtgttcgacggcgaccaccgctggaagggcctcgacgtgccggaaggcgagctgttcgcgtggaacgacaagtccacctatgtgcgcaagcaaaccttcttcgacggcatgaaggccacgccggacccggtcgccgatatccacggcgcccgtgtgctggccctcctgggcgactcggtcaccaccgaccacatctccccggcaggcgcgttcaaggcctccagcccggccggcaagtatctgaccgagcgcggcgtggagtcgaagaacttcaactcttacggttctcgccgaggcaaccacgagatcatggtgcgcggcacgttcggcaacatccgtctgcgcaaccagctgctcgcctccgtgggcgaggaggtgacgcctggcggcttcacctacgacttcctcgccaagaagccgaccacgatcttcgaagcctcccgcgactacatcgacaacaaggtgccgctcgtggtgctcgccggcaaggaatacggcaccggctcctcgcgcgactgggccgccaagggcacggtgatgctcggcgtcaaggccgtgatcaccgaaagcttcgagcgcatccaccgctccaacctgatcggcatgggcgtgctgccgctgcagttcccggcaggcgaatcctatgagtccctgggcctcaacggcaccgagacctacgatatcgccggcgtcgagaagcttaacgagggcgtgacccccaagacggtccacgtcaccgccacccacgaggacggctccaagaccgagttcgacgcggtggtccgcatcgacacgcccggtgaggccgactactaccgtaacggcggcatcctccagtacgtgctgcgcaacctcatgaagtaaccaccttcttggctcccctctcttgaggggagctgtcagcgaagctgactgaggagagcaaggccggtatccgccaacggataccggccttttccacgcatgccaaaatgctatactgtatagcatcttcgaaatggaggttgccatgaccatggtccaaatgaacgttcgcattgatgcgaaactgaagaacgaggtcgaagaagtcctcaagggcaaaggcatatcggtgagtgacgtaatccggtcgctgtggttgtacatcgccgaccgcaaggaagtgccggcattggaaacgaccgccgaagagcaagcccgcgaggaggaaaagcagcgcaagctgaaactgattcgagaaggtgccggatacgtacacaaggaactggtcaaggccggactgatctcagaagacaccgacctcatggaaggccttacctacaagcagttccgcgacaaaatgtacgacgagcaacttgatgcgtattacaacatgaagagggccgattgatgaccgacgtttccatgcagcgtattttgctcgataccaacgtactgttggactatttgctccatcgcgatgatcacgccaagatggcggaagcggttatggaacttggcgcgaagaacaacattacgttgttgtgcgcgtcattgtcgctgaaggatatcgcatacctatcatcatcggcgattcgtagggaattcaaaccgaatgaatcggaagtggagaatttcactcgcggctttctgtcgtcacgggtgccatggcgttgtatcgagcaggtgaaggagatgtgtgacatcgtcgctgtcgatgagtcgacatgtgataaggctttttccctgcaaaaacggcatcgggattttgaagatgatctgatcatcgttgccgcgcaacaatccggtgccaactgtgtggtcacatcggatgccgaactaatcagtcattttcccgaatattgcaaaacaccggctgaaatcgtggcggcactggaataaatgagcggttggcttccctcacggaggggagccaccaatgatgtgccggccaccgtagcctactgcgcctgtagacggaactgcttccagatgtcgctgagcttctgaccgttgcgcgtgcgcttccacacgtccagaccgccgccgcgacgtcctccggcggcggcacgggccgcggcggtcggagtcggatattcggagccgtcatccagacggagacgaccgttttcggtgaccgtggcaaaccagcgctcgcccttgcgcggccgatcccacaccagacgctcgcccggcaccagcagaccagcgtcaatcacctgccggatcgtgacgcgccgcgaactatgagacggccgtggagaagtcttcgacaactcatcgatattctgcttggtcagatcacgggcgtccttgtcataccggatgccccagtattccacgatgagtcggaccgactcttcctgccgcgcctccagcagggcaggtgtgcagtcagcgaaatccttcaactgattggtcagcgggaaacgacgtgaatccgcgcgcaacagcatgcggtcgcgacgtgccggatattcactcaacctgtccaactgatcctcagggccctgcaccagcgccatattgccgagtcggtacatccagaaatcatgctgatcctgcggccagtccgcaaacgatttcgaccgttcgatatccaacggcataatcggcagcgcactgaaccggcgtggtcgatccaactgcatgccggccttctgctcgttggcgcgaatcagcagcagacggaccaaatcgccgtcaccctgcatctcgccatgcaaacggaccaatgcgccttcacggtcgccgtccgagacatgcaacccgttcacgcgctggaccaaatagcccttgtcaagatcacggatggcggcgttcgcataaccgcgccgctccaacgttccagcgcgattcagcgtgcggatgccggtcacctgttccaatgcggtcagaatttccagcagccgacgctcgtcatgggcgcccaacgattccaacgtggccgtggttctggcgatacgcgaggcacgaaccacgaacggcgacaaatcggcgtcgcccagcccgcgatacgaattgaccaacgcccacatggccacgggcttccactcgtggctgcggtaatcgtccaatccctcaagccggctacgcacctcggcgggcagtacggtatcgctggggcgcgcgataatccgccacgccatcgcgtagggtgccagcacctggttgatgaacgtgggcaccgtgcctttgtcgatgtacggttgcagcacgtcggccaggaaatcctcgatgagcttgtcggtggccggcttgtgcgtgagcacgagatgcagataggcgaagaattcctcacagtcatgcggatcgtcgccaagcgggtcaatgatgtcatcccagcgggcggcgtacacgtcaagttcggcggtcgacaggctggccgtggcgcgcgccttgaacacgtctgacggggtgagcggcaggccgcgcatgttcatcacgtcgaagatgcgatgcgcgccgtcgagatcgtcggtggtcacgatgacgagcgtcacctcgttgaccagatactgcgcgaattgctggcgttcggatgccgaccaattggagatctcgtcgtacgtcttgcggatgttggcgacgatattgcgttgcgcagcggtcgccagatcgtcgtcgttcatgtcgaacacggattcgaggttgtcctcctgcacgtgttcgcggaagaacgccgcgtcgcgctcgcgcaacgtgaggcgaggctcggtgacgatgccgcgcagcttgtcgccgggctccaccagcagcgcgtcgagttggcgcatgaggtccgggtctcgctccagatcgcgcaacacggcgatgatgatcgacagggataccagccgctgctgcccgtcgattacgtcgtaacggttatcgccctcgcgcaccagaattagcgagccgaggaagtacggagtaccgggcgacttgcaggcgtcatccaagtcgcttaccagttgcaggatgttctcggtcttccagatgtaggcccgctggaatgaggggatcgtgaaccggaaatccggggtgaacactttcccgagtggtagttccttcgcactgattgccatgtcagccccttcgtcgccggcctgtggacggtatgccggcataccaacttgtgctcaagcctaccagtgtttgcccgacggcgggcacatcacgccggctcgggcaccgacccctcatacaagtagaacgaagacgggttttctcccggcacggatgcgggcagtgactgctcgcacacctgcgtcaggccgcgatgcacatagaacccgacatcgcatgtggtgtccgtgaacaggaagtagtcgcgcacgccggccaggcggaacgcgtccatcagcgtctcgaacatgcgccggcccagcccgtggccgcgcgccgccgggtcaagtacgaacagcaccacttccgccgcatagtcatgcccggcgctcgcggcctgggcgcgcagccgtttgtcgatgccgagaatgcccagaatctcgccggcggccttgattccgcccttcgcgaacacgagacgcgccagcgcgttccacgagttgatccgatgcgagttgagcgggctccgatggtccagcgcatcgacgcgccccacgatcagggcgaccggctggccgtccagttcggcgacgaacgcgttggtggtgcgcgccagacagttctcccagtccgcttcggccgccagcagaccggtccgctcatcgaattcggcataccaggtgcggcgcaccaggtcgatcagcgccggatagtcatccctacgtaatgttcgaataatcgcttcactcatattcccattatgactgatacggctcaacaaccggacgacttacagccgcgccggcagatcggcccgctccaccagccgcgccatctgcacgcggcccatgtcgagcttgttcgccgcggaagaaagatgcgccttcgccgtacgctccgaaatgaacatgcgggaggcgatttcggcgttcgtatagccctcggccgccagcatcacggcctcgcgctcgcggtcgggcagcgcgtcgagcagggcgcgcgcctcatcgcggcgcgaacgcggccgcgtgacgctcagatcgtcgatcagctgtttctgactggccgtgttgaactgcggcgcgccctcgcataccccgatgatgcggcggatgatatcgtccgccgcatcggttttcgacacgaacccctcggcgcccgcctccaccgcgcgttccacggtgccggacggactcaacgaggtcaggatcagcacgtgcggcgcgggggagagcgagcgcagcagacgggtcgcctcgatgccgtccacgccgggcatggcgatgtccatcagcaccacatccggcttttcctcggcagcccgcctcacgcaggtctcgccatcggtggacgtggagacgacttcgatgcgcccgtgggaataatcgttgaggatcaggctcatcgcctggcagatcatcggatcgtcatcgatgacgctgacccggatcggcttgggctctaagccggtgccgcttccggtcagaccgccgcgttcgggctttccaccagacacactattcccgttcttctcactcacgctagccatcttagctgcgccaaggcagttgcacgtcgacatggaacaggtgccgatcgtccatcccataccggcattgcccgttgaccgagtgcacgcgcgctgccaaaccaggcagtccggccccatgggcccgctgcgtctcggtcgcatccgtggcgatcggattgctgatatggatatgtacgcccgcctgcggcgtggcggagacctccaacgacaccggcgctccgggcgcgtgccgccgcgcgttcgtcaatccctcctggatcgcgcggtaggccaccttgccgattgactcatccatcacgctcagctgctggatatcgatccaggtgttgagcgacgtgcccgagttgcgcgtgtccgcaatcagcgcatccagcgattcgcgggtcagcgacgtgtcgtcggacggggcgagctgctcccatgcctggtgcgggttgcgcagcatgtcgatgatcgagtgggcctcgtccaatgccccggccgactgccgacggatgtcctcggccttatccgccaacgattgcgcttcgggggagtcgccgagcttggccgcctccgccttgagcgcgctggcgttcagggccatcagggacagggaatgcgcgagggtgtcgtgcgcttcggctgcgatggcgtcggcgagctgctggttggtcaggtcggtctgcagggtcgcggcatgcgtggtggccgcgctggccaccgcattcgccgtgcgcaggcgggcgcgcgaacggatatgcaggccgatgagcgtagcgatggtcacgaacaccagtgaggccaccgtggcggtgatgatgacggtcggctcctccaccagcatcaccatcggggagcctgaatcgccgccggtatgcggttgagcgaaaatcagatgccaaatcgaggctttgggctgttgcagggcgtcgcggagctgggagatgagcgtcacgatggtgccgccaaccgtggcgcggatggtcgtgttccggtttgaacgacgggcgagcaatgaggtcatcgccatcagtgcgatgagcgagtcatacgggaacacgaccaccagcgcgcaggcgatccagaacgtcgcctccgggtattcgctgcgggccaagagcaggaaccctgccgggaatgccagcaaggtgcagaggaccatcagcgtgtatcctgcggaatcctgcgcaaaattctgggcgaagaacgaggtttgcgccatgcacatgaaactggccaatggcaccataacgaccgaacaccatacgcgcgtagtcacgggcacctcgtccgtatccggtgtaggaaccggggaccccgtgccgggcatagggcgagcgtcaggccgtgagccgggtcggaaaccggggtatggcccggcggcgcgttgtgggttcgtcatgctttccactgtatgacctgcatccggcccccgccactggacatgcgggcaccgttatcacctccgtattgcccgaacaggcaacgaacaatgaccgttcgtccactaacgtcgctgtttcgcggccggtagcgtcgtgctcacatccctatttcggggaagatacgagaaggagcacatcatgtccaaccacaacatcgccccgcagccggttccctcatccccacagcagtaccagccacaacagcctcagcctcagccgccgcaaccgcaacatctgcataccaccatctgcggcatcgcggccgtggtgtttggcgcgttgggtttggtgctgagttttattcccatcgtcaacaatatcgccgcaatccttggcttcatcggcgtcatactggcgattatcgccatagtgggcaccttccggggcaagaaacgcggcaaggtgctgtccattgtggcggcggtgctgtcggtgttggccattgtgatcacgctggccatgcagtccgctgccagcaaggccattgacgattccattaaggagtccaagggcatcgacacgtcacaatcctcatcatcaaagtccgcgggcaaatcgtctgatgcctccaagagcaaggcatccgagcagaaagcgcagggcgagcaggatttggaaggtgatatcgaaggtgcccacgtgaaaatagtctccgccgtgaaaagcgtcaacgactataacggcaagcccaccgctctggtgacttatgaatggacgaacaacacgtccaagaacaactcgttcgccactttggctcacccgaacgtgttccagaacggcaccgaactggagacggcagtatacttcgatcagcctgaaggctatgacgcgaattcgtatttggcccaagcacagcccgggaccgcggcaacggtgacgctgggctatgtgctgcaagacgattcgccgattacggtggatgtcactgcgttcctatcaacggatcaagacaccaaggtgacgcataccttcacgttgcagtgaatcgcgcggcggtccaagctgcgatcgaatgtcaatcgaatctcaagtgcatgccacgcgcatggtggaaacgcccgttacgctttgagatgagcagaacgagccgatcgatcatattcatggaatgttcagctttgttcctctaagattggtactggaacaaacgctaaaggagcgattatgacattcggtcagcagccccagaacaacgggcaatacaacccgcaatacaacacgcctgattacaacgccgcccaacagtctggatatggccagcaatacgcacagtccggttacggccagaactactatgcccagccgcagggcgctcccacctaccaatacgtgccgcagggtactggtgccggtgcgggtgcggccaccatcaacacgacgatgacctacaactatgaggaagcccgccgagtctcagtgaccaaggtgtacggcgagatgaccatcggcatcctcgtcaccgccgtggtcgccgtgctcggccagatcactggagcctactacagcttcctcatggccaccggcatggtgggcctcatcggcctgtgcgtggtgcagattgccctggccgtggtgctcggcatgcgcgtcaccaagatgaagtcggccaccgcgcgcgtcatgttctatgtgtacgccgcattgatgggcttcaccttgagctcgatcttcatggtctacgaccttggctcgatcggcgtggcactcggtgtcaccgccgcgttcttctttgcgctgaccatgttcggcatgactaccaagttcaacatgctcaaggccggcccgatcctgatgatcggcctgattgtgctcatcatctcgcagatcgtgctcgccttcgtgcaggtcgacggcatgaccaagatcgtctgcgccatcggcctgatcctgttcgccggcatgaccatctacgacgcgcagtccacgcgcgcgctgctgaccgaatacgaggcccagggcccggaaatggtcaagaagatctccatcctgtgcgccctgaacctgtacctcgacttcgtgaacatgttcctgtacatcctgcagctgctcggcaacagggactagcctcgacagccgattggcgagcggcatgtagcctgcccgtcaaacgtcacagcccgaccacattgtggccgggctttttcatgtctgtcacattcgcacgttaggctggctccccgtgaaaagacaagaactcgtaggcatgctgagcctgttgttgaccgcgctgatctggggttttgcgttcgtggcgcaggtccagggcatggattcgatgtcgccgatgttcttcaacgccgcgcgcttcacgctgggagcactgtctttggtgccgattctgctgtggatgcgtggccgggggagcgcggataagggcgatacagccggggccgatgtcgttgggaccgaggcatccgtggccgtctccacagatgccgcatcgaacggtgcatccgacgtcgttaccatcaccggtgccaagctgaatgcgaacaagcccgattcggccgtggcgcgattgctcgccaacccggtggtcatttccgtgatctgcggcatcgtgctgttcaccgccagcaccctgcagcagtatggcattctgtacggcaaatcggccggccgtgcgggattcctgaccgccatgtacatcgtgatggtgccgttgctggccttcgtgttcctgcgccggcgcatcggcatgctggtgttcgtggccgtggcgctgtccatcgccggcttctatctgctgtgcatcaccgatggtttcggttcgatcggcctggcggatatcctgctcgtgttcacggccgtgctgttcgccgtgcatattctggtgatcgatactttgggcggcaccgtggacgccatcaagctttcattcggccagttctgcaccaccgccgtgctgagctgggcgggttcgctgatcgaaggctcggtcgactgggccggcgctgctcattcctggattccgattctgtacgccggcatcggctcggtgggcatcgcgtacaccttgcaggtggtcggccagcaatgggtgccaccgacgcgagccagcctgctgatgagcctcgaatcgttcttctcggcggtaggcggtgcgttgcttctcggtgaagtgatgaccccgcgcggctacctcggctgcgccctcatcttcctcggcaccctactggcccaagcgccggccaggctgccgaagtggccgcaacggtgaatgaatcggccgcaggccgattccatagcacctcagtccgaggtcttaggcgcttcgcccacttgcggcgcgccgttgatgtcgcggtggatgttctgcatctgtacctcgatgttctgcaatgagcgcgcgcagtcgagcagcgtctgggaatgctcggcgagcttgttgtccggcaaatcggtcttgtagcgcagcgcatgctccagcgacgcccaataatccatggcgatggtgcggaactgcacctccaccggcgtgtaatgcgcgcccgaggagaggaacacgggcaccgcgtagattacgtgcaatgaacgatacccgttctgtttcgggttcttgatgtaatccttgacgcgcagcacctgaatatcggactgcgacgacagatagttggacacggaatacacgtcgtcgcggtaattacagatcacgcggatgccggccacatcgaacagattgtccttaatcgaattgacgccgatcggcagacccttgcgctccagtttgccgatgatcgagctcaccgacttcagacggcgttccatatgatgtatcgggtcatggctgaaccgcacctggaactcgtcgtcgagaatctccagtttggtgctgatctcgtacatcgcgccttcatacacctgcatgaggtcaacgaattcaacgacctgttcgggagtgaaggtgcctcccggaagatccaacgctttgagacgggcttgcagatcggaggttttgagtcggctatgtcggtcaagtatcacgtccaccaatatactcggcggattccagccaatctggacgttcgcggggaatctttccaagaacccataatttgacatcgtgacaaccaatggcatacgtgaccggagcatgacgaaccccgtcgatagaatcggtcgttatgaatgaagacatgatgaccgaggcggagcgcgcctcgattgcagccgatggaaccgatggtttgctggggaaacgcggcaagggcgtgttccatatccatacgctcggctgccagatgaacgtgcacgattccgagcgcatcgccggcgtgctggaggccaatggctacgtgcctgcaaccgaggaccagatcaatgacaatgacctcgatttgctggtgctcaatacctgtgcggtacgcgagaacgcagccgaacgcatgtatggcaccattggccgattcaatcgcgtcaaactggttcggccgaacctgcagatcgccgttggcggctgcatggcccagcttgaccgcaagaagatcgcggatactgcgccatgggtttccgcggtgttcggtaccaagaacatcgaagatctgcccaagctgttggatcagaatcgtgcgaccggcaaggcgcaggtccaggtcactgaacaattgcggcagttcccgagccagcttcccgccgcccgcgcctcccgcatcagctcgtgggtggcgatttccgtgggctgcaataacacctgcacgttctgtattgtgcccaccacgcgaggcaaggaaaaggaccgccgccccggtgacattcttgatgagattcgccaatgtgtggccgatggtgccaaggaggttacgcttctcggccagaacgtgaattcgttcggttatggtattggcgatcgatacgctttcagcaagctgttgcgcgcctgcggcaccatcgacggtctcgaacgcgtgcgcttcacctcgccgcacccggccgccttcaccgacgacgtcatcgccgcgatggccgaaacgccgaacatcatgcaccagctgcacttcccgctgcagtccggctccgaccgcatcctgcgcgcgatgcgccgctcctaccgctccgccaagttcctcgacatactgggccgcatccgcgccgccatgcccgacgcgcagatctccaccgacatcatcgtcggcttccccggcgaaaccgaagaggacttccagcagaccatggacgtggtgcgccaggcgcgcttctcctcggcgttcacgttcatctactcgccacgccccggcacgccggccgccgcaatggaacagattccgcgcgacgtggtgcaggaccggttcgaccgtctggtggcgttgcaggagcagatcaccgaagagaacctcgccacattcgagggccgcgacgtcgaagtgatgatcaccggcaaactcggcaagaaggacaccgacacccaccgtgtcaccggccgcgagaaaaccggcgtgctggtgcacatcggcgtgcctgaaggcgaaccggtacctgaaatcggcgatttcgtcacggccaccgtcacacacgccggccgccataatctgcttgccgaccccgacgtggccgccggccagacctattccgtgcggcactgagggggcgtatatgacgcaacgagtcgtctccatcgtcggtcccaccgcgtccggcaagacggggttgggcatcgccatcgcccggcgtctggccgaagcgggggagcgggccgaaatcgtgaacgcggacgcctaccagatgtaccgtggcatggatatcggcaccgccaaacccaccgccgaggaacaggcggccgtgccgcaccatctcatcgacatcatcgaccccgaagacacgatgagcgtggcccgattccagcagcttgcgcgcgagaccatcgccgacctgcaatcacgtggcatccggccgattctcgtcggcggctccggcttgtacgccagagcggccatcgatgacatcaccttccccggcaccgatcccgacgtgcgcacacgtcttgaggaacgcgagaaaaccgagggtgccggtgctttgttcgacgagttgcgggccaaagaccccgaggccgccgcgcgcatggacccacgcaatccacgccgcaccatccgtgcgctggaggtcatcgagcttaccggcaaaccgtattcggccagtctgccgcgctaccggtacgtgattccgtccgtgcagatcggactcgacctggaccgcccggatttggaccatcgcatcgatttgcgcaccaagcagatgtatgacgatgggttcatcgaagaagtcgaacggttgcgcccgcatctgggtgccaccgccgtacgtgcgctcggctatcagcagatcatcgacctgctggacggcatctgggatgtgaacgacgccttcgcggacatcgcacagaaaaccaagcgactcgcccgcaaacagatgggatggttcggccgtgacccgcgcatccactggctgcaggccctgaacccgaaactggtcgacaacgcgatggccattatcgcgcacgccgacgccggcgactacgacccgatcgacgcccgagccgacgaatacacccagcatcatctgggggatatcacggcgtaggaatcagccaaaggccgatgcaatcacccgcaatcagtgtgcaggcccctgattccagccggcgatcaagaacacgcgcgtcggattcgccgggcgtagtatcgcgtcgaacatcgtctccagtgcagacgtgtcaccccgatatgccgagtgcttggcggagcgatactcttcgcgcgtcactgagccccagtcgagatcccagccggcgtcatgcgccaagcgtgaaccgaatatacgcagcaccatcgcattgccgccacggaacggatgcagataaccgagctcatcataaatagaagcaaatgcgtgaacgaacacgtcgcgatccaacgcatgcaggttgcgcttgtccgccaactccatcgcgatgttgtgcgcgccggtctcaatgagcccagccgggaagaacgcctcaggattcgcggctcgagcccggtcgttcgtcacctcgcgtgtggtgtttgaggtacgcaacttgcccgcatcctcaaacacgccttcgaacagccccttatgaatggcggtcagctcatccaagtcgccagacggattccatcgacgttccgccaacaacacggtacgtgcgaacaccgcatccgcccgatccgtggcatgatcatccagactgccggcagccagacgatcctttccggcagggtcggcggcggcgcgcagacgcatggcagtctgttcgtccgccacgtcgatgagatgggtcacgggcttcaagccgcgttcgtaggcagccgcggcgcgcatcgttgcctcgcccggcgtcatcgcttccagtgcgcagttcttgagtgcaaatgcgactgcgctcgcacgctctgcgggtgtcatgcaacccatgataaggcatattcgcgccccagcggggaatcgactcagacgaacgcggcgaatcggctgtcgggattcgtcaatcgaccatatcgtcacggtgtcgtcaccaaccatgcacccccgtactagtagaatcagacccgatatggcacgaacagcatcctccaacagcaccaaaccccgtaaatccaaagacaacgggtctacccatgatggcgaaaccaaggtccagcccgagcttgacctcgaacctgagccgttgtggaagaagatcctgctcgcgattccgcgcgcgttcggctccggcgtacgcgccgtcaccggcgtcggcgaatacgatccagcctaccgtcgtgatggtttgtgcttcctgctgctcgtgctcgccgtactgttctgcgcgtccgaatggttccgcgtcagcggtccattcggccagctgcttcacgccatcgcggccggtgtgcttggtctgatgagcgtcgtgctgccggtgttgctcgccgccgtggccttccgactcatgcgcaattccggtaaagggtccaataacccgcgtgtggtcaccggttgggtgctgctcatgtggtcgatttgttcgatcatcgacgtggcgatcgccgccgaccacaccggattcgacatcacgattctgcaatccgccggcggcctgttcggcttcttcctcggctcaccgctcgcctggggcctttccaacgtgttcgccatcatcattttcgtggtcgtcggcctgttctccttgctgatgattaccggcacccacgtcaccgatttgccggaggatgcgcgcaaaatcgccgctaaaatccaacgcaaaccgtatgtgccgatgggccaggagacggatgggagcgccagccagttccccaacgaggtccgtgtgggagataccactctcgcctttgccgacggtgttccctcgcatgacggcgacgatgacggaagcgacaacgatcaggccggcgatgcacggcccagcctgttcgcacgactgttcggccgcaaatccaagaccgaagacgacaaaactcttgacaagtatgctgccgacgatccattcgaccgtgccgccagccagcatggtgccaccgccgaaaccccggtggtcgatccgatgaccggcgagattatcggtgcgcgaaccattgcatcgtcttcgtacgacggccgtccgcacctatccagccctgcgcctgctgccgatgcagatgatggcgacgcttcccgaacccgcgtcatcaccagtggccagaccgtcgccatgcccggtgggggagcggtagacgacccgtgggcacccagtgccgcccaggccggtactgtcgcgctcgcaggggcagccggtgcgatgggagcggccggagccgccggtgccgcggctgcggcagccgcgaccggagcctacgcgggtgccgatgcggacggcagcggagtcggccagggcgtgcccaatacgggcggccagccgaatgccaccgccggcaacgatacagacgacgacgccaataggccgtatcagttgcccgacctgaacctgctgaccaaaggccagccccatgcgatgcgcaccccggccaacgatcgcgtgatccgggcgctgacttccaccttcgaacagttcaacgtggatgccaaagtcgtcggcttcctgcgtggcccctcggtcacccaatatgaggtcgagcttggccccggcgtcaaggtggagaaagtcaccaacctgcagcgcaacatcgcctacgcggtggccagttcggatgtgcgtatcctttcaccgattcccggcaagtccgccatcggcatcgaaatcccgaacgaggatcgcgaaatcgtgcacttgggcgacgtactgcgctccgacaaggccgtgggcgacccgaacccgatgctctccggcatcggcaaggacgtcgaaggccacttcgtgaccgccgacctgaccaagatgccgcacctgctggtggccggtgccaccggttccggtaagtcgagttttatcaactcgatgctcacttcgatcatcatgcgtgccacgcccgaacaggtgcgtctgatcatggtggatcccaagcgcgtggaactgtccgcctacgcaggcatcccgcacctgctgaccccgatcatcaccgatccgaagaaagccgcacaggccctcgaatgggtggtcaaagagatggatgcacgctactccgacctcgaattcttcggattccgccacgtcaaggacttcaacgaggccgtgcgcgccggcaaggtacatgcgcccgccggctcccagcgcaaggtggccccctatccgtacatcctcgtggtggtcgacgagatggccgaccttatgatggtggccaagaacgatgtggaaagctccatccagcgcatcacccagctggcacgagccgccggtgtgcatctggtgctcgccacccagcgtccgtccgtggacgtggtcaccggtctgatcaaggccaacattccatcccgactggcgttcgccacctcgtccgccaccgattcgcgagtcattcttgacacggtcggtgccgagaccctgattggtcagggcgatgcgttgttcctgccgatgggttccgccaagccgattcgtgtgcagggctcgtgggtgtccgaatccgagattcgcaaggccgtggagttcgtgcgcacccagcgcaagccgaaataccgcgaagacatcgaacagatggccaaggaagccgaaaagaaagacagcatggagcccgacgaggagatcggcgacgacatggacgtgctgctgcaggccgccgaactcgtggtcaccagccaattcggctccacctcgatgctgcagcgcaagctcagggtcggcttcgccaaggccggccgactcatggacctgctcgaatcgcgtggcgtggtcgggccgtccgaaggctcgaaggcccgcgaagtgctcgtccagccgcaggacctgccgcaggtgctcgccttcatccgaggcgaaaccagctcgctcgaagccaccgccccgcaatagcccgaactcggcgaataattcacccatcgaccttcctctgatgagggaggtgccccgaaggggcggagagagaagcgcggccacgcggccatcagcacgcaacctgattcccgaataatggcagtcaatatccagccaatactcactcaaggtagaagtgtgggggtaacgtgaacactatggatgagaacacaatggacaagcagtcatcgcccaaatcatcgctgttcgacggatggaacgcgccgccgaacctggtcacctactcgcgcatcgtactcgtggtgtttttcctgacactcgacattctcgccggtgcctggggtgagaacaacctgaccatgcgctgggtcgccgcggtgctgttcatcatcgccgcgtccaccgataaaatcgacggttggatggcccgcaaatacaatcaggtcaccgaaatgggcaagctcatggatccgatcgcggacaagctgctcacttgcggcgcaatgattgtatgctccgcgttcggcgagctcggctggtgggtaaccatcctgttcctgattcgcgaaattggtatcaccgttatgcgtttcttcgtcatggagcgtccgggcggcaaagtcatcgccgccgcatggcccggcaagctcaagaccgtattccagtgcgtgggtctgtccatgctgctgctgccgttctggtctctgggtaacggacaagccacgccgttctggatgaccgcttactacttcctgacctacgccatcatctacgtggcattggtcctgtgcctctactcgggtgccgtgtacctgtacaacacgttcgtcgccccgaagcggaagtgacggatattccaatgcgggaattgtgcgacagtctcgcggccggcatcctcaagatttgcgaggcgaacaatacgaaaatcgcctgcgctgaatccctgaccggtggcctgcttgccgatgcgttcgtgcgtattcccggcgcctccaacgtgttgttgggctccgctgtcacttacgacatcaatgccaaggcctcgatcctgcacgtggacaaggccctattggatcgagaaggtgccgtacaccccgaagtcgcccggcagatggccgtcggtaccgctcgcctatacagccagccggaatacggcgaccgaatcatcggcctttccaccaccggcgtggccggccccggtccggacggtgacaagccggccggactggtgtatgtgggcctgcgcatccccgcaagcctcaccacggaccatgccgaagtgctcaaagccgtcgaactccatcttgatggcatgcgcgaagagattcgtcgcctcaccgtattccacgttctgcaaaacttgagtctattcacagcaagttttaaggaataaaaccgttgggttgtcgtgttgtacatagtggaaacactgaaccgacctgggaaggggcgatggcgatggaaacgatgacccgagtgaacgaacagatggatgtggccgccaagaagccgatggctgtgcagccgggtgtcgcccgtatgcgtgaactgactccggcccagcgccgtgcggtgatgttcgcccagcagcaggtgctcaaggcacaggccgccaagaaggccaaggatcagcgtcaagccgttcgtgaacgtatgtgggatgaggattcgccgtcgtacaagccgactgccgccgccgagcccgtggtggctgaggaggagcctcgcgagttttcgctgcgtggtgctatcggtcatgtgctgcgcgagctgcgcacgcgcgatcgccgcacgttgcgtgaagtctccgagaaggcaggcgtttcgctaggctacctttccgaagtcgaacgtggacagaaggaagccagctccgaactgctgagctccatcgccgatgcgctcggagtctccacttcgcgcatgctgcgcatggtggctgattatctcgactcggtcgagggctgatcggttggcggtgtgaagccgcgtcccgtaatctatgtctagctgtgaacccgtatcgcttgtggcgatgcgggtttttgctgtcctgcggttggtggcacactggcgtgtatgcgtgaacgggaattctgggaattacttgaagaggtgttcggtcggacctacggtcgttcgctgtcgcgtgatcaacggatgcccaaactggcgaatatgaccgtggtcgaggcgctggacgcgggggaggagccacgcgtggtctggaatgtgctctgcgaccaaatggaggttccggactccaagcgttggggccacgatcataacgcgccgcccatgcccgccgtctgacactgcgggattacggagtcgctgaatcgtgaaattggcgatttcggcgtgttgcacgccaaattcgaacaaatgttcgtgtgtgtggttatagttatccacagtgacaagaagccgcatacgtgtgcacagggtgcttgccatctgccataatccttaccgcagtagggtttaaggaggccaggtggccaagctcgggcaagctggaaccacaatggttggtttggattgcctcacatggcatgtccgtcatacggtggaggcatccgattcgcacacgacttcgacaaggagaagatcatggcacttgagaccaagccggccaaggacccggcagccgaggacaagcacgagctcgatcccaagcgcaaggcggcgctggacaccgcgctggcgcaggtcgagaagagttttggcaaaggttccgcaatgcgactgggcgaccagcccgagcagaacgtcgaggtgattcccaccggttcgttggctctcgatatggcgctcggcatcggcggcctacccaagggccgcatcgtggagatctacggccccgaatcatccggtaagaccacgctcgcattgcatgtggtggccaatgcccagaagaagggcggcgtggcggcctacatcgatgccgaacacgcgctcgacccggcctacgcccgcaagctcggcgtggacaccgactcactcatcgtctcccagccggataacggcgagcaggccctcgaaatcgctgacatgctgattcgctccggtgcgcttgacgtcatcgtcatcgactcggtcgccgctttggtgccgaaggccgaaatcgaaggcgaaatgggagacagccatgttggtttgcaggcccgactcatgagtcaggcgctgcgcaagatgaccggcgcgttggctcaggccggcaccaccgccatcttcatcaaccagctgcgtgagaagatcggcgtgttcttcggcaaccctgaaaccaccaccggtggtaaagctctgaagttctacgcctccgtgcgtctcgacatccgccgcatccagaccttgaagaacggcgacgaagcggtgggcaaccgcacgcgcgtcaaggtggtcaagaacaagatggccccgcctttcaagtccgccgaattcgacatgctctacggtgaaggcatttcccgtgagggctcggtgatcgacatggcccagcaggttggcgtggttaagaagtccggttcgtggttcacctatgagggtgatcagctcggtcagggacgagagaaggtccgtcagttccttaaggacaacccggccatcaccgaggagattgagaacaaggtcaaggccgagttcggtctgatcggttccgccgatcagttcgcggaagatggcgaagccgcagcagcggccgccgtcagcgaggctgctgcggctgacgtggccaaggacagcaaggccgcagcggcgcctgctgccaaaacgacccgtgccaaggccggcacagctaaggcctgaacatgattagtgccgaagcgttcttgcggcgcaatcctgttgcgtcgcaagacatgcccattgccgagcagcatgttcagtcgaaaccgtcgggacgtttttctcgacgggggagagacgctgccgttgtcgaagatcccaatgatttggacgcttgccgcgaggctgcattgcgtttgctggacgcggccccgcgtgcatccggtgcgttacgcgaacgattgcttgccaaagggtacggcgaggcgatcgtggacgaggtcatcgaacggctgattcgcgtgcaactgattgacgacagcgcttatgccgaatcggccgtacgctattgtgccggtcgcatgatgggccgtcgtggtacggtcatggaacttgctcgcaaaggtgtggaccgcaagctggctgaacaggtgtgtgacgaagctgagcaaaatggcatctttgaagatgccgcatgggaattgggccgccaaatagcccgcaaaacccatggcctcgatcgtcgggtccgtcagcgtcggctttggtccgccggcggccgcaaaggccacagccccgaaaccctccgtcgagtcgccgccgaattgttggtgtagccaagaaaaaaatgagacctcttataccccgggttctgtcgtgccgtgcgcgaacgcacggcacggatggccatccatctcgacctgacgttaccgccaggctctagcagcctacccgatgacacgggcgagcagcccttaccgccatctgcttggccttgctcccgatgaggcttgccatgcgacctactgttaccagaggcccggtggtctcttacaccgccgtttcacccttacccgtcgaggacgggcggtctgttctctgttgcgctatctctcaggtcaccctgggcggacgttatccgccatcgtgctctatggagcccggaagttcctcagccgatcccaatgaagatcacggccgcggccatcaagaggtctcaagcttgcaattatacataaggtgcggaaaaggcggcatcccgccctgcggtgaggccatgccgttgcccggttatcctgttttctccatggttgggcatagttgggcgattcgtgaacgacgcgccgaatatcggatggggcgtgtcgggcgtgttgtggcgtgtcgtatggagacgaatcaaatctgtaagagcttggtatgtgcgagaaagagcaagaaaacgctgcctatccattgcagtatttaccatgacgaacaaacgagccagcctgataaaccggtatcaaatcttcttataggagactgctgccaaagccccagtatatacatcgtttcattgcagagaaaagcccgggaataaacatatattctctgggcgagtttccggccgttcacccattgttcgtctacaatgaaacatacccggtcggtgatgatgccgttcggaacacatatagcgggttacaccgcttgagttagaggaggtcaacatggaaatcgtcgttaccggacgccacacgcaggtcaagcaaaggttccgtgatgtggtcgagaccaagatgaatcgtgtgaccgctatcgccccggatgctcagcgcgcgcagatcgtgctgacccatgagggcaacccgcgtcaggccgataccgccaagcgcgtggaaatcaccgttatcgccggacgtaccgtggtgcgtgcggaggcttccagcaccgatgaattcagcgcgctggacatggcgctggataagttgacgctgcgtctgcgtcgtactcgtgaccgtcgcaaggatcaccgtcgtggttacgcgaacccggtcccggtggatctgggtgttatcgccccggagcccgagccggaggtgtcggaggaagagccgaacaacagcccgcaggctgcggtcgcctccgatcttggccctggcgaatccgtggaggtccaggttggggatacgccgattgtcatccgtcgcaagctgcacatcgccgagcctatgagcatcgacgaggcgctgtacgagatggaactgatcggacacgacttcttcctgttcgtgaacaaggagaccggacgcccgtccgtcgtctaccaccgtcacggttggagctacggcgtgttcgaaatcgacactccggagaatgtcaagaaagcctgaaggtaaggcctgctgacacgatcagctgataccgcatggaccgcttccaatatggaggcggtccattttttcgtaaaaaggtcgaaaaattcgactgctgacggtgtgaggcgctatcctgatacgcggacaccaccacttatcagtcaagggagaacccagtggtcgatattattgacaaagccctgcgaatgggtgaaggccaccagctcaagaagctggagaacgtggccaaggccgtgaacgctcttgaggacgagatctccgccctctctgacgaggatctgaaggcccaaaccccgaagttcaagcaggaaatcgaaaacggcaagagcctggacgagatcatgcccgaggcgttcgccaccgtgcgcgaggtctccaagcgcacccttggccagcgtcacttcgacgtgcagctcatgggcggtgctgccctgcactggggcaacatcgccgaaatgaagaccggtgaaggcaagaccctggtcgccaccctgcccacctatctgaacgctctcgaaggcaagggcgtgcacgtggtcaccgtcaacgactacctcgccagctaccagagcgagctgatgggccgtatctaccgtttcctcggcatgaacgtcggctgcatcatcaccgagcagaagccgccggagcgccgcaagcagtacaacgctgacatcacctacggcaccaacaacgagttcggcttcgactacctgcgtgacaacatggcatgggagaaggccgacctcgtgcagcgcggtcaccactacgccatcgtcgatgaggtcgattccatcctcatcgatgaggcccgtaccccgcttatcatctccggcccggccgaaggcgacgtgacccgctggtaccgtcagttcgccaagctggtgctgaagctcacccgcgacgaggactacgacgtcgacgagaagaagaaggtcgtcggcatcctggacccgggcatcaccaaggtcgaggacttcctcggcatcgacaacctgtatgagccggccaacaccgccctgatcggctacctcaacaacgccatcaaggccaaggaactgttcctgcgtgacaaggactacgtcgtcacccagggcgaggtgctcatcgtcgacgagcacaccggccgtatcctgccgggccgccgctacaacgagggtctgcaccaggccatcgaggccaaggaaggcgtggaggtcaaggccgagaaccagaccttcgccaccatcaccctgcagaactacttccgtatgtacgacaagctcgcgggcatgaccggtacggccgaaaccgaggccgccgagttcatgaacacctacaagctgggcgtgctgccgatcaagaccaacaagccgatgatccgcaaggaccaggacgacctcatctaccgcaccaagaaggagaagctggccgccatcgtcaaggacgtggccaagcgtcacgccaagggccagccggtgctgctcggtaccgcttccgtggaaagctccgaagtggtctccaccctgctcgacgtggccaagatccctcaccaggtcctgaacgccaagcagcatgagaaggaagccgccgtggtcgccgtcgccggccgcaagggagccgtcaccgtggccaccaacatggccggccgtggtaccgacatcatgctcggcggtaacgtcgagttccttgccgacgccaagctgaagtccgagggctactctccggaggacaccccggaagagtatgagaagcgttggccgggcaccctgaacgagatcaaggcccaggtcaaggacgagcacgaggaagtcaaggagctgggcggcctgtacgtgctcggcaccgagcgccacgagtcccgtcgaatcgacaaccagctgcgcggtcgttccggccgtcagggcgatccaggcgagtcccgcttctacctgtcgctggaagacgatctgatgcgtctgttcaacacccagctggtggcccaggtcatggccaagggcatggaggaaggccagccgatcgaggccaagtccgtgaccaagggcgtgcgcaccgcacagaaggccgtcgaatcccgcaactacgagattcgtaagaacgtgctgaagtacgacgacgtgatgaacaagcagcgtaccgtcatctactccgagcgccaggctgtgctcaagggcgaagacatccacaaggacatcctgcgtttcatttccgacaccgtcgagtcctacatcaagggtgccaacaagggatccgagaaaccgaaggactgggattgggagggcctgttcaaggcgctcaacaccgtgatccccaccaaggtcgacgaagacgaggtcaggaagatcgtcggcggcctcaagggtgcgaaggccgtcgaggccgtgcgcgacctgatcgtcgaggacgccaggcagcagtacggcgaaatggaggagaccatcggcgagaccggcttgcgcgatctcgaacgccgcgtggtgctcgccgtgctcgaccgcaagtggcgcgagcacctttacgagatggattacctcaaggacggcatcggcctgcgtggcatgggccagcgcgacccgctggtcgaataccagcgcgaaggctaccagatgtacaactccatgatcgaggccattaaggaggagaccgtccagctgctgttccacatcgacatcaagcaggtcgccaccaccgacgaggccgttgacgaggtcgaggagaccgccgaaagcgccgacaccatcgccgtggcctccggccccgacgagaacggcgaatccgtggtcgaggccgccgagggcgaagtcgaggaagaggacgaggatacggacgccaagcaggcgatcgccgaatccgcagccgcctccggggccggcgagtccacgctgcctgttgccggaccggctccgatcagccacgccgaaggcaaggtcccggtttccaagcgtccgaagagcgaagagctcaagacgccgtgggccgacggccgcaccttccctggcactggcaagaacgccccgtgcccgtgcggttccggccgcaagtacaagatgtgccacggccagaacgagaagtgacgcatcgctagttagtaactagctcatggctccccacacggggagccattttctatgcggttcatcagcatgtattcgtgcggtgccgtacgcgcgggacggcacgcgattttcgcggattttgacgtcgtatcccacactgttgcgggatggcacgagtgtcaatcgattgactagcgtggcgtcccgcagtacgaattacggaatcgttgaaattccgccattctcggtgttatggtgtcacggtccgcaaagggtgatgtgggacggcacggctcaaacggcgaaaatgagctgccgtcccgcagttttacgggatagcacaaaaaagaggcttctgctgttttcgtgggttgtcgggcgcgtcgctcgtccaactgacgatgtggaacccgtcgggcgcgcgttcggcgttcgggcaccactcatgcacgcatgagtcgatccaccgggccccgtccccggcgacgaccctgatggaggcgcgctgttcgggcgtcaacgtttggaagaacaggccgaacacgtccctgccgtacccgtcgtgcgcctatatcgcccgatgccgttcgtggtcgacgaccacggtgatgcacgtgtggcctttgcggtagctgatctcgtccacgccgatcgacgtgaggccgccgaacggagacggcatcgacgctttcaaccgttcagcgaccctatgggcggcgtcttccggcggcgcgccacgcgacgtgcggaaaaccgcttacggtcttctggttcgcgacgctcatcggccacgcgcgttccgattcgaaatcgcgtgtggaccggctgcccggctcggcccacggcacggaagcgaccacgacgccgcacgccgccgccctggtcatgcccgcggcacctccttccgcatcgggagcatcggagcatacccgcacgtggacgcacccggatctcgagcacgggttcggaacgcggcggcgaatccgtgatccgcgcatcctctgcaaccgtgcctttgacgttcggcaatccggtgaatgggcttttgcccaggcgttcttcgtgattcatttctttggtcggaaaacagaatacgcgggaacgcccctcacgcttacgaaaccaacggctcgacgacgaaccgacatccacgaaaacagcaatagcgccatattttgcaatatggaagattcagggccttgaaatgacgaaccattacaatgagcggcgaacatacatcacacggcgtaggaaacgccaaggagggcatcatggccgagatcacatggaagtcgattctcaccaagctggtcgggggagaccaccttactgctgaggaatcggagtggttcgtggacgacctgatgcaaggtaacgccaatccggccgccgtgggtgccgcgctcgctatgcagcagcagctgggactgaccgccgacgaggtgcgtggtgccgccaaggccatggtctcccacgccgtgccgctgaacgtttccggtgggaccaccgacatcgtgggcaccggtggtgacggcttcgccaccgtgaacctgtccaccatgggctccgtggccgccgctgcagccggcgtgaagatcgtcaagcacggcaaccgcgctgcatcctcgaagtgcggtgccgccgatgtgctcgaagacctcggcctgccgctggatttgaagccggaggccgtcggcgaagtgggcgacgaggtgggcatcaccttcgcgttcgcccgcaccttccacccggccatgcgcttcgtgggcccgattcgtgccgcgctcggcattccgtgcgtcttcaacatcctgggaccgttgaccaaccccgccaacccggcacacgtggccatcggctgcgccaaccgcaaggtgagcccgatcatggctgccgtctacgccagccgtggtcagtccggcttggtctacacttcgcatgagggcatggatgagctcgcccccaccggcccggtttccgtctgggagattcgcgacggcaaggtcaccgaaaccgagttcgacccgaccgtggatctgggtctcgccaagattaccgtcgaccagctcaagggcggcgtgccggacgtcaacgccaacgcatttaaggacttcctggccggcaaggacattacgtcccgcaccaccgcgctgctcaacgctgcctccgccatcgtggctgacggcaatctggtcggcaacggcacactggccgagcgcttcgccgaggcctacaagctggccgaggatgctgtcgactccggcaaggctgaagccctgttcaacaagtggatcgaaaccgccaagtccaaggcgtgatatggaatgggtttgctcgaatatatttacctttccttcattatcaactatttcgagttgcaggagtccatcgacttcaattcgtgacctatcttggctcggccgcaattacggacgagctacgcctgtgatacattggttcgctatcgctcacacctcgcctacaaacagcccactgggctgtttgcttaacggctcggcctcagagaggggagccaaggactacacaacctacgcgaactacaccctcgcgccgtcgtcgtaatagccaccctgatcaccggggcggtctttgcggttgaggattttggccaccaatccgcccagacccaaaatgacgcccagcccgaagagaatattgagcagcgcgcctaagagaggaatcgcgttcaagccgggaacgaatatcatcaccgtttcgcctgcgagaccgatgatgagcaacgccgtcagcagtaccgtagatgctttgaccggaccaagatcagggttcgggggagtgaagccgccatcatcataggcgtccatcacattatcggtatccagccagctagagccggtgaaatcacgggggcctggctgcttgccttttttgccgccacggctcgggcgagcatcatcggtgaacgagccgatatccaagtcatctacggaaagcagtgcttccttctcgcgtttcttggcctgcttctcgaactttttggcctgcctggaggaagccacgtcatgcaagtcggcctgatgctcggcttcgaacgcggcccacgccgcatccaaatcgttcatgtcatgcgattgcggtgtatcggcaccattcgtggccggtccggcggcaccgggagtcgacgacttggacgaagtatcggaatcctgtccgttgcccggcgtgggggttggccgctctccgtcggcattgctattctggttctcagtcataactgtcactctaatcaggcgaccggccaatggctagttcgtctgcgggaggaatgccaagtgctctactggttcttcgtcaaaggtctcggccctattgctcatcatcgtttgagccctgctgtcagcggactgaataacgtgcctcgagagggtggcgcgattatcgcagccaaccatctggcggtgattgacgatgctttgattccgattacctgcccgcgcatggtgcacttcatgggcaaagccgaatacttcgagggcaagggattgaagggcaagttcaagaagtggtggttcacgtccgtgggcgtgttcccggttgatcgttccggtggcagcaagtcgcttggcgcactcgagcatgcacgcgagattatcgaggatgggcacctgttcggtatccacattgaaggcacgcgcagcccagacggtcgactgtacaagggacacaccggtgccgcacgacttgcgctcgagaccggttgcccgattgttccgaccgccatcatcggctcggacaagctgcagccgattggcacgtcgattcccaagaagggcaagaccaaggtgttgtatggcaagccgattgaggttgcgaagaagccggctgatgaaattacacatgatgatttgcgttcgctgaccgatcgtgtttccaccgcaatccagaaaatgagcggtcaggaattcgtgaacgaatacgcccagaaggtcaaggccgagctcaaggcccagcaggccgctgaagaagccgaaaagtaattaacaaatgaggctccctcgtctgaagacagagggagcctcattcaaatctcacacgatggtgagggtgatgacggtggggttgccgttggcgtcgcgcaagcgaatcttgccgccgttggagaggtccgtatcgccgcttttcacggtacgtaccgtgccgaacaggccaccgagcaccttgtcggttttcacctcgaacccgagaccttcaagtgtcttggttacggcgctttcctgtttgccgacaaggccggacggtatcgtcgccatctccggacccttggaaatcaccacgtccacgctatcgccccacttcagctgggctccggcttcctgagacgcggaaatgacttgaccggcctcgaccttgtcatcgtactgttcggtgacattggccgtgagcttcaactcgccgagcgcggcttgcatctcatcctgggtcttaccgacgatgttaggcatggtcaccggcatcggtcccttgctcaaagtaaccgtcacctcatcgttgtgcttggccgtggtaccgggatcaggggagatcgtcaatgccacaccctgcggcgtgtccatcgaatactcatccttcgactcgtcatgcttgacattatcgaagccggccttcttgagcgcgttcaacgggtccttgccattggccgaattcgcgtcgagaatatccttcgggatggtggtcatccgcacgcccttggacaccaccaccgtaagctcctgattggctcgcttgcttatgcggctgttcacaacggccttggtcttgttcacggaagaagagatgatcttgccttccgccacgtcgtcgctgtattccttgtgcgtcttgtaggggatgccgagagccttcaacgtgctctcatacgtggcccaatccgcgccggccaacgagcattcggtgcttgcattcgcatcgcaggtcacgtcatccggcttgggcacactccaatagctgcccggtccggcaaaccaccaccagccggcggttccgccgattgcagccagtaccagcacgatcaccagtacgatgatgagcggttttttgctgcgctgcttctttggcccggtgccgttggaagcgacgtccggctcatcggaaaaggcaagcgctcgggtgaaggcatcgccggcctgaggcagcacttgtgtctcgctgccggactgtgccatgatttgcgtcttatggggagccgaagcatcggctggcgtcgacgaatcaagtgccgtggtgggggcgaccggaggagccggaggattgacgtctgcggcgccaccggtatcgacggtattgcttgcgacatcatcggccaaaaacgctggtacggacggcttgaacgttgctgcaccggcaggtacgccggtcagcggggcctgctcggcgatattgcctaccagcgctgcagcggtggcatcggtatgatcacctccgatgggttcggcatgcaaacggtattgccacgtctccagcggcaatttggcggccaactggctcaattcctcagctgctgccgcgccatcggtggggcgggcatccacctgacgcgcggtcagatgggcgatgaacgccgccacggacggatcaatgccctgacagaccgtggccacggacggcacgtcctcatgaacatgcttgaaaacaagcgtcaccggattatccgaatcgaacggcaccttgccggtcagcatctcccatgccatgatgcccaccgaatacaggtcgccttgcgcggtggcctgattgttctcgatcatttcgggagccagataagcggcggtgcccaatagcatgccggtggagctcaatgtggcctggctggcggccttggccagaccgaaatcagtgatctgcacatggccgcgatcattgatcaaaatgttctcgggcttgatgtcacggtgaaccacgccggcgcgatgtgcggaagccagaccatccagcgtctccgcgaccacgcgcagcgtctcacgtacggagaatgtgccttgggcgttcatctcatgccgcagattgacgccatgcacatattccatgaccagaaaatcaagtccattgaactcgccggtgtcatacacctgaacgatgtgcgggttggcgatggacgcggccgaattggcctcgcggcggaaccgttcgacgaactgctcccgatgcgggcctttggcgagttgtgtgtgcatgaccttaatcgccacggtgcgccccagacgctcatcgatggcctcatacacggtggccataccaccctcggcgatattgcgcacgatgcggtagcgtccctcaatcatctgtgcgggctcgttctcactcatgttgtatcgtacggttcctttaatcacgactaaacatgttcagtgtacatggccccggttacgcggccggagcatcagcgcatagctttcacgggttttcaccggtgttcatggtctcatggtccggcggctcgcattgtggactatcgcaaggattcggggacgaatcgcgcacaagcctcggtcagacggcgttgcgcttcggaattcagctcaagaccggcaatcgccttacgggactcaccccatagggcagcgatgcgctcgcgggatcgatcaagagcaccggtcgacgtgaacagttcaatggtgcgggccacctggttgtcattgcgacaatcttcttcgaagatggcaatcagatcggccttatccgccgtatctgccgcagacagagcatcagccaacagcactgtgcgtttgccttctcggatgtctccgccaactggttttccggtattgcggcttgatccgacgacatccaacaggtcatccgccagttggaacgccagtccgagcggccggccgacggccaacgcgcaatgcctggcctgatccgggctctctcctgcggccagcagtgcaagcagcagtggagcgatggtggtgtaactggctgtcttccagcggaatacgttcaatgaggcgttcgccagagcttcgggattggacagtggggccatctcgacggccaagtccagtacctggccgatttccacctcgcgttgcatggtaagaaacgcctcgttcagggcatcggtgttgggaagacggctggcggaccggcgtgtgatttcaatgcaggcggtggccagaatgtcgccgagcatcaggcccaagccacggcctatggcaccgctgtgtacggcctgttccaaggcacgatgtgcggaaggcctgccccggcgcagatcggattcgtcgatgatgtcgtcatgcaccagtgcggccgtctgaaacacttcaatggcgcaggccaggtcgatcatggcgtcacgccgatcaggcgtcacgtcgccggcaagaatatcgaaggcgtccaacgcgagcagcgcacgcagtcgtttgcctccttggctggaggaggcggcttggtccacaacctgttccatcaccggtttcagggcgtcggcaacctcgtcggtggcgggggcggcagtcagttcccgcaccaactgaatgatgcgtggctcgatgatttcgcggttgttagcagttgtgcacatgcctaataacttatccacagggtttgaagaacacaagaacgttgggaatcaagggttttgaagctagaaccacaatggtcgttttttcctgcgtcatacggcgttttcagccatagtgggcacacaccccctcggcgcatgagctatccggctcggcgcgcaccacaacaccaatagattgcacaccattagtcaaggaggacatgatgaacaacaacacgccgcacaagccgcgtaagagccgacacgccaaacggcacgccgccgagcagacggagccctttggctttgacgagttggagacgagatcacaggaatttcgcaatgatcgacgacttcgaggcgcgcaacaggctaatgccgactgggtggccgaaccattggacgaatggctgtcttgtcttgatgccgggaacaccgacctaggccgagagacgatggccgcgtttgcggtgggcatgcgtgagaccttatcgattcgtgatgcgctgattctctcgttggttattgatgaaagccgttgccccaagtcatggcttatggaattcgcggcgcgaccgcatctggcgcgtacgagaacacgaatgggcgagctgctgacttgcgcattcgaggatgaaggcatgatgccggataaggagcgttgccatgccggcatcggtatgttgctcgatatcgccgaagcctcaccggtgccgtactgcatacagccattggccgtaatcgcctacaccttatggtggctgggcgatccgcgagcaatggtgttcgccttgcgatgcctgctgctcgatgaggattgttcgctggcggcgatgatattctcagccgccgatcgaggcgtggcaccggcatggtgctcgggctgagtgaacagaaacggcggatttccgaggttttacgcgcgatgcgcggaaggaaagcgtgtggtgatcggcaacacgtcgggcaacgatgtgggaataatcgtccgtggagggtggtttactcacatagttgacgatttgcccttgccagaagtgggcccatgtggtatatgcacttcacggcgagagatcaggaggagcagttttggccacgaaggaaacgacggcaaccaagcagacagccgagtccagcgaggagaccgagaccaagaagaaggccagctctacgaccaccgcacgcaagacttccgccaagaagtccaagtccgcagagccctcgaaaaagaccacgcgcaagtccgctgcgaagaaaaccgcgaagaaggccaaggacgatgagctcgtcaaagacgaggacactcaggtcgatgacgagcttgatgacgatgccgaggtcaacgacgacgatttggacgttgacgacctcgacgaggatcttgacgacgttgacgaagacgatgccgacgacgaagacctcgatgaggacgatgccgacgacgatgatgtggaagacgacgaggacgaggaagaagccaagtccaaggcacccgagcagcccaaggaaaagggtgcctacgtggtctccgacacggatgatgaggaagaaaacatcatcccctcgggcaatccgaagcgtcgtgtgattgcggccggcgcaaccgccgacccggtcaaggactacctgaagcagatcggccgtgtgagcctgctgaatgccgagcaggaagtcgacctgtccgagcgcatcgaggccggcctgtacgcccagcacctgctcgacaccgaaagcgaaggcatggagttcaagcgcaagcgtgaactcaagtgggccgccgccgacggcaagaaggctaaggaccatctgctggaagccaacctacgacttgtggtctcgctcgccaagcgttacacgggtcgtggcatgctcttccttgatttgatccaggaaggcaaccttggtctgattcgtgccgtcgagaagttcgattggaagaagggcttcaagttctccacctacgccacgtggtggattcgtcaggccatcacccgtgccatggctgatcaggcccgcaccattcgcgtgcctgtgcacatggttgaagtgattaacaagctgtcccgtgtacagcgccagatgctgcaggatctggggcgtgaacctacgccggacgagctggcccgcgagctggacatgccggttgagaaggtgcaggaagtgcagaagtacggccgcgaaccgatttccctgcacaccccgcttggcgaggatggcgattccgagttcggcgacctcattgaggataccgacgccatcgctccgtccgacgccgtggccttctccctgctgcaggaacagttcaagcaggtgctggaaaccctgtctccgcgtgaggccggcgtcatcaagatgcgctatggccttgaagacggccagccgaagacgctggacgacatcggccgtgtgtatggcgtgacccgtgaacgcatccgtcagatcgagtccaagaccatgtccaagctgcgccacccgtcccgttcgcagaccctgcgcgacttcctggatcaatgatcatctggctcccctctgtgaggggagccaagcatttgaagagaaaaataggactgtatgcccaaagaagaatacggcgccaaggacctagctgttcttgagggcttggatgcggtgcgcaagcgtccgggcatgtacatcggcaccaccgactcgcagggtcttatgcactgcctgtgggagatcatcgataactccgtggatgaggccttggccggcttctgcaacgatatcgtggtcaccctgcacaccgacggttccgtggaagtcgcggacaatggccgaggcattccggtggataaggaaccgaaaaccggcctgtccggcgtggaggtcgtactgaccaaactgcatgccggtgccaagttcggcaactcgtcttataacgccgtcggtggcctgcacggcgtgggctcctccgtggtcaatgccctgagctcccgactggacgtcgaagtggatcgtgacggcaagacgcaccacatgaccttccaccaaggtcaccctggcgtatacacggatgccgacccggccaatccgtctcccgattccccgttcaagcgcactcgcaagaaccgacccaccgagctggaaatcatcggcaaggtatctcccaaaaccactggtacccgtattcgctactggtatgatccggagatcttcaacaaaaccgccgagttctcatacgaacagctcatcgaccgcgtgcgtcagaccagcttcctggtgcccggcctcaaaatcaccatcatcgacgaaaacgtaccggaaacggcggcgactgacaccgtcaaggccactgatgacgcaacagtcgaacctgcgcaagaccaggcaccggccttggatgtctcgtccgacgatgccgagagcccggccgaggaggacttctcactgacggccggcgaccaggtcgttgatggcgcgttcggcgaacagcccgcgcacccgcgcgtcgtggaattcctgcacacaggcggcgtcaaggacttcgtcgacttcctgtccaaaggcgagccgatctccgacatctggcgcatccaaggcgagggcacctataaggaggagacccaggccgtgggcaagggcggtgaactgcacgcccaggaaatcgaacgcacctgcggcgtggatatcgccctgcgatgggtcaacggctatgacaccacaatcatgagcttcgtgaacatcgtggagacgcccggcggcggtactcacgtggacggtttcatgaacgccatcaccaagcagattcgcaaggcggtggaagacaacgcccgcaagctcaaggtgaacatgaaggactccgccatgaaggtggagcgcgacgatatccaagccggactcgtggccgtggtcaccgcacgcgtggccgaacctcagttccaaggccagaccaaggacgtgcttggcaccgcgcaggtcaagccgatcgtcacccggctcaccgacaagcaattcggcgagatgatcaccggctccaagcgcgggtacaaggaacaatccggccgcgtgctggagaagatcgtcggcgaaatgcacgcacgcatccagtcgcgcaaggccaaggaggtcacgcgccgcaagaacgcgctcgaatccgcctcgatgccggccaaactctccgactgccagccgggcaatgacgacgtggccgaactgttcatcgtcgagggtgattccgcactcggtaccgccaaggccgcccgcaacgccggtttccaggcactgctgccgattcgaggcaagattctgaacgtgcagaaggcgtcgatcacgcagatgctctccaacaaggagtgcgcggccatcatccaagtggtgggtgccggctccggccagagcttcgacatcgaacagtcgcgctatcacaagatcatcatgatgaccgatgccgatgtggacggcgcgcacatccgtatcctgttgctgacgctgttctaccggtacatgcggccgcttatcgaacacggctacgtgtatgccgcagtaccgccgctgcaccgcatcgcgttgaccggctcgcacaagggcgaatacatctacacgtattccgatgacgagctggccggcaaactggccgacctcgacaagaagcacatcggttacaacgacgacatccagcgatacaagggtctgggcgagatggatgccgaccagctggcggacaccaccatggacccgcgcacgcgtatgctgcgccgcatccgcatggaggacgccgcccaggcatccgagatcttcagcctgctgatgggcgacgacgtgccgccgcgcaagcagttcatcgtcgacaacgccgacgatttcgaccgctccaagatcgatacctgatcgaagacgtcgctgataatgacatcgtgcttaccgagaatttccgtaattggcgtttgaggtgagcacgttgtcatatgttttatgcgtgttgcccatgagtcattcgatagactgatgacatcgttatcacaaccggtgccgtactgtgaatgggagatgggacatggccagtctgttgcttgccgtcatctatgtggcgtttatcagtctgggattgccggattcgctactcggatccgcatggcccaccatgagccaggatctgaacgtgccggtggcgtgggccggcggcatctccgcggtgatttccatgttcacgatcgtctcggcgctgctttcggaccgaatgacattgaaattcggggcaggcaaggtcaccgccgtttcggtggcgttgactgcggcggccttggccggtttctccgttacctcgaattactgggtgctgttggccatcgccataccatacggccttggcgcgggcggagtggatgcggcgctcaataactacgtagccattcactacgaaagccggcatatgagctggctgcactgcatgtggggcgtcggcgcatcggtcggcccctacatcatgggctatgcgctctctcaaggccaaggttggccgtggggctatcggtacatcgcgatcctgcaggtgatgctgaccgtcatcctggtgctgagcctgccgctgtggaagaaacgtggcgcaattgcggtcggcgaatcgaccgatgacaccgcatcatctgacggcaatgccgagagatttggcactgctgaaggggtgtctgttgctgaacgcaaaccgctcggcgtggccggcgtgctcgccattcgcggtgccaaggaaatcctcgtgatgttcttctgctactgcgccgtcgaatccacggcgggtctgtgggcctccagctatatggtgatgcacagcggcatcgacaagatcaccgccgccagctgggccagcctattctacgtaggcatcaccgtgggtcgtgcgctttccggctttctgaccatgcgattcaaggacccggtcatgattcgcctcggccaagtgctggtgttcgccggcatcctcaccatgttcgtgccattgcctcaccaccttggcgtggtcgttgggctggtggtcatcggcttcgggtgcgcgccgatttatccgtgcgtcatccactcgacgccggcctacttcggcgaagacaaatcgcaggccatcgtcggcgtgcagatggcctgcgcctatgtgggctcactgctcatgccgccactgttcggcatcatcgcgcaatatgtgacaatcagtctctacccgtggtatttgctggtgctcttggtgctgatggtggccatgcacgagcgtcttcgcaagttgcgcggctgatcatatgcgcatttgggcccgtcgcctactatgcttggagcccatggtgataagtggagaagaacatgaacagatgcccgagcccgtacgggagcgattgagagcgctgaaggatgcgccgggctcggtaatcgtggtcggctcgatgaacgccgattacaccgtaaccactaaacgactacccaagccaggtgaaaccgtcaatggtggtgccatgaaagtgctgccgggcggcaagggcgcgaatcaggcatctgccgccgctcgtctcggtgtcaatgtccagttgctgggcgcggtgggcgaggactccaacgcggacttcctattaagcaagctggatgaggccggcgtcgacaccgccgatatcctgcatgtcgaaggccccagcggcgccacggtaatcaccgtgagcgctgagggcgagaacaccatcgtctattcgccgggttccaatgccaaggcaagtgccggctatgtgcaatcacatcgcacgaccatcgccgaatgcgcggtattgggactgtgtctggagagcccgattgccaccgttatcgccgccgcgcagaccgcgcatgacgctggcgtgaccgtgctgctcaacgactcgccatttatggacgagctgcctcacgaactggtggaagccacggatattctgctggtcaaccagcatgaagtggctcaactgctgggcctgccggatgatgacgtggaatcactcgactggtatgaggtcgccgaacgattcaccgattacggattcgaccgggcgatagtgacgcttggtgcgtcggggtcggtggtgatcgagaacggacgttggcatcgcgtatccgccgcgcaagtcaatgcggtggacaccaccggttgcggcgactcgttcatgggaactgtgctggctggcttggccgctggccatacgctgctgcaatccgcgcaaatcggctcctatgtctccgcctatgcggccaccaagcttggtgcccaaagcgcctacggcaccgccgaagaagtcatcgcctacttcagctgacctataatcgtacatatgtacgaaaccctgagcctgttttccgaacccaccaaggtgtggttcgagcatgccttcggtcagccgaccgaggcacaggctcaggcatggccggcaatccattccggtcgtaatgtcttggtcatcgcacctaccggctccggcaaaacattggctgcgtttctctcggccattgaccggctgatgaccgtgccacgcacgcggcgtgccggtgtgcgtgtgctgtatatctcgccgttaaaggcgctcgcggccgatgtggccaagaacctagaacagcctttggagggcattgccgcacaatgcgaggcgcaagggctgcccgtgccgaagatcgcggtcgccactcgttcaggcgacaccaccgcacaggagcggcggcgcatagcctcccatccaccggatatcctcgttaccacgccagaatcgttgtatctgttgctcacttcgaaggcagggcggattctcggcactgtcgatacggtgatcgtcgatgagattcatgcagtggcgggcaccaagcgcggcgcacatctggcggtaagtctggaacggctggagaaccttgtcgcggaatcgcgcaagcgagatgcaatcgatgcggatgctgatgagggcagtgataccgccatcgatgctggcctcagtgaccttcatatgcagcgcattggtctatccgctacggtgaatccgcctgaagaggcggcgcgattcctgggcggcggacaaccggttaccatcgtgaatcccggtgggcggcctgcaatggatctgcgcatgattgagccgttggaaaacatgcgtgatttgcagtccgtgaatgccaagcagcgtgtcggtggcgtggaggctgaacggtccgctccgcatatcagcggtgtcacgccggccatgcagcgacttgccgaacgcaggggcatcgtgccggtggatgatagagatgtttcttccacttctggggacgattctgatgcgagtgatgcgttcgattcctccgcgttggttggagcggcgggcgaccgtacctccggttccatctggcccgtggtggaacgcagtattttggatgagattctcgcgcaccgcactacattggtgttcgttaattcgcgtggtgtggctgagaaactcactgcgcgcttgaacgatctgtatgcgcagacccggcatggcaccaatcccgacactgtgcgggatctgggctctccggaaggccgcgaagggttctccacgcattacgatgctgtggtcggctccaccaccatgcttgtcggctcacatgagggcgatgatgtcatcgccatggctcatcatgggtcggtttccaaagaccgtcgcaaaatgattgaggaacggcttaaacgtggtgaattgcgttgcgtggtggccacctccagtttggagctcggcattgatatgggctcggtcgacttggtgattcaagtcgatacgccgttgtcggtctcctccggattgcagcgtgtaggccgtgccgatcatcaggtcggtggcgtctctcacgcattgttctacccgctcacccgtcagcagattgtcactggggccgcaagtctggaagccatgattgccggcgatatagaaccattggccgtgccgcgcaatccgctcgatattctcgcccagcagaccgtggccgctgccgcgatgcacgatttgaacgctgatgactggtatgccacggtgcgccgtgctgcgccgtttgccgaactgccacgtgacatgttcgatgcggtaatcggcatgatgtccggcgaatacaacagcgaggaattctcggcctttcggccgcgactggtatggaatcgggataatggcctgatttccgcccgtcccggttcgcagaaagtggccgttacctctggcggtacgattcccgatcgagggctgtacaccgtggtcctgcctgaggcggacgccggcaaaggccagcgtcgcgtcggcgagttggatgaggaaatggtctatgagtcgcgtgtgggcgatgtcattacactgggtacctccacatggcagattcaggacatcacccgcgaccgtgtggtcgtgactccggctccgggccgcaccgcccgcctgccgttctggcacggtgaaggcgctggccgtgactacggtttcagccgtaccatagcccgcttcacccgagaaatcgccgccggattagacgtgaagcggactgaggggaggtctgccgcagaaggtccagctgtcccaaccttcatcccaacaatcctcacccgtctccaccacgatggcctagatgccaacgccatcaccaacttggcccgcctactctccgagcaacaagccgccactggtacggttcccagcgaccaaaccctcgttgtggagcgcacgcgagatgaagacggcggttggcgcatcgtactgctgagtccattcggccgccgtgttcatgaaccgtggtccatggccatcagtcgcaggctgcgccagcgttatggttttgacgggcaggtatatgccgctgatgatggcatcgtcatccagctgccggatggcgacgggcatattcccgctcaggatctgttccttttcgacccagaagacctcaaagcagatgtagagcgtcaagtgggcgagtccgtgctatttgccgcacgattccgcgaatgcgccgcccgatcactgttcatgcctcgttccgatccaggccgtcgcgtgcccctatggcagcagcgactgcgcgccgcacagctcctgcaatccgcacgtatggccaagaactttccgctgctgctggaaaccgcgcgcgaatgtttgcaagacgtatacgacatgcccgccctgaacgaggtgatgaccggattgcaagccggcaccattaccgtgaaggacgtggaaaccgagtcgccatcgcctttcgccgagaacattctctttggcttcgtcggcgtggtgatgtaccagtatgaccaacctcaggccgagcgtagcgcgcaactgctgtctctcgatccgcacgtgctcgaacgcttgctcggcaccaccgatatggcacaagtgctcaacccggacgtgattcgcgaagtcgaacaggaactgggggagcacactttctggaatgagcttgccgacgatgatgtgactggtcgcgtgacccgttacgccaaaacccatggtcctttcaccgccgatcagctcatagccgatctacacctcgatgctacggatgccgtgcacactctggatgtgctggctgccaaaggcgagttgctgcaaggccgctttgtagatgatgacgagcaaggccaacagtggctccataaggacgtattccgccgtattcggtctcgctcattggccaaggcgcgtaaagcagtcaagccagtagaatcagaggcgttccagatgtttcttatcgaccgacaaggtatcgggccggtcggcggcgaacgatatgaaggtgctgacgggctcatgcgcgttatcgagcagctggagggcatatcactgcccactgcactctgggagtcggcagtattccccgcacgagtacgagactaccaacctgcattgctggatgagttgctgaccagcggcgatgtggtctgggtcggctcaaaaaccgggggaaccagtgcgatggaccccggtgaggttgctttctatccggcggattcaatattgttcagcggtgtggaacatggtacgacatcgaacgcctcagacgccaccatgccggaagcgattctgaccgcactggactcagggggagcgttccatgcccgtcaactgatggatgccgccaaacgtgcgtggaatgagaccgcggagccggacatcaatccaaacaccggcgaaatcattccgcaagagtggagcgaacagcagttcaaggatgccttgtggagcttggtctggcaaggtaaggtcaccaattccagcttcgcgccggtgcgtgcattaaccgcaggcgcagcaagcccgcgtaaatccactacatcacgtcgtcgtgggcgtgtcgctccgattcgccgagccactacggatatgacgttaggaggtttgtggtccgccgtaatcgggcaagctgaagccgaagacaccgaccagaccgaacgggcactcgcactggtcgagacgttgctggacaggtatggcgtcatcgcgcagccggtgattgacaaggaaaatatcccgggtggctactcagcgttgtatccggtattgaatcgcatggaggagcatggtcgactggtacgaggcatgttcgtccgtggtttcggcgcggcccaatttgccgagcgcgacaccgtggatgcgttgcgtcatccgtcagagcatcgcggccagtccgtggtggcattgagtgtgctcgaccccgcaaatctcagtggctccgccatcgcgtggccggacgcgcctgccggtgcgggtaaaccggcacgccgtatcggagccacggtcgtgctcaatgcgcaaggcgcgctactatacgcggccgccaaagccaagcacctgacagcgttcgatcaatcggtcggccatgaagccgctgtcaatgattccgacgaacaaatgcgcaaggccgccacagaactggcctacgccctcaaacgcaatggcaccggctccgtgacattcagcgacatcaatggcgaacccctcaacgcccgtcaccccttcgcccgcatcctccaccagtccggcttcacccccgttccccaaggcatgcggctgtactgattgagcccagctatcgaatgcggtagttggagcctcgttgggtcatgatgaggccggcgcgggtgagcttcttatccagtgtgtagagggcgttcttgagtaagccctgttgctcgaagaatgggccgccgataagtttgaccaactcgctggtgttgacgaactggccatcatccttgaccagcgcttcaagcaaactgtattccagacgggacagtgagattgcgctgtgagtggatgcgtagtaggccttgtgattcgtggtgtccaacgtgagattgccacgaatgatcatggcgggggagtcggtggcaagcgagccgacgtatgagagcagttcgccatcggagaatggtttgctcagcgcggcatctgggcgtcgtacgttagcttgtgcgctagaggcagcattgtccgagcgttgttcggcttcggcatctgagttgtttgcgcgtgaattcgcgctgaaggagctgtagggcgtctcttcgataggggcgtactcgtcaggcagcgctcgccagcggctgccttcaccaatggttttgctgagtggcgtcgaagtcagcagcagaatcttgacggaggcacgggcattgcgtagggattcgatgagctgctcggtggaaatgccgagcagggattcatcaagaatcactgcgtcaaatgactccttggcgacagcggcgagcgcgatactaccggtgcttgccaaagacacctcatgacgaccggcaagcagggcaccatgaatggcgtgggccaacggttcattggatacggcaaccagtagtctcatcgccacctccttaatgcttagtgtaggccgggtttagggtctcttctctattgtttggctcactatcgttcgctcctcgcctacaaacaccccactggggtgtttgctttacggctcggcccatcagagggagcttaattgaggttacgcaatgaaggcgatgggggaggcgaggtctactccggaaccgtctcggcgcatatcgggcttgggaagctcgaccggagagcctgcggatgtagaagcgtgcaacgggtagaggcccacccaggcaagaatcagcgtgttctggcccttcaggaatcgctgggaacgcacgccgccggtagcgcgacccttggtggggtacatttccagcggagtgaccttcgccgcgccgttttcggtgccgggcagtgcatcggaatcgccggccacggtgagcaccactgcaccggatccggaagtcaagccgttctcgccctcttcataggtccatgccaccttgccggcgggaaccacgttgaaggccgccacacgggcgccctcggccagcttgatgccggccataccgcccgcagtacgaccctgcgggcgcacgttcttcgcctcaaaggtcagtagcgaggaatcggaggagatgaacaccagacggtcgtcatcctcggccacggcggcgaataccacttcgtcgccatctttcagatcaatgacgggccaagaatccatggtggtgggtgcctcacgattccaacgcttgatgacaccgttacgggtaccgatagccagcgacggcaacggcttggcctcggcggccccgccatcctcgctctcgtccttggcactggtcttgccggacgtcggctgctccatggcaatcgccgtaatcacacgctcaccgcgaatcggatcggtggattcggtcatgccgatcagttcgtcggcctgaactcctcccttcagcgacaatgtggcggtagcgggcaaggcaggcaaatcaaccacatgcgcgagcaccaggcggccggccgacgtgaccagcccatacgtagcgcgcgtggaagtctcgaagattgtggtgatctgatcgtctctcaaacgctcatcggaagtggatcgtgcattgaacacgtccatcgcgcttggcgtggtacgggcaatcaaaccggtagcgctcatcatcaccacgcacggctcgtcctcgatcttcaaggctccggtcagcgtggactgttcgccggtcttcttggccgcagctgcggctgcggccacatcggcttcggcggaggagatcgtagtggcggccttcaccgcttcgagcgcggacttggacacgcccgaagccccggcaccctgcgccacgaccggcgtcaacgtgccatccgggtcggcatccagcagcacggtacggcgcggcgagccccacttggcgaccgcttcgtccatctcgtcggtgaccacctggtcgagcgcctcggcggaggccaggatccgggtcagctcctcgatacgcttcttcagatcatcgcgttcggcctcaagctcgatacggttcatcttggtcagtcggcgcagacgcaggtcgaggatgtactgagcctggacctcgtccaaatcgaaaacgaccatcaaacggctcttcgcggcatccgcatcatccgaggtgcggattacctgaatcacctcgtcgatgtccaacatggccagcagcaggccctcgaccaggtgcaggcgctccagcgccttcttcttgcgatattcactgcggcggcgaatcaccacacggcggtggtccacccacacctgaagcatctccttcagacccatcgtgtgcgggcggccctccaccaacgccacgttgttcatggcgaagttgtcttgcaacggtgtgtgcttgaacaactgcaccagaaccgcatgcgggtcgaaaccagtcttgatctcgatgacgatacgcgtgccgttatgacgatcggtcagatcgaacgcgccggaaatcccctccagcttgcggttcttcacaccgtcggaaatacgttcgattaccttctccgggcccaccatgtacggcagctcggtgaccacgatggcctgcttgcgggccgtgacatgctcgatatgcgtggcggcgcgcgtggtgagcgtaccacggccagtggcataggcctcacggatgccgtcgcggccgatgatcgtgccgccggtgggccagtcggggccgggcacgtagcgcatcagctgttccagggtggcgtccgaatgcgccatgaggaacttggcggcgtttaccacctcgcccagattgtgggtggccaggttcgtggccatgcccacggcgatgcccgagccgccgttgaccagcagattcgggatggcggccggcagcacggttggttccttgagcttgttgtcatagttcggcgtgaagtcgacggtgtcctcatcgatatccgcgttcatgccgagagcggctgggccaagcctggcctcggtgtaacgggaggccgcagggccgtcatccagcgagccgaagttgccgtggccgtctaccagcggcagacgcatcgcgaacggctgtgccaaacgcaccatggcctcgtagatcgcggaatcaccgtgcgggtggagcttgcccatcacctcgcccaccacgcgggcggacttcatatatgggcggtcgggagtcaggttcatcttgcccatctggtagacgatgcggcgctgcaccggcttcaagccatcgcgcgcatcgggcagtgcgcgtgcgtaaatcaccgaatacgcatactcgaggaaggacttgctcatctcctcgttcagcggtgtctcgacgatatgctccttgaccgtgcgcggatcgtaggtttgcgcggacggtttgcggtgtgatgccatgaaactccctttcgaacgcccccatattagcgggagggcgcgaaacagtgcgcagagaacggttctcgataacaactgtgcgctggtttcggtgcgccaatcgcacatgtttgccgataaaacggcgtgattccagtgtttcagtcgatgtgcgtttgtttgattatgtgcgttggagcgcacagttgttattgagaaccgttctctgcgcactgagccaaggggaggggtgctacttgaatgggcaactatgagtgttgagacgccggatatggacgagttgctgcggctggtgcccacagtgggctatggggatgacgccccggccgatcggcgtgggggagcactgcacctgtccgccgtgctgcccgccttgtccgccgccatcggacatccgacccccaccaaggtccacgccgatcccaaggcctgccagcgcgcattggggctgcctgatgccgaatcggccatcgtggtgctcgtggacggcctgggctactggaacctcgccatgcgcctcggccacgcgccctatctgcgttcgctgatgaacgaaagcgccaatcagcgtcccatcgctacctgcgctccaagcaccactgtggcggccatggccgcattcggtaccggaacctgcccgggactgaccgcaatggcgggctatacgcagctcgaacccgccagccataagctcatccaactcatccagttcaaagacgcgctggcacccaaaccagccaatccgcacattcctgtgccgcccatggtcgatccgctcgacttgcagcgcgaggagacggtgttcgagaaacttgcggctcaagaggtgcgcgtcacgagctcggggttgcccaagttctccaaatcgccattgaccgaagccgcattgcgaggcaccgactatcaaggcaacgtcaccccacgcgatcgtgtgctggccgccgcacgcgcctcccgcacccccggcctgacctacctgtacatccgtgacgccgacaaagtcggccacaattacgggtgggattccgaacactgggtggccgcattcgaacatatcgacgcccagctcgcgctcctgaaacgcagcgcacccaaaggcacgctgatcgtcatcgtagccgaccacggcatggtgcaaaccgacatggaccagcggattgacatcgccgttgaaccgcagctcacccgaggcgtgtcactggtcgggggggagccgcgctcgctgatgctgtatgccgagccggatgaacgacctgaggatatagcttgccggtggcgcgattgtctgcaagaccgagccttggtgcggaccaaggatgaggccatcgcggacggattgtttggaccggtctgcgagcgagtccggccaatgctcggcgatgtggtcgtgcaggcagcgggagccgtgaccctcgtcgattcgcgtacgcaaggagacaaggccacccacctgccgagcgtgcatggctcccaaacagcattggaaatggatattccctgcctgatcgatatggcctgattcggaaattcagtctccgaacagaatctcgtcccagcttggtacggccgaacgtcctgatttacgcttggccggtttggctggtgcctcatgttcggtggcggcggattcggccgcccgctcctgctcggtggctactagctgtgcattggggccactccgtatggtcttgtccgaaacattgtcagagccctgctctggtgccgtggcaggcgattgctgtaatcctgcggcagatggcgaaacagatccggcggtctgcgaagagaccggactgggggccgtagtgccatgagcctgggtcgtggccggtgagatggacgtggatagatccactgggggcatggaacctgtggaagtgacagagggccggattgcggcaggccgtgcggccggaatcgaaggcgtaggagccgcccaagcagacacggcgcgctcgatacgcgcggagcgtacggagtcgccgggcagttcgggaatcgtcggcttgagtttggaatccgtggctgattccggattctgttcgccgagcagttttcgagcggcattgttcaggctcatcacggaattgtcgtgcatattccacgtccattcggcatggatctcacggcccgcggaagtgaatatcgccacgatgcgccaaggctcaagtccacgtcgggtggatttccaggtcactgattccatgccgattcccgcagaggccagcgtgcgttccaccagttcgctgatggtgcgcacgctgctgtctttgggtgccgccacggcaaggaactgttcgatggcatactgtttctcggtctccacagccatggagaaacgacgtaccagcatttcgctcagatgatatttctccgcgacacgggccggatcggcaccggcgcgaatcagcgactgtatctgggaaatcggcaaagtggactgctgatgcggctggggagcctgtcgcatctcgcttctgacctgcttggcctcaagaatcgcccgttcgagcgtgtcgtccacgctcacagccatttccctgccgccaagggagaatacgaggtcccccgtcttgctcacgcgcacgaaacgggctttttcaagccgatcatctggcatattcgcaccactttccgtcgcaaagacattacttcttttaagtatgccccacgtgtcgaactttacgagtatttcaaatcgtgtatcctatgggcgagtacggcgctgaccgtgctatatatatcgacttacgaaccaaagacgacgaaaggaccatgatggctcaggattatgattccccccgcaacaaggatgaggacgaggaatcgctgcaggcgctggggaagtcctcgcagaacgcctcgagcgacatcgacgacgatgagaacgccatcgccgaagactacgaactgccgggcgccgatttgagcaacgaggattcctcggtgaccgtcatccccatgcagggtgacgagttcatctgctcgcagtgcttcctggtcaagcatcgcagccagctcgcctacacggacgaggatggccagccggtgtgtgaggagtgcgccgcctgatggcgttcgacgagacctacaacgagcccgaatccaccgaggtcctggtcaagagcctcgaccccgaacatccggcccagctgcactatgcccacgcgggcgatgccggtgccgacctcatcaccaccgtcgatgtgacgctgaagccttttgaacgggcactggttcccaccggcgtggccatcgccctacctgcgggctacgtggcgttggtgcatccgcgttccgggctggccgccaagcagggcgtcaccgtgctcaacgcgcctggcaccgttgatgccggctaccgtggcgagatcaaggtgcctctgatcaacctcgatccgaagcacaccgccgtcttccatccgggcgatcgcatcgctcaattggtgattcagcggtatgttgaggctcggttcatcccggccgagacactgcccggatccgatcgcgccgaacgcgggttcggttcgacgggagtggcgtcctgaccggattaggccggttgaatgactaaggtgatgacggcaacaacggttgtggaaccaatgatggcgaacaggtgaatgcacaaggctccggttcgcggctacaatgaacttcatgacgagggaggtgactggcatggcagagattgatggcgagcagtacgccgcccgtaagttgggttgtgagatcagtgccgatccgctcaatccgctggatccaatcaagaaggtgtgcaagtcccatcaccccgatgaggatttgtccattcttgaccgtgcctaccggcgtgccgtcatccagcactccgcccagcgccgcaagtctggcgagccgtacatcatccacccgctggccgtttcccagattctcgcggatctgggcatgggcccgatcgtggtggcagccggcctgttgcacgacacggtggaagacaccgactatacgttggatcaatgccgcgccgaattcggcgacaccgtggccggtctggtcgatggcgttaccaagctgagtcagcttgaagtgggtgattccgcccaagccgaaaccattcgcaaactcgtggtggccatgagccgcgacgtgcgtaccttggtggtcaagctcgccgaccgcgtacacaacgctcgcacctggcgctatgtgaagaccacgtccgcccagaagaaggcgcgtgaaacccttgacgtgtacgcacctttggccaaccgactcggtatgaacgccatcaagacggagctcgaggaactgagcttcaaggtgctctacccgaagatctacaacgagatcgtggtgctggtggctcgccgagccggccagcgcgatgtgtacctgaagcagattctggcggagatcaacgaggatctcgacgagcagaacatcaaggcatacgtcaccggacgcccgaaggattacttctccatctaccagaagatgatcgtgcgcggccatgatttcgcgaacatctacgatttggtcggtgtgcgcatcatcgtcgacaccattcaggactgctatgcggcgcttggtgccgtgcatgcgcggtggaacccggttcccggccgattcaaggactacatcgccatgccgaagctcaacatgtaccagtcgctgcacaccacggtggtgggtcccggtggcaagccggtcgaaatccagattcgcacttgggacatgcaccgccgcgccgaattcggcatcgccgcgcactggaaatacaaggaaaacggccaggccggccgcgccctgagctcgccggacaagtccgatcgaaagcgtgatgaaaacaatcaggagctttccgaggtcgataacctcaaatggattcagcagctcgccgactggaccagcgaaacccctgattccaacgaattcttgggctcgctcaaggaagaccttggctcgtccgaagtctacgtgttcacgccgaaaggcaaaatcgtatccctgcccgctcacgccacgccggtcgacttcgcgtacgccgtgcacaccgaagtgggccaccgtacgatgggcgcgcgcgtcaacggtcgtttggtgccgctcgacaccacgctcgataatggcgataccgtcgaaattctgacgtccaaatccgatacagccggcccgtcacgcgattggctgagcttcgtcaagagcccgaaggcccgcaacaagattcgtcagtggttctccaaggagcgtcgtactgaagccatcgaggagggccgtgacgagctgacccgcgcgatgcgcaagcgcaatctgccggtcaacacattgcttacgcccgaagcactggtgggtgtggccgacgaccttaacttcccgaacgcggacgccgtgttcgccgccattggtgacggacaggtctccacgcagaacgtcatctcgcatctggtcaaggatgcgggtgccgacgaggtcgatgaggaagtcgagcaggaagtcctgccgctgaagcccatggaacgcaaggcctccagcagctccaccggcgtgtccgtcaagggcgtgggcgatgtgtggatcaagctggcccgttgctgcatgccggtgcccggtgacaatatcatcggcttcatcacccgtaatcagggcgtatccgtgcaccgcaccgactgccagaacatgatcgatctgaaaaacaagcagcctgagcgtgtggtcgaagtcgaatggaccagcaccaagggcctgttcatggtcaagattcaggtcgaggcgctggatcgacgaaacctgctttcggacgtgacacgtgtgctttccgaccatggcgtgaacatcatttccggtacgatcgccaccggttccgatcgcgtggccaccagccagttcagcttcgaaatggccgatccgcagcatctcaactcgttgctggcagccgtgcgcaagattgatggcgtgttcgacgtgtaccgcatcactggtgccaaggaatccgccgaacctcgactgcgcaagatgaagtaggccgttaccttactctggctccctctcagagaggggagccaagaacacgaaaaggtcctgactggaatacctgaactgcgccccgattgttggacgtggtttattaagggtacctgattaggctgtgagggacatgttccggaattcctccggggtgtgtccctccagtcgtatctggcggcgtttggtgttccagtggatgatgtacgcgtccagttcgttcttgaactgttcgtatgaggcgaactcgcgtccggcgtagaactcgtccttgaggtggccgaacacctgctcggtcgcggcgttgtcgatgcagttgcccttcctgctcatggactggcggatgttcagtcccgcgagccggtcgcgccaccaccggtgccggtactgccagcccatgtcggaattaaaccgacatcggtttaactcggattaagccgggtttgttgttaagccggggaacggttcggggtcttggtggctggccgtgtcccatgtggtttcccggcttaacgttccgggttatgttcgtcttgtcccatttgattcgaacgaaggagtttgccatgggtgagacgacggttggccatgtcgcgggcgaggtggtccgcgcgctttacggggccggttatatggaatccaccataggccagtaccgcaagtccatcagggcgttggaacggtacgccggaggcccggatgcggtgtacacgcgtgggttgggcgcggggttcgccgcgtcgaccttcagtgagcggacgggcggtttcagcaggcagcggtggttcgattacggcaggctggcgcgtttgtgcgactcgtatctgcggtccggttcggtggacctgggcaagtggcgcaggagcaggcttgcggagccggtggttccgggtttggccgtggtcatggagcgttgggaggcgtatctcgccggttcgggactggcttcggcgacggtggggcattaccgtcggatggcgggcttgttcctcacgtggctggaatctcatggggtcgtgtcgttggatggttcggatggctcgcatgtgctggggttcctggccgggctgcgttcacgctggtcggagtcgtcgatgcggcacgccgcgtcggacctgcgcccgttgttcagatggctcgggcgggatgacctggcggacgcgatcggcctgaccggcatacgcaggacccacgcgatcgcgggaacgttgcccgacgacgagcaccgccgcttgctggaggcgtgcgcctcgcggtcggtgccgtcgagggacgcggcgatcaccctgctgtcgctgacgtgcgggctgagggcatgcgatgtgatcggtctgaggatcgccgacgtggattgggattccatgagcataggtctggtgcagcgaaagacgggcaatccgttgaccgtgccgatgacgggaccgctggccgcgaggctggcgtcctggctgttggacgaaaggcccgccaccgacgacgaccgtgtgttcgtgcggtacaaggcgccccatgtcgcgcttcggggtcattcatcggtgtacgaggcgatcagccgtgtcatgcggcacgccgggctcggacgccggggcggttccaggctgttgcggcgcaacgcggcgacgaggatgctggaggcggccacgccgttgccgacgatcagcgcggtgcttggccacgccgaccccgattccacacgcgtctacatggccacgcaccgcgggggaatgctcgcgtgcgtgctgcccgtgccggaaggcggatcgtcatgagacccacggaacacggattcgtcggcccgctcgccggcgaattggaggagtacatccgcttcaaggcgtccatgggcaggcatggcgccacccgcgtccgggtcctgcgctcgttcgaccggcattgcctcgaacacggggccgtgcgtctggagcggggcgtcgtggagcgatggatcgcccataggatcgacgcgaatcccgggggttgccgctcgtggttctcgtacatcagggacttcggcaggtggatgcgactggcccacgatcccgacgcgtacgtgctctccgaccagtggaaggccggatccccgcgtccgacgccgtacctgctgacggaccgcgaggccgccctgttcctgcgggccgcgggaacgttggagtctccgtcgccgtgggcgtggcagtctcgcgcgttcttcatgctcatggcctgctgcgggctgcgcacccgagaggtcaggagactcgccgtcgggcacgtcgaccacaaggcccgttccatcgacgtggtcgattccaaggccggtcgcagccgcaggctgcccgtgggcgacgaggtcgccgccgaactgctggaatgcgaccaacggtcccgcgaacgcttcggagacgaccgtcccgcgttcttcgtcacctccaccggcaatccggtctccccgggcatgcccggcgtggtgttccgccgcgtctggacgcgggccgggctcgagtggccacaagccggcaaacggcccaggccctatgatttccggcaccggttcgcgttcgcgaacatcgagcggtggactcgcgacggcgtggacgtgatggcgatgctgccctatctggcggcctacatgggacacgccggcatcgacagcaccctctactacgtgcacgccagccccgatttcatggacggatacgcggacctcgtcgccgacgccgaacgcgtggtcccggaaacggaggaaccatgagcaaggcaaggaaaacggccgccagctccggtgaaccggacttctggcgagtcgcgcgcgactggctgcaccactggctgcccaaggtgcggggcagctcgccgaagaccgtcgaggcgtaccgcatcggcctggaatcctacgtccgatggctcgaaaccacggaaggcacgcagcgcagccacatcggtttcgggcatttcgaccgggcgcgcctgggccggtgggtcgaatggatgcggaccgagcgcgggtactcggaccgcaccatcatgctgaggatgacgacgatgcgcgtgttcctcgaccacgcgggcctcgaacacccggcattgaccgcgctgggcaacgacgcggccggcatacgtgtcaaaccacctgcgcgcaaacccgtcgaccacctcggggaggagcacaccaaagcgttgctgaccgcatggggcaccggcgacgccaaatcgcgcaggaaccgcatgctcctgatcctcatgtacgacaccgccgccaggatcggcgaactcgccgcactgaccatcgcggacgtgggtatggataagccggccagggtcacgctcaccggcaaacgcggcaagagccgggtcgtgcccctgggagaaaggacacgaacccacctggccgcctacctcgaggaattccatcccggaccgtccatgcgcgacggcgacaggccgttgttccactcgacgaggaacggcgccatccagccgctctccgtggaccggatcgacgagatcctcaaaaccgcggcggccagagcacgccgcgggacgtgcccgtccatgcccgaacgcgtccactgccacctgatccgccggacccgcgccatggacctctaccaacagggcgtgccgctaccgctcatcatgcaactgctcggccacgaaagcatgagcacaaccagcgcgttctacgcgttcgcgaccctcgacatgatgcgcaaagccgtcgatgcggccaaccccggccccgacccctccaaggagacatggctcagcgagcaacgactccgacaactacacaccctcaaataacccggaacgttaagccgggaaaccacatgggacacggccagccaccaagaccccgaaccgttccccggcttaacaacaaacccggcttaatcggagtgcaggatcgggttggcgtcttcgggcagcttctcctcgagcatggcgagcaggcgccactgctgggccatgtcgggatgccggctgacgtcccaggccacgatctccttggatcccatgtcgcatacgggagccagatacgccttgccgtcggcgaccctgaactcggtgacgtccgtgcccagcttcacccacggccggtcggccgtgaagtcgcggttcagcaggttctccaccctcgcgcccgtctcgtcccggtacgagctgtatttccggtacgggttcggcctgcgtatccggcattccaggcccatgcgcctcatgaccttcagcacgctcttgtggctcacccgcaccccgaactcgtgcacgaggcacatgcgtatctgccggtggccgcacccgttgggcgtgcgcgcgaatatctcggcgaccatcggctcgatgtccggccgggtcacggcggccggatgcgacagaagatggtaatacgtgcttttcgccagtccggccgccctgagcaggtgccggagccgatgtcccagccccgccagcatggagacgatcaccgttctgtcccggttgccgatctccacgccagcagggcgtcgactttttccaggtacgcgaccctcgccttgaggtacgcgttctcctcctcaaggagctgttcccttgtgggagccggcctcggcttggatttcgcgcccctgggcctgcccttcggtttcggacgcagcgcgtccgggccgccggaccggtactcgcggcaccagcgctccaacggggcgggacccgcgatcctgtacttctccatgacttcggccttcgtcagcccatgctccacatggtcgcgcaccgccgcgagcttcgtctcgtagtcgtatctcctgttgccttcgcgttctcccatgagcgccgcctccccgccaaaccggtatgacaacacccattttcccgcggtactgacgggcacgccaagccggcgggcgagagaacgcctcccggccccgccccggatcaggtcggcgacgacccgcatgaaaccgtcatcgtaatgacgcctgcgatccctacacatgagaaaccgcacctccgatcatcgaatctgaattacttcagtccaacaatcggggtgcggttcagaatcaggaccttttcgtatatgttgtcggtcttactccgccacgtccacggacagaatcacggccggctcgagcgggcgatccatcggatcggtgtccagtgcttcgagcttatcgacgaccttcttggagtcgtcatcggcgacctcaccgaagatggtgtggtgaccgtccagccacggggtcggcacggtggtgatgaagaactgggagccgttggtgccatggaccttaccgtccatgccgcgacgcagaccggcgttggccatagccaacaggtacggcttgtcgaacttcaggctcgggtcgatctcatcgtcgaactcgtagccagggccgccggtaccggtgcccagcgggcaaccgccctgaatcatgaactgcttgatgatacggtggaagatcaggccgttgtagaacttgccgtgggaaggctggccggtgtacgggtccgcccattccttctcgccggtggcgaggcccaggaagttggccacggtgttcggagccttgtcgtcgaacaggttgatggtgatgctgccctcagaggtattcataatgatggtagtcatacgttccatgttctcattgccccacgtcattgactggcattgccgccatcgctgctatcgagtcggcgattgtcagccaatgaatttgatgccggttccgctgctgctaccggttgaggagccgctcgaaccgctattaccggagtttgaactggatgatccgcccgtggagctggaagaggaaccggagccattggctgatcctgaacccgatccggttgaaccgttgccggtgccggtggtgcctccggtggtgccggaaccggtggaaccgccagtcgtgcccgaattagtggaggaatcggtgccggtcgaaccatcggtggatccattggtgttggaatcggttgaggagtcggtgccggttgagccggacgtgcttgaatcggtgccgtcgttggacgagccggatgtggagtccttggtgttggaatcattcgaaccgtcggtaatgcccggctgcggcagtccgttattctgattggacgtgtcggtctgcgttttggtgtcggtttgcgtgggcgtggtggacggagtgatgatatggtccgtgccacggccctgcgtgaccagcatgacgatgccggcggttactgccacggcgagcaggccggataccagcgtgacgataatggcggtgcgcttcgaattatgggagcgggccttgcgcagttcattgaccgaataggttcgtccgttcgctcgattggacacgacttcgcgcggcttgcgcgcggtggaaacggtattgaccatgccggtcatcgtcgtatcggactcggattcggctgccttatcggacttattatccgtagtgtcatcgtcattgccggaagacgaggccgactgtagtttctcaccggaggcggtgagtatgttttgatagattttggtggccaccgcggagacgatgtagctggctgccgcgccgattaccgagccggcgataccgattttcgatgccagtaagaatgaggtgacggcggcaagggtgcccgccacgatggatgagagggaaagaccttcgaaaaacttcttcacaagacacgaccgtaaagtgtcgggctggaaggttgcttaaggctcggtgataccgagaggatgcctacacgagaccttcaaaacctagccagcggaatgtggaatgactcaaaaatatggtgccgatgagcagtgggaatcagcgcaaagtggcgcaaagtagcgcaaagaacaaccgaaattggttcgcttggagcgaaaacgacgttcagcagaacgtcatgcagcccaagcgaagctgccgttgccggcacccaactcgaaatgcagtttggcgatgccaagtccgatttccgattgcacgccttcaagagcctcggccttcaccgtaacggttcagggcaatggagaacccatgaccatccatggccgaaactgaatcgtcagttccggtgcagcgactgtttggtcggcttgattaccgacatcagcacggcgacgaagatcagcgcaaagcccaccagtgaactccacatgattgtctcgccccagaacagcgcggagaacgtgacagcgaacagactttccgtacacatgatgattgacgcctgcgaggcaggcacgtgagccagaccgatgttctgcatgatctgggcactcatcgtggcgccgaggaacagatagagcacgctggccactactgagggtgccagccagctggcgttcggcatgggttcggtgaacaacgcgccgatgatgaacaatacgccggcaacgccgaactgcacaaaagtgacggcgatagggtcgaagcgtttggtgtagacaccaaggcaggtcagattgaacgagaagatgaccgcggtggcgatggtcagccagtcgccggcactcagcgacagcgaaccgcccggcttcagcgagacgaagccgacgccgatcagacagatcacgccggcgaccagattgatggccttcgggcggttttttgaaataatccacgtggcgaacggggtgagtacgcagtaggcggccgtcaggaacgcgctgcggcccggttcaatggtctgcaggccgatggtctgggtgaccatcgtgccccagtaggtcaggcccaccacgagcgccggcacaatgattttcggcgtcagatacggcacgatgtgcttatggaacaaggccagcatgcacaggcaggcgccgatcatgcgcagacccatcagccattggggcggaatcgcctccatggcgaatttggcgagcagatagctgccaccccataatgcagcgcagcccagcaacatgagtcgggcgagattcgggggaaagttgcgggaccagcggctgcgcagcttgctgaaacgttcgaccaaacccatggtgcacctcaggacagttaggaaaacttgtggctctctcggctcacagattacgggaactaccggccaaaatcgaccggtcgatgggtgtcgggtgtgtgacaggtgtgtggctggtgcgcgaccggggcatggcatcgccaagcaggcaaaaaccggatgaaagctgtgcgaaggtgaggttactcacagcgaacatccgggctagtcgcgttcgaaaccggtactctggaaagagtaaggatacgttatccgtagcaatcatgaaaggattcgacatggcagtcattactccggaaatcaaggaattcatcaagaacaaccttggctggatcaccaccgtctccaaggacggcgaactggacctcggcccgaagatgtccctgttcgtgctggacgacacgcacatcgcctaccacgagcgcaccgccggccagcactacgagaacctcaagaacggttccccgctggtcatcgctttcgccaacctcgagaagaagcagggctaccgcttccgcggcaacgtggtgctgcacgttgacgacgacatctacaacgagcaggtcaaggtcgccgaggaaaagggcaccaagaagccggccgtgattccggttctcgaagtcaccgagatccaggaccttgcctccggtccgaccgccggcaagaccatcgccaaggactgattagctgacgtattggtggcttcctcgtcagagggagccactttttcgctttttagtgcgcagtactaggtgacggccttgggcgtcggtggtggcgaagaggtaggtgctaccaccgtccttgagtttgagctttttgcgcagctgggccacggttagggggaaattgcgtacggcgatgttggcgtgcgtgaggccggccaatagctgtttcagttctttcttgttcatggtggcgatggattcgatggcgaatgacctgcctggaaaatcggcaataggttcggccgccacgaacaggtggctattcgggctgatgtgatgcacggcgaagcgctgttcgagaacatcaaagcatccggccttcatgattgaggcgttgggctcgtaaaggtacttccaatgcgaggaatcgaagtcgttcgcgctttcctcagacagggaatcttcggtattgcaagtattgcgtgcagccaaggcagaatcgctgatagtggtgtgattgtcgctgttatcgccggccttgtacgacagcacctgctcgtcattagcacataccacgagcggtgaggcgtaacggccgcgccccaacaccagcaacaattccttgcactcattcccggtggagacgatatgcacctcatgtaccgcgccggcgaaatcggcgacggtcttatgccagtcgagcatgggggagagcttgaccatgaccgtcggtgccttggccagcagcatatccttcagggtcagcacatccggcatgcaatcggcaatcgcgtaggtacgcgagccatgatcgtcacggcgggccggatcgaggaagatcatggagactcggccaagcgtgtcaagcactgctgttgaatcatcattgatgacttcggcgtggtcaaggccgagtatcgggaaattatggcgagcgatatcacataaaatggattgttgttccacatatatggcacgattgaacactcgggacatgtaagaaaagtcgacgccgaaaccgccggtcagatcgactagggatgccggggagtcgtcgtcgactgcctcttcggccaacaatcgctgtgccagccgagccttgtactgtgcggtgaattggctggaacattgttccattgggacttgcggcgggaagatcagcccatcatgggacgcccagtcaggtagcttgagtgaagcgcgctgccagccggcaatttgctccagcgcgaacggcacatccacgtcgccatcatgcttggcgtgcaaggccacatcacgcacatcttcacggcggtgtttggcgatgaacgcccaagtcgactcagaaatctccatgccgccattctaggggttgtgctgagatgagtatggcaaaccgcaagagaacgaggtggcgaaaaccgatgatcgatgaagtgatgatgctgcgtcatggccgtacgcaatacaatctcgaacatcgcttgcaaggccagatcgatgtgccgctcgacatcgtaggccaatggcaggttgaccagaccggattcgcgctcgcttcacggtattactgggccaaggtgaaccgacttgccgagcatcccgaagccatcgcccagcccggtcctgacgccgccgaacgcactgatacgcgccagttcgaggaggctcctgccgccggccggcgcatggtggtgatgacctccgacctgttccgtgcccaacagaccgcacacgccttcgccgatattttgggattgccagtcacctgtgaccaacgactgcgtgaacgcagcttcggcgagtgggaaggcatgacccgcgccgaaatcaaagccgtggcagccgacgactacgcctcttggaaacagcacactgggggcgaaaccaagcatggtgtggaaagccgtgccgccgtggggcagcgaggtgccgatgccgtgcgcgcactggtcatcgactccgcctattcagacagcacgcccaccacgctgatgctcgtcacccatggctcatggattaccgccaccatctccaacctgctcgaacttgacccggacggcatgaacgcactcggcggcatgcgcaacgcctgttggtgccggctcaaagtgcgccacagcgtcaacggcacccccatcgaacagcccctgtgggagttggaggaatacaacaaggctcccgccatcgccgacagcgccgactgggagaacgggccgaccgatctgcgaggaccgcacatgccaagttggcagccaatcgtctggtgatggtcgctatgcgaaaccccgctcgcaaattcgaacggtgggtctagactaatctcggtttggaaccgtacagcgatagaacagtaagaaagcgcggaaggcgggtgagacgacatgctgagaatcttcagctcaatcaatggccaagtggagcagatcgagaaaccggaaaacggctcctggttatgtttgagcgaacccactgatgtggagctcgccaccgtcgcctcgcaaaccggcatcgacctggccgacctgcgtgcccctttggatgacgaggaacgttcacgtgtagacgtcgaagacgattacacgatgatcatcgtcgacattcccaccgtggaagagcgtggcggacgcgactggtacgagaccatcccgctgtcgatcatcgtcaccgaaaacctcatcatcaccgtctgcatgcaggacacgcccgtgctccacccattcatggaaggcacgatccgaggcttcaacaccttcatgcgttcgcgcttcatcctgcagatcctgtaccgcaacgccacgatgtacctgcgttacctgcgcatcatcgaccgcgaaagcgacaagcttgaactgaagctgcgccactccatgcagaaccgcgagatcgtgatgctcatggagctgagcaagactttggtgtatttcaccacatcgctgaaatcgaacgaaatcgtgatggagaagctcaccaccctgcaacgcatcaagcaatacccggacgacgaggacctgctcgacgacgtcatcaccgaaaacaagcaggctatcgagatggccaacatttacagcggcgttcttgcgaacatgaccgacgctttcgcctcgatcgtgtccaataacctgaacaacgtgatgcgcatcttcaccatcatctccatcacactgtccatcccgaccctgatcttctcgatgtacggcatgaacttcgatggcggcatgatgggtatgccgttcactgacaagccgtggggtttcatgctcattatcgtgatttccatggtgctttccggtgcggttgcctggttcctcacacgttcgcgcatgttcaagtaaggcgtttgacggttatgcaccactggtcatcgttcgccagccgtagcatgctccgcgctcgccgtccgatgcggcgcggatttcgctcccgactgatggcaggattcgccgcggcctttggcgtgatattgccattatccggtctggccggttgcggccaaattcaagtcaccaccgtctccggagcgccggaggggcccaccatcgccattggggtcgcagccgacgagccatcggtgggagcatggcatgacggcacataccagggcttcgacatcaccatcgccaaatacgtggccgccaaactcggctatgcgaacaagcagatcgtcttcaaacaggttcgccccgaaaaccggcgctccatgctggacaatggacaggtcgacatggtcgtcgcctcttggcctatcaccgatgggtccagtgcgatcgttgattttgccggaccatacctcacgaccagcgtcggtttgctggtcaggtcggatgagcgtggccgattcaccaatgacgcaggttcggtgggtgacgtaggcgacggcacggtgtgcgcagtgaaaggtgacgagacagtcggcatcttccgcggcaaccacccgcaggcccggattcaggagcgcagcagttatgcgcagtgcgtcacggccgtgcaagtagggtcggcggatgccatagcctccgatatggcggtgctttccggtcttcaagcggccaacgggccccagtatatggacgtgattgcggacaagggcgaggtcggttatggcatcgccgtgagtcaaggcaccagccaattggcgcagaaaatcgcggaagcattggaagacatggttgaggatggcagctggacggccgccaaggatacgttcacaagccaaacaaagctcacggtttcgctgaacggcgaccccaaagccatcgtctcggatgctgaataacgattgacgacgtgtccagttgcgaggctaccttgctgatttatgagtgacaacgagaagagcacgcaaaccgaagagcccaacttccgctacaacgccgcactggcgcaggacatcgaaaacaagtggcagaagatttgggacgagcaaggcaccttctgggccgccaacgtcaacggcgatttgaaggacggcaagggccgtaacgccgaaggccgcaccgcctacttcgccatggacatgtttccctacccgtccggcaagggcctgcacgtcggccacccgctgggctacctggcctccgacgtggtgagccgctaccaccgcatgaagggcgagaacgtcctgcacgccatgggttacgacgccttcggcctgcctgccgaacagtacgcagtccagaccggccagcacccgcgcgtgaccactgaggcgaacatcgccaacatgagccgccagctgcaccgtatgggcctgagctttgacaaccgtcgtacgttcgccaccatcgaccccggctacgtgcgctggacccaatggatcttctcgcgcatctacgattcctggtacgacgaggacgccaccaacccgtccggctccaggggctccgcacgcccgatcgccgagctcgtggccaagttcgaatccggcgaaaaggccattccgggccacgagtccgacggcaagcagtggtccgacctcactgacgccgagcagcaggatatcttgaacgacttccgcctggcctacatctccaagtccccggtcaactggtgcccgggtctgggcaccgtgctggccaacgaggaggtcaccgccgaaggtaagtccgagcgtggcaacttcccggtcttccagcgtgagctacgccagtggtccatgcgcatcaccaagtacggccaccgcctcatcgccgatcttgacggcatcaactggcctgagaaggtcaagctcatgcagcgcaactggatcggtgaatcccatggtgcctccgtgcacttcaccgtggccactgccgacggtgacaaggacatggaaatctacaccacccgtcccgacacgctgttcggcaccacgttcgccgtggtttccccggaacatcacctgctggagaacgtgcccgccgaatggccggccgatgtacccgaagactggaagggcggctatgccaacccggtcgaggcggtgaaggcctaccgtctggccgccgaagccaagaccgccaaggaccgcgtgaacgaggccggtgagaagaccggtctgttcaccggcctgtacgccaccaacccgatcaccggcgcgaagctcccgctgtttactgccgactacgtgctgatggactacggcaccggtgccattatggccgtgcctggtggcgaccagcgcgattacgactttgccgtgaagttcggtctgcctgtcatctacaccgtcacgcctctgccggattccggcgacgacttggccaactacgagggcaaggcgccgttcgtctcccatgacggcatcgtgatcaactcctccgtcgaggccaccgaagccaagggcgacgcgctgagccttaacggcctgcgcgtggacgacgccatcgccaaggtcaacgcctggctcgaatccgccggcgtgggcaagggcaccgtaagctaccgtctgcgcgactggctgttctcccgccagcgctactggggcgagcccttcccgatcgtctacggcgaagacggcaccccgcacctgctgccggattccgcattgccgatcaacctgcccgacgtgcccgactatgagccgcgcaccttcgatccgatggacgcagagtccaacccggaggcaccgttgagccgcaacgaggactgggtcaaggtcgagctcgacttgggcgacggcaagaagacctactaccgcgacaccaacaccatgccgaactgggccggctcctgctggtactacatgcgttacatcgacccgaccgacaccaagcacatggtggagaaggacgagttcgactactggatgggcccgaaccacaacaagtactcgggtgatgaaggcggtgtggacctgtacatcggcggcgtcgaacacgctgtgctccacctgctctactcccgcttctggcacaaggtgctcttcgacctcggctacgtggactcggccgaaccgttccacaagctgttcaaccagggcatgatccaggcctacgcctacaccgacgaccgcggccagtacgtgccggccgacgaggtcgtggaaggcccggccgacgcctccggcgagccgaccttcacctggaacggcgaacatgccaaccgcgagttcggcaagatgggcaagtccctcaagaacatcgtgaccccggactacatgtacgagaactacggtgccgacaccttccgcctgtacgaaatgagcatgggcccgctggacgagtctcgcccgtggaacacccgcaacgtggtcggtggcatgcgcttcctgcagcgtctgtggcgcaatgtggtcgatgagaccaccggccaggcccatgtgactgaggacacgccggacgaaaagaccctgaagctgctcaacaacacgattgccgaagtgaccgcggaaatggaaggcatgcgcccgaacaccgccatcgccaagctcatcgtgctcaacaaccacctgaccggtctgaaggctgtgccgcgtgccgccgtggagccgctgatcctgatgctcgcgccgattgccccgcacatctgcgaggagatgtggagcaagctcggtcacgccgaatccctgtccgccgagccgtggccggtggccgacgaacgctacgtgggccacgacaccgtgaccgccgtggtgcagatcaagggcaaggtgcgcgccaagctcgaagtgccggtcgacatcgatccggccgatctcgagaagcaggcgctggccgccgtcgccgaccgtcttggcggcaaggagccgcgcaaggtgatcgtcaaggccccgaagatcgtctccatcgttcccgcggagtgacttgttgcgagccagctcccctctttgaggggagctggctcgcgtagcgagactgaggggagcgtcaaccgcccacctcaattgtggataacttcataagctagaaccacataccccgtttcagctggacaaacgcccatgaatccatcagcgtggatgcatgggcgtttctcataaccatcgcgcagaccatgccgccaaccgtttgcgcgcattcagcaggcagagcgcagccatgccccaaccgcgagtggaacggcccacgacgcctccgccgcctcctggccatgcacggatccgtccggctggccacccgccccaaagggcgcagagcggcctgcggcaggcgacccgtgacaaacgtgcgttatcggatctgattggcgtacgttccgccgatgccgtcggcgaatcagccagactcacccgggatcagccgcgattgtcgttcaccattgggcatgccttggccgtgatattgctgctgatcgtcgcccttggcatcagcttggcattgctggtccaacagtcgatgaatatggccatgctgtctcaaccgaccgccatgcagaccacgggcggctccgctggagatcagacgatgccatcgcagaacaccacggacgagaaacgcacggatccgcagcagtcggagcattccgatgccacagcgaaccccgaatcggataccacgcaatctccgcacatgcagacggacggcagcgatgccggcgcttccacgcatggtcttatcaacctcaacacggctaccgctgaggaattgcaatccatcaaaggtattgggccggttaccgctcagcggatcattgatcatcgcacggcgattggcgggtatacatcagtcgatcagctgctggatgtcaaaggcatcggctccaagacgttggagaccatgcgagggcaggtgacggtcggatgagcagggattggatactgcgcgagcaggggagccgcgattggaggatgctgccgatcgccatagtgatgtgggcggcgagtctgggagcgcacgcattattcgcatggaggatgtctgatggactcggcaccggtcaggcaaaggctgatgccggagctggcattgacgtcaccataatcggcatggaatggcctgtcacgcgaatattgcctataacagtggcgtcatgtgctgccgtggcggcgatgattgtggtgtctttccgcctgcggatccggtggacgggaacattgaccgtatgcgttgcggtggcgtgcatcggcagtatgacggcaatcgcgtcggacaccattgcctggcatgatcctgcctccgcacaagctcgccaatccagttcataccacgaagtcatggccacggtgacgacgcccgtgatcgcttcggaccaacgcacatacgattgtcagacggacatacggctgagcggcatcactgtggatggtacggatgtacgttccacggtcgctgtgcgtgtatacgccgacgaatcgtattgtgggcagttgcgtcgaggcgcggtctatctgctgacaggcgtattgcagcaagcgcgatatggacgcataccactatggctgctcttggaaggaaaacagccggtagcacaggtgcgggctccgccgtggcatctcgccgcgattgcgcatgtgcaggaggcgtttttcaccgtgaccgaacaattgtccgatcaggggcgtgtgttggtgccgggattgacgatgggtgtgcttggccaggattatatcggcggcgagaccggtccgatgccggtcaacagcacgtatgcgcaaacgttggagaatcagttccgccagtccggcatcatgcacctcatggccgtatccggcggccactttgtactggtggcgggattggtgcgccggttatgcatgtggatgctgcttgatcggcggctgacggcgttgctggtctctggagtatatgtgctgctggcattggcgatgttccccagtgattcggtcacccgcgcgttcatcatgggattgataggtgcgttgacgtatgcgatggggcggcgtacgcaagcgttgagcgccctgtgctggacggtaatcggtgtattggcggtgaatccggatatgtcggccagctacggattcgccttgtcttcggccgccgtactgggtatcgtgctgtttgcggggcggctggccggtgcctttgagcgagcgatgccgcacggcatcgccgaaatgatggcgatgaccgtggccgcgcagttgttcaccctgccgattcaggtgttgatggaaccggagttgccgttgctgtccgtgccggcgaacctgttggtgtcgccgtttgtgggattggccacgatggcgggattgatggcattggcctgcgcatggtgcgagccatggctggccggcgtattcgcgtggatatcgtcatggggcacgctggtgatggaacgggtggcgttgtggctgggtggcagcacgatggccgtcatcccatggaaagatggcgttacgggtgccgtgctgattgtggcggtggaaatcggtatcggcatgctactggtgttcgtcagccgttgcctccagcatgtccgtcgttatgaggccggaatgcctggcgtgcgcttcggttccgcttggcatgtccgcctcagtctctggtgcgaggagacgagacgtctctttacgcggcggcaagccgaatagccaatgcggtattcggtgcagcaaccatcgcaatagccagccgaacctatgcgataggccgcgcggcataaaccatcagccggtaaaactgcgatacagttgagaccagttcaaccagctgcatgaaggagtgccggcgatgatgttgtctcataatccgatagtcgaaccatttgcattggcccacgccaccatcgtcaccggagataaagccggaaccatactgcgtaacatgacgatcgtggtcggagccgacggacgtatcgaacaggttgcacccagcatcgaaaccagtatcccagccgaataccactatcttgacggcaccggcaaaatcgtgatgccggggctgatcaatgcgcatacccatctgttctcccaaggcaagccgctcaatccgaagctggcgacgcccaaaggccaacgtatggtcgccacattcgcgcattcgccattgggcaagccgtacatggccgcaaccgtaaaacacaacgccacaacattgctggaatccggcgttacgacgatccgcacgcttggcgacgtgggatatgaagtcgtgacattacgcgatcagattgatgcaggccaaatcctcggaccgcgtatcttggcgtccggaccgctgatggcgattcccgaaggccatggcgccccgcttatcgcactgaccagcggcaccccggaagaggcgcgtaccgcagtcgcgcagaatctcaaggctggcgtcaacgccatcaaaatcgccgcgaccggcggcgtaaccgatgcacaggaaatcggcgaggccggcagcccgcagatgagcgtggaacagatgcgggcgatttgcgatgaggcgcatcagtatggtgttattgtcggcgcgcacgcgcaaagcccggaaggcgtgcggcgttcgctgctggccggcgtcgataccatcgaacacggtagcgtgctcgacgacgaattgatcggcatgttccggcacaatccgaatgcgttgcgcggatactcggcattgattccgacactgtccgccggcctgccattgaccttgcttggacaggacgtgaccggcatcaccgacatccaattggagaattccaaaaacgtggtcggaggcatggtttcaggtgctcgtcaggcgcacgaggccggattgatgataggcgtcggcaccgatacaggcatgacattcgtgccgcagtacgccacatggcgtgagctggagctgctggtcgcatatgccggtttcagtccggctgaggccctgcacgcagccactgccgtcaacgcctccattctcggcgtcgatgccgagaccggttctttggaagtcggcaaatccgctgatttgcttgtgctgaatgccaatccgctggacgacctgcgcgcgttggaacacccggcattggtcatcgcggccggtcacccggtatggcgtcccggtcccaagcgtttcgcggatatcgacgccctgttggatgaggcatacgcctaatcgcggggtgctgccgggccgttatgccggcaggtcattgtccaacctgtgtggcgagatgggggcatggcgaaaacagcagcgaacgtaccggtaaccgtggtgcccggaggcgactcgtatttgaacgacgcgcgcaccaaggcactgtgcgcacaagcgttgaaggcgcgacccgacgccgaactcatcgagctcgacgccacatcggccgaccaatatgccttcgatgaagccgtcagcccatcgttgctttccgacgttgccgtggtcaaactcgtcaacctgcagaatgccgacgaaaagctcgccgaagctttggtgacgtacaccaagcaggccgccaaggatccgaacggctccagcgtggtgatctgccagcacgagggcggcgtcaaagggcgcaagatcatcgaccaactggtgaaagccggcgctcgcaaagaggacgtgccggatttgaagaaaccggatgcccaactcaatttcgtactcggagaattcgagaaacgcggtcgtagagtcgaaccgatggccgcgcagcagctggtatccgtgctcggcggcaaaaccggcgaactcgccgccatgtgcgagcaattgtgtttcgactttgacgataatccgatggggctcgactgtgtcaaccagtatttgaccgccaatccgcaggtcaccggttttgccgtggcagacaaggccgtggaaggcaaaaccgccgaagccatcgtcatgatgcgtgcagctgtggaacaagggaccgatcccatcgcgttgatcggcgcgttgggcatgaagctccgtaccattgccaaagcctcggcggtccgggccggcacgatttcacaggccgaagcgaaaaccaatccgtgggtgctgaagaatgcgatgcgccaacttggcggctggacttcggcaggactcgcgcattgcatccgtatgctcgcctgggcggatgagcaaagcaaaacgaacggcggcgacccggtatatgcgctggaacgctgcattgaagacatcagtcataaaggtcggtaaaagtcgataaaggggtatttatgagcgaacacactattgcggctcccaccagcgaggccatgcaggagctcggccgccgcgtggccggaatggtacacggcggcgatgtattgctgctctcaggccctcttggtgccggcaaaaccacattcgcccaaggcttcggggcggggctggacattaccgaacccatcgtgtctcctacattcaccattgcccgcgaacttgacgggcatttcgccgacggcactccggctcatctggtgcatgtggatgcctaccgtctgggcggctcagcctatgcgccggggcaggacgccatcgggcgtttgttggacgagctggaatcgctgggattggacgaagaacttgaagaccccggcgagaacacggtggtgcttatggagtggggcgaacaaatggccaccgccttggctccagaacgacttgaaatccatatcgatcgacctctcgattcctccgatgtcgcatccgctggatcagacggcgaactcaccagcaacggcactcgtaccgtcgcattcgtcccagtcggcaagcgatgggccgcgttcgacctgcaataagccatgcgcccatagactcctcgatgtacactctctagaggctttacgactaggaggattcatgggttgcacgttggtgattgacacctcattcggttcgacggtcggcattgtggggcgcgagcccattgtggagaccgattcgcgcacccatgtggagaaactgcaggtcaatatcgcgcgcgcggtcgaggaggccggcctgactcctgccgatatcgaggagatcgtcgtgggcatcggcccggcgccattcaccggcctgcgcgccggcatcgtggccgccaaggcgttggccttcgccaccggggccaagctcgtcggacagaacgtactcgacccgcaaggcgagatgatgagcttcgtgctgggtgacagcgccatgtttgacggcatcgatttcctggccgacgtgccgcgcttgagttcgcgccaatcggatggtgacgtcccggacgccgaggccaaggaacacgaactcgaccgccacgtcacgctgtgcgtcaacgatgcgcgccgcaagcagctgtacttctcgctcaaccacggcagcatcagcctgccggacgaggacgccgccgaacgacgctggatcgagatggatatcgactacccggagcatatcgtcgaacgggtgaacgcggcgctcgcggaacacggcgaacgcgacggcgtcagctatgtggtggatgtggccggccacggcgcggccaaatacgcgtccgtctggcagggactgcgtgcgctgggctccgtggtggacggatcggtattggatgccgggaaagccgggctcgccgtctttgcgaccaccgcgttgagctgcgaactgcgcggcgaccaggtcgtgccgatcgaaccgttgtacctgcgccggccggacgccgaagtgccgaacccgctgaagcacgtgctcggccatgccggtgccgataaagcgtgaggcgggttgtgtccgatgattgttgatatcactgctgtgagtcgtgatcttgcggttcgttccattgcacagttggaaggcgaactgttcggccgcggcgcatggaatgcgaacatggtgcgagaggaactggacgcaccggcccgcacgtatctgctggatgtgctgggggaggcggaacaggcggttgtccgcggctacgccggcttctggtatgacggcgaggacgccgagctcatgaccatcggcgtgggcaaggcataccagcggcaaggcatcgccgctgcgttgcttcaggcactggtcgacgaggcgaaacgtcagggcgcctcgcgcatgctgctcgaagtgcgtgtggataacgaccctgcgctggccctatatcagcggttcggattcgaacgcatgggattgcgcaaacgctactaccagcccgaaggcatcgacgcatacaccatgagcttggacctgaagccgagggtcgtgggctttgccgccccgcagacggcatcggcggacattgaagacatcaccagcaagcaaacggagaagaacggagaagcacgatgagcgaaccggttgtactgggtattgaatccacctgcgacgaaaccgcagccgccatcgtacgcggccgcgaactgctctccaacgtcgtggcctcatccatggaggaacacgcgcgatacggcggcgtgatccccgaaatcgcctcccgtgcgcacgccgaggccttcgtgccatgcgtgtccaaggcgctcgccgacgcgaacatgacgttggcggatgtggacgccatcgccgtgtccgccggtcccggactggccggttgcctggccgtgggcgtgtccggcgccaaggcgctggcctgggctgcgaacaagccgatctacggcatcaaccatgtgatcgggcacatcgccgtcactcagctgcagttcggcccgttccccaaggacacgctggcgctgatcgtctccggcggccacacctcgctgctgcacgtggaagacatgccgcgcaaaatcgacgtggttggtaccacgctggatgacgcggcgggggagtgcttcgacaaggtcgcccgcctgctcggcttcccgtatccgggcggcccgcacatcgaccgccacggccagaacggcgacccgcacgccatcaaggtgccgatgggcctgacacaaggcaaggccggtgccgcgcacccgtatgatttcagtttctccggtgtcaagaccgccgtggctcgctgggtggaaagcgagcaggccgccggccatgagattccggtggacgacgtgtgcgcctccctggccgattccgtggccaccgtgctggcccgtaaggccatgcgcggctgccggcagtacgattccaacacgctgatcgtgggcggcggcttctccgccaactcgcagctgcgcgccaaactgctcgaattcggcgagaagtacggcgtcgacgtccgtatcccgcaaatcaagctctgcaccgacaacggtgccatggtcgccatgctcggcgtgaacctggtcgaagccggcgtggcccccagcgcccccgacttcccgattgactccgccatgcccctgaccaaggtttcgatgtaagatttgcgcggtattcccaaactcatactgggaataccgtgcctctcatcggtgaattgacagtgacctgtctgcctgatgtgagtagtggtgaggtcttcgccatggatttcccggttgatgatggggtgtcgtgtctggtcaccaatgcgatgaaaataaaaaagcctcggagaaccgaggctttcgatggctcctgcggctgggcttgaaccagcgaccgtccgattaacagtcggatgctctgccaactgagctacgcaggaatattcaattttcatcccgtccggagttacccgttcaggtgagctcctgcggctgggcttgaaccagcgaccgtccgattaacagtcggatgctctgccaactgagctacgcaggaatattcaattttcatcccgtccggagttacccgttcaggtgagctcctgcggctgggcttgaaccagcgaccgtccgatatacggttctggctcgcagccgtagggctttttgcaacaggagtaaacaatacaccagccttgctgttccttcaaatcggcgtgtcatcgcgcatgttcgccttgcagctggttttccgaagagcatcggccagaaacgcgcaatagtattccttgggaagtgatgaagaagtcacttcccttttctatgcgcttaaggagccccatgaggtattggaacgacaacaggaagagctgcgaacacgtcgagccacgggaggattggaaagaatccattgagaaatggatcgactggatggacgccatcggacgcacgaacgacaccctgcgcacccgctggtaccagatcgttcgattctccaaagccgtcgataaaagcatcaccgacgtgaccgaagacgacctcatattctacctagccggcatgggaaccgaaggcagacgcggagtacgcagctgcgtcaaggtcttctaccaatggagcatgaagcgagggctcgtccgccgcaatccggcggacgaagtgcccaccgtgcccatgacccttccgtccggctgcatctgtcccgaggagaacatcgaacaaggactcgcatcacccgacgagaacgcgcggctggccgtcatgctgggcgcgttctgcggcctgcgccgcatcgaaatgaccagaatcaacctgaagaccgatctggaggagaacgccgagggcatggtgctccacgtccacggcaagggcaacaaggagcggatgcttcccgtgccggcaaagctcgcttcggcattgcggaaacgcaccggcgtatggctgttccccggagacgtgcagggacactgcggcgtcgattacgtggcgaagaggatcaagacggtaaccggatacccgtcgcacagcctgcgccgtaggttcgccacatgcgtctactacaggaacggctgcaacatcgtgcttgtcagccgtatgctggggcacgccaacatcgccaccaccatgcgttacatcggcctcgtgcaggacgaaatgcgcaacgccgtggaatccaccacccgcaccgacatgagactgaccatgcccatgaaccaggtcgtcggaacagccggcagcgtcgccacctattcccttagcaccgcgaggatcggatgaacaaacggtatacgccaacatgcttctttgcgcatattggcgtataccaacaccgctcaccgagtgttcccgagactggaaagcggcaacgcggctatgtctatccccagcgcatcggctgcggagaacaccgcttcaatcggggcttcgccccgctggagcagagcatcggcaaaccggggatcgataccggcctgggaggcaaggtcgtcggcgttccaggaatggttcgcggtctcttcacggaaggcggctgcgatatccgattcggtgcgggcgaaaagagtccggcgttcacgcggcgcttggaaacggctgaggtaacgcgcgtactccaattgcgcctttgtcggctcaggcaagttatagtccagattcgacatcgcagacctccttagcgttcagcgggttggactggagtcgttcgacgcaccgaaaatagggaatccgggaaccgcatcggccgacgatggagtgcctggagtgccgtacaacgtcccgatctgttcgatcgcccatgcgctccaacgtggggattcgaccgtggatgtcatcaggccggcggggaggaaccggcgcatctcgtcggcgaaggcatccgagccgatcacatcggcgacccccgccacgcgatcagcacggtctgcccaaagtccttcttcgccgtaatcagatgatttcaattccgcaagctccatcgcccgtcgggaatcgacgtcgcctctcgacgccaaccagcacatgtcccacaggtcgcgtcgccgcaggtgcgatgcgcaggcataggagagcagcttgtcggcaagaatctcggtggggctttccacatcgaggatgatctgacccgacaaggccgggaacatcggatagttgaccaaggcgggacgatgctgcggctcgtacgcgggaatcgatgccacctccagcttgattgtctggctcggcagatccttgcgctgaccggccgtgcgaatcgctatacgccatctgcgcgtcagcccatcggcgtcgggtctcggctccttgacccggaccgtcacatcatcgcccatccccgagagcgaatcggagatgcaggagccaagccctttaagggtgtccatgtcgaacgaggtgccgccggcaaaatcaaggtcctcgctgtacctcggggacccgtggcacaggcgcagactcgtgccgccctggaacaccagcgaggagaagaaaccctcgcgcatcatggcgtccaggattcgataatgcagaagttccttctcgaccacgggaagcagattgcccatgccctcgcccccggccaagacgatcccggccgccatagccttgtagtcataggtgccgtcagctccagtcatcatcgtcctccaattcgtccatgtccaccagatcgaggttgcgtccgacggccttcaggtcacgatacgcccactgtttcgacgcgagcggcgtcagtccgtcatcgcgggcgatcaggttcggcaggatgcgactccagctgagcttgcagtgcgtgaactcgatcaccccgtacgcggtgcggaactcgccctcacggcccgtggtcatgaacgtgaccctatccaccggaatctggctgatcacgttccagcgcgacagagcgctttcgaggctttcccacaccagctcgccggaacgcaaccgctttgcgacctgatgaagtgtcccctcgccgagatgggaggaatacgcgaacacgtagacgccacgggcggcacggaccaacgccttcgccgataccaggctggacagggttcggttcagtttctgcccctgctcgcccagcacgacggccagttcgttcttgcaatacacgtagcacgagtacttggcatccatctcgcgcagctggtcaatcgcctcgctcctcttcatgcatataagtgtacatgaatatatgtaaaaacgcatattcatgtacacctatcacaatcctgaagcgttccaatcagagggaacgccctcgtgccggaccgtcttcgagaccaatcccgtcgatggcgttttccgagaaagggttctctcttaatctgccgacgatttccgctacggcgcgctcttcctgatcaacgcattggacaagctgggaaatgaacggcttgggatcgccgtcaacctgccatgcttccagacttttcccatagctgcggccggcatcatgtttgattgctacgggccggtagccggcagccatgagcatgagattcagaatctgtcgcccggttcgcccgttgccgtccgtgaatggatggatgttctcgaacatcgcgtggaatccggcagctttgaggatcgggtggtctttggaaccgttcaccgcgtccacgagcgcttccatgtcctcgtagatttcaagtgggtcggcggtcttcactcgggtggcggtgatccttgcctggtagccgtaggggcggaaccgacccctgagcgcgggctgcatgtccaatgcggtgacttcatgcagcttttggatcatctcgacactcagcgtccgctcctcttcagcgaatcgttccgcataggccatgccatccgcaacgccacgggcggcgaagatgtatcttgccggcgagtcggtcggcacgaactcgccctccaacaccagttcggtgtcctcaagcgtcagcgtggatccctcgatcgcgttggagttgtagacatagcgggccatccattccttacggtaatcctcaagcgctgactgctccaccccatccaaaggaaacatctgcctgaaccgttctcgggcagcatcggaacgacgaagcaagtcggacacctccgcgtcccgctccagagagtccaagagaggaggaaggtttcggattttctcagtcagcgctggattcggcatatcggctccttaatcgatgcttccataagtctacaagcgcaggcgcgtcacatggacagtcctggcgtatctctacctccacactgccgtcgtggtggtggccgcgcatcttcaggattccgttctcgtcccagatgtggtcgatctcgcaatccttgaacggggaatcatcgccgttcatcagatcatcgaaggtctcgaacgaggatatgcccgtgcgttcgccgtcccatcggccgatgacgccgaacgcgatcagcgggttgcctcccatcgggttcctgtacgaggagagaaccgactgggatccattgaagaaatcacgtagagcgccggtctccatcctgtaatcggtttgacgggattcgtccgcgaaggcatcgaacgtgatcgacgtgccgctctcctcgtacagccgccacaggctgtcggcgcgggtgctgtgttcacggtaatacgggtccccgtgtcgcgtgtcgtagtcggcggcgttgtagatgggcctcttgaggggttccgggtcgcgtatctcgtccgtccaattcatgtccatcatgtgctccttcgctttatcgtccgtgtgtcgtttccatgccgtcatccaacgcgaggccgagccctgcggtctcaggagacgtttcctgtgggtcggcccagccgacggcgaggtccagcgcgccgcgcaacgcctggccggaaagccggtacgtccaggaatcgtttgcctcgtaagggaaggattcgccggacacgatgccgcgctcgtcatgcaggctcacgtcgaacgttccgggtttggccgtgattagcgcatgacgggcggaaccgggagccgagacctccagcgcctttctgccgtcgggagacccggtggcggtgaatttgatatcggggtggtgcgcgaggctgtaggaagcgttggactcacacgccagcgggaccgtatctcccagcccgctgtctgcggccagctgctgtgggctgtaatccatgccctgcgtgtagtcgatgggctgcgcgtcggtgtagaagcatccgccgccatcgtccgcgtcgatcaggtcgcccacgagccggtccaggcgtgcggggtcgtcccatgcgctcacgagtctggcgggttcggcctggttcttccatgccatgtagcggtcgcgttggtcgccgcagatgccgtcgaatgattcctgggagatgaacgtgccgccgtccaattggtagcattccccgtccgggtccaacgcgcgctccttgaactccttttcggcggcggcgtacaggcgcttgtcgagcggttccatggccgcgtcgatgcccgccatcatctcgtccacgtgttgccgcatgtcgggctggctcgttttccaccatgcctgcaagtcggcgagcacgtcggcggcgttctcccgttcgcacacgtcgagcaggtcatcgtcgtaattttccaccgtccaggagtagaaatcccagtcactcgaaccggtcaggcgttcgatgcccttcatgcggtggaagtccatcaacccgccgccgtgctcgcgcacgatgcccgccaacggcagatcggcctcgtccatcaggcctttccagtattcggggacattcccgttctccatgtcgttctcctttccgaacgccttttcgatcacgagcgggtctcgtgggtcaacagtgcggtcgatccgcagtatctcgggcatgaccgcctcgctttcacggccgatgacgaacgtgccgataccggccttgacgcgatgctcgggaagccttcccgaaccgtcgcacatcaccgccggccggaacagcgaatccccgtaggcgagcgtcaccgtgtcgcccggcctagcgagaacccgttcgacggccatgcgtgagaggccgtgcgcgtcgagacggccggaacgccaatcgttggcctcggctgctgtcagggtgaaggaaacggaacgcccttcctgggccgaggtcacgtcgagcctgactggctgcatggcctcgaaaccgatccagatgccttccggcgtcctgtccggggctttcacgtcaatgtccgtgaacccgtattcggtcagcacgtccgtgaccctgatcctgagcgcgttgtcgggaggcagatcagggcgttcattgggaatcgggagcgaggacgcctcgaaccacacgtcctcgctcggatcggtgtcgaagccgccgtccgcgtcggaatacgccatgtggacgccgaactccaattccttggcatcggcggaagagaccagaatcgcgttccccagcacgagatcgcgcgcgttcctgcgcaggatggattgcatgtcgggcttggcgggattcccggccgcgagcaggtcgcggttcacaccctccatgtcaaaaggcgtcaaggccatctcgctcgccctttctcacttggaaaggccggaaccggccgtatcggtcatattcagcgggtccgaggggtcgcacgcctgcgcgcgttccgcgaacgaggtgacggcaccgggcagcacatatcccagatcaaggtcgatcgggctcacgccgtcgtcttcgccgacggacgctgcgggcattgcgcccatggtctcgcgcagcacgtccacggcgtcgccagtagcggcgcgcgcgtcgatgatccggtgcatcgtgtcctcaagcgcggcatggatatcggtggaaccctcctccacgatgcactggtatgagggggctccccagttcgtgccggtgccggaaatcgtgtagtccgcgatgcgttcgcccggctggacgagcgaggcgaggtcgaacgcggccggcgaaccggtcttcgcgtcgaaatcatccagccattcgacctcctcggcgatctcctcgcgcgagtaccggccgtcgatatcgctcggccagtccgcgtcctccagatagccgttgtcgccaagcgacacatcgccgtcgagcttgaggtcccggccgtacatctccatatcgatcagatagccgagccccgtatcgaacatggaccacacggcatccgatgcccacccatggttcacggcggtccaggcatacttcgcctccttcgattcggccgaggacggcgcatcataagagtgataggggatctcgtccgagttcaacgcgaggttcgcgtactgcaacggggtgcgcgggaccgcgtcaagatcgtcgcggaccgtctgcaccttctcgtacacgtccgggtcgtcgtcctcgcgcgcctcgaacgcgcggcacatgaggttcaggtccgtcagcgactcgtattcgccgggattcgccacggtggcgagcagtccttccccgccctcgtagtcgtggatcgcgtactcctcgtaccggccgcccaatcccacctcggtcttcagggtgtcctgcaagcgttcggcgggcatgggcagcgtgatccacgcgccctgcaacacgccctccacgtatttgcccaggttggcgacgtacacgctgatctggtagtccttcaatccggccatgatgatgctccttcgctcgggtcttttatcgtgtggctgcggccgaggcagacgtatcggcaatgctcaacgggtcggccgggttcgcgggatcgtaggtttcggacgtttcggccttctcgccttcgtctttgcgggcgagccggccgtcgtccaccatcgcgtcgatgatctcccatccctcctcgatgctgcggtcccgcaattccctggccgagatcatgtcgcgcatcgcgtccatgttctcgttgttgtcgggccagtcatggtctttcagccagtgccgaaggtcctcctccgtccagcggatctccgcaatcgtttcgttgccttgcccggcgttgctttgaccgggatgaagcaacgcctcagatcggagaccgaaatacgctttgtcttcctggaggccggacaggaagccggagggcgtgaacccgttgcgtgccgcgaactcgcgggaccagcattcgtcgaactcctcgtcggggtcgaagtcgaggagcccgtccgccatggcgcgcctcagccccttctcgtccgcctcggccggcaccgtgaccgtgaccgtggcgtggttgggggcctccagcgtcatgtacagttcgctgtggccggcgtcgcgttggatgaagcattccccgttgccccagtcgagctcgtgctgctcgatcagctccttcgccttgtcggtcagggcccgttcctgggacgtgtattcgtcgggttccatcagcatgatgcgtccttccttcccttggatgatcggtgccgcgccgtccggcgggcatggctccgatcatcagcccatacgggcggtcgcgcggggcatggcgtctacggggcagatgattccgccgagatttgatgctcggtccctttacgtgtcccgctccttagtaccagttgtgggcgagccagaacgtcttggcggcgctggggctgccgtaccggccggcgatgtagttcaatccccatttgatctgggtggcggcgttgtccttccagtcgtctcctgcggaggcgagtttcgaggcgggcaacgcctggggcatgccgtacgcgccgctgctcgggttggtggcattccactgccatcccgattccttgttccacagccatacgagcgcgtcatagtcgccgtctccccagtccttgtacgaggcgatcatcttccgggcgatggcccgggcctgttccggcgtggcgtgggtgccgtcgccgtcgtagtccaccaccacgtccgtggagcccgagtcggaactggagcacgtccatgccgcctccaccggatccgaagaggaggacgagtcggacgatgacgacgaatcggacgattcggaaccggatgacgtggaatccgtgccggcggaaccattggtggacacactgccgttgggcaggatgtagaccgcgccgacgtcgatcctgtgcgtgcggtggttgacgatgcccaggccgccgcgcccgttcatctcgctgatggtcacggtgccggccgtccggtcgaccgcctcgacgacggcgacgtggccgtacagggtgtccgcgtcggccacgccgggcgggtagctgacgatgctgccggccacgggatcggtgcgggtggtcttccatccggcggcggtggcgctggcggcccagtcgccgccgttgccccagtaggagcccacgtccaatccgattttatggcctctcatgcacgcccaccatgtgcattgcccgtccggataggcctggcacacgttgtcgggcccgtcggatccgttgaaccacgccttggtctgcgcgatggtcatgccgtcacgcacctcgccggtcgtgacgcttcccgtgacgcctcccgacgatccgttggagccgccgtccttgcagccgccgaggaccgcgagcacggtcaacggcgtgcatccgccgagcagggacagcaggcacgccgagagcatggccgcgaggatccgatggcggctggcccggctcattgcgtgttcctcagcgaccagaagggcttctgcccgccgaccacgacctccacggtccggcagggatgctggaccgtgccgtatccggtggcggagatcaccgtgtacgcctcgtcgccggccttcacctgatcggggtcgagctcgttggcatccttgtccagcaatgacgcgtcgagcgcggccgggcagtagacggtgacgtgccagttgccgtcgtccatcggcaagagcacggtgttgtacgcctggctgacggtctgctgcggatccgtcgtggatgacggtccgccgccttccgggatcgggaagctggtttccttcgtcgtccagaacggctgggactggatggcatccgtatccgagccctcccatttgccgtcggaggtgcaggtgtaggcgtagttgacgtacttgtcatcgtattggcccgagcatacggatccggcgtggaagcggcgctgggtccaccaccagcgcggcgcgtcggagaccggatggctttccccggcaccgtcgtcgccgagcagcgcgaacacgttgttgcgccattcgtcgtcgctgccgtttggatcgagcagcgcgtccaccgtttccaatgcggtgtcgatcgggccggaaccattgtgcagcgtgatgccgtccgcgttttcggagagcgtgcgggtgccgtccttgtgggtgtcaacggggaacgcggtggtgcgctgagaccagtcgccgggaaccgggattcccgccgcctccaggccggcgtaccgtcgcgggcccgaatccgttttccttttgcccgtggactcctgtttcgcgtccgtcgcggaaccgtggtcgtcgccggccgttgacggctggtggttggcgacgatgacgcccagcgagcacacgaggagcgcggcgacgaacaggcacaggacgcgcagcggtttcggcagcggacgcggttccggccggttcacgattcaccgccttcccaacggttcggctcgcccggcatgccgccttgcgtgttttcttccatggccggatgctcccgctcggggttcacggttcccggatccgcgttttcgggcgacccgtcttccgccgacccgtcttccgtccccgtccaccgcgcgtctatgaggtcgtccgccgttttcagttcggcgctggtgtttcccgcgtccttcgccttcctgcgcagcagggtggccttctcgcgggcctcttccagacgttcctccaatgatttgatgttgacgcgcgccgccacgtactcgtccatcgcatcctgtttcgtcttctggctgtcgcgcaccgccttgaggatgctgcgtttcatgtcgcgcatggtgttctggttgttcgccacgacgatcttcctttcgctcgtttttccgtcaaggcgagtctgccttcccgtcgcgcgttccacggggcatggcgtctacattccccatggcggaaggcggggcgtgtagacgccgtgccccgtggccggccgttttgcggccgagaatcggaagcgtcgttccaatcaggtgaaaggaaaatcaatggaatcgtttctctctatgctcgccggctggttcatgggcctgtggacgtggctggtcgagctcaacgggatgctccaggtggtgctcgtgctgttgtgcgtggtcgcctcgggcgtgtgcgcgatcatcggcaaacgcatgggcagcccgatgatcgtggaatccggcggacagacctggagccgcacgctggtgacggccatcgcgtggatcgccggcgtcatcctcatgctgatcgcggtgctggccatcgccgccgtgttcgcgccgctgctcggcttcgccgcctgaccttggcgacgcctttccatccagggccggccgggaagggattcccgcgccggtcctcgcatgtcggacaagaatcaaggaatcccaaaaaacggaaggaacgcgaacgaagaatgaagctcgtcatcgcggaaaagaaatcggtcgccacggccatcgcgcaggcgttgtgcgccgcgcccgtccaaagggacggatgctatgagtgcggccagctgctcgtgacatgggcgcagggccacctgatcgaccttgccatgcccgaggactacaaggacagggattggaggaaatggagtctggacacgctgcctgtggacccgtccggccattggcggtggaagatcagcgaggagcgcggtgccggctcccgctaccggcagatcgtgcggctgatccgccgaacggatgtggattgcctcgtcaacgcctgcgaccccgaccgcgagggtgaggccatcttccgccgcatcgcggacatggaaggctctcacaagccggaactgcgcctgtgggtggcgagcctggaggcggaggccatccaggccgcgtggcgggcgatgaaacccgaatccgaataccaagggctcgcatggtcggcggagatcaggtcgaaggcggactggctgatcggcatgaacgcgagccgcgcgtactcgctgctctacaacgcacggttcagcgtgggccgcgtgcagacgccgacgctcgccatgatcgcggaacgcgaccggcagatcaggaaccacaaaccggtgccgttctggaccgtgatcgcggacatgggcggatggcggctctccagcgaacggatcgacagcaaggatgcggcgatgctgctgtgcggccaggccgaacacggccgcttccgcatcatgtccgtgaaccggaggcgggtgaacgaccggccgccccgcctgtatgacctgaccggattgcagaaggacatgagccgcatgtacggcatgaccgccgcgcgcacgctcgcggcgttgcagcacctctacgaactcaaactcgccacctatccgcgcaccgacagccggtacatcacgcatgacgacctcgaaacgctcacggcgctcctcgaatccggccgtctcgcccaagggttcgtcacccgcgagggcatacccggacacccgcgcccggagctggccgtcaatgacgcgaaggtggccggccacaccgcgatactgccgaccatgcaattggacgccgggaagctggaaggcctggacgatgacgagcgcaaggtgatgacacgcatcgtgcgccgcatgtgggaggccgtgggcgacgaccatgtgcacatcgtcaccgaggtgaaggcccggctttccgacgacaccgacagggagttctccagtcgttccgacgagaccgtatccgcaggatggaaggccgtcgaaaccggccacgggcccgaaccggaagacgaggaaaccgcgaacccggcgggaggaaggaacgtgatcccatcgaacctcatggaaggcggcgtcattcgcccggtcgggaaggtcacggtcgaggaaggcgagacccggccgcccaaaccgttcaccgaggccacgctgctggccgcgatggagcacgcgagccggtgcgtggaggacaaaaacctcaaggcggcactcgatgacgacgaatcacattccggcggcatcggcacacccgccacccgcgcggacaccatcgaaaagctcgtgcgctccaaactcgtggaacgcaagggccggcaattgcacgccaccacggaaggcgaacgcctcaccgacgtggtggagccacgactgaaggacgtgctgctcaccgcacggatggaacaggcgttgtccgacgtggaacacggcaaacgaggcccgtctgaggtgatggacatgttccaccgggaggcattgcgaatccccgccgacgcgaccgcgaacctcaaggccgatgccgtcacacgaaccgcgaacaccgacgcgcaggattggggcgactgcccgcgctgcggccagccggtcaggaaaaccggccggatgtggcaatgctccacgaacaagaccgagaagaccaaggacggcaagtgggccacgaccgcaggctgcggatggaagatgttcgcgcgcatcgcgggcaagaccatcaccgaccagaccgcgcgcaggctcctcgcgggacaatccgtcaccctgaagggcttcacatccaaatccgggaagaagttcgacgcggccatccgcatcgacaaggaacgcggcacggcgttcgatttcgaccgctgaccaaacgccaaccatccgtgcccgacgcaccatgccgcgccgggcacggcaacgaccaaggagacgatgaaaccatgcgacgatacagccacgccttccgggtcctcatggaccaggagctgttcaatctgcttgccgaggcctccaccaagacgggcatacccaaatcccgtttcgtgagatacgccatccagccgttcagctacacggaactcgcccccggcaccaccgattggaacgacgtgtaccgcaccgaccccgaccccgaacatccgctgaagcggggacgccagctcaatgtcatgctcaccggcgacgaatacgagatgctgtgccgggccgcattcaagctgggcatcgcgcgcagcgcctgggtgcgggaacgggtgtacgcgctcctctgccgctcctatgcggacgagctctccccgctcacggacgcgagcatccgcgacaacgcgacgatgctgctcaaggagctcaagacgaaggatgcgggaagatgacattccaaaaaaaggaagagccccttcccattcgtggaagaaggcatcaccccgaacgatcatccaccctcatgcgttttcctatgcgctcatatggatatgtccatggatacccacatggacacgtccatagacatccacatggatatgtccatggacatccacatggagatgcccatcaaatcgaaggtaagcaagctagacggttcatgtacatgaaccgaacgcagcacctcccgcgcccgtcggcgcaggagcaacaacccgagtgccgaaggccgatggaggagaagaaagaataatgcgtaaaagaagcagcaaaggcggcggcgcgcagcgctccatccaagtgcatctcatggtgaacgaagaggaagccgcgatgatccgcgccgccgcgaggaaacggaaccagacggtatccctcaccatcatcgaagcggtaaagctgttggagggaagcctgtacgtcgaggaggaggaacatgattcgcccaccgtccaggcgctcagggagatcgaataccagctgcgccgcatcggccgcaacgtcaaccagatcgcgcacaacgcgaacagggagatgaacgcgaccatcgaggacgaggcatcggcgtcctacgccgtccggcaatgccgggagctgatagaccatctcgatgccgtcatcgggcagtccgggggagtgcctgatgacgcgaaccggtcagaggagggtcaggctttgcggacggtccgcttgtagtccttggatttcttcgatgaaccgggagaacgtcatggtttctccctggatcaggtcgtcataggattccttgactaccttgggcatgaccaggtggatgtgcagttcatcgagttgggcgagcttgggatgggtcacgtcgccgggagtcagggtgaacaggtgtttgtccctgatccggttggcttcgtcggcgacctggcggaaacgatccttgatggaggttttcgaggcgagcatacgcagctgttcctcggggaacgccggatcctcgtaggcggcttgcgagggaaacatgtcgccgctcgcgcacacggtgcggcagcgccggaaacttataggccggctcgaagtcatcatcacgcaagccgaccgtaaataatcccatggagttcgggagcacccccggacgccacgaccgtcacctcagtaagccggaacctccatcgaggccgtcgaggggaacaccgggcacgatgcccatcccgttcacggcatcattcgtcttttccgcgaccccagacgattgggccaaagtcagcccgccgggcacatggccgacggcgttctgtgagagccaatcggagagccgggagtagtcgcccgtctcgtagtagcgcaggagcatagagacgaactgtgccttgtcttcgggagggatcgagaagacgccgatgccgtcgtgtatgagctggtggttggcaaccatcagcgcggtgcgcttgttgccgtccgaaaaccattgtccccgcgtgaccgcgccgaacagcagcatcgcagtgtcctccccttctgactcctccaggatgccgcgaaccctttcctgtggggattcgacggtggggatttccggcacccatcccgtgccgccgatcctcacgccgtattcacgcaagcggccggcgtcgcgcacgcggccttcgccgatgatgcggttgtattcgcggatgtactgccaatcgactggatagtcgatgttcccgagcaggaatccccacgcgcgcttgatgttattcaccgtgactatatcgtccacgctcataccctcgggggcgcgcccgtcgaagatttcctgcgtgtcggggaaggtgacgccatcaacctcgatcttggcggtgcgccagatcaaatcgaccagcagccgcttcgccagttccacggccgtgcgcctatccgtcgtcgtatcgttcctcaccggttccatcaaagccccttatccgtttccgataattctatcgaagtggccgtgccggcaaagggcgcatatctctcatagacgccatgcgccgccgtgccgggcgcgcgggcggagaatcatcgtatgataccgaatatcgtcaggggttcggacccggccggcctggtgcgctacctgttcggcaagggacggcgcaatgaacacaccgaccagcatctcgtgtgcgcgagcggcgacatgtttccctcgtttgacatggatggcaagccggcggcgtcgtatgcggagataggccgcaggttcgaccgacgctaccgcgtcagggaacgcaaggacgatccgttcccgcccgacatgaggggcaagaacaaccccgaacgagagcatggcaggaagcgcgtgtggcactgctcgcttgccatcaaggccgggcagggaatcctgaccgaccaggaatgggaggccgtcatccgtgattatctgacgcgcatgaacatcatcgacggcgacgacgatcagggcgtcacatggctcgcggtccgtcacggactgtccgccaacggcaacgaccacgtgcacatcatggtgcagctcgccgccgacgacgggtggataaacccgtaccacgaccggatcaacgcgcagaaatcatgcaggcggatggaaaagacgcgccccgaactggtcgagctcgcacgttccgataccggcacgcgcgtcagctggcagtatgggcaatggcgtcaatgggccgaatggaaggcgcgaaacgagtacggcgacgacgagggatgggatgcgttggacggcaacgagagaagccggctcgtcacggcggtcgccgcctcaacgatgccacgccaatacatcgcccgaatcgtggaggcgtgcgccaaggcatcgcacagcgaggacgagttcatacgccgcgcgcgcagggaaggcttctccatcgaccccaggctgcgcaagggaaccgccaaagactcgttcaccgaccccggccaggtggtcggctacaggatcacgtggcgcagcacggacgggtggacggaacggttcaacgccttcgagctcggcgacgacatgcgattgaaacgactgcgcgacgactgggcggacgatgccagaagccgcagcctcgccgtgcaggaatggcgcgccgcgatggagaaccgcccgcccttcctcgatgatggacgcgaacggcacctggagaacctgtccacgcacgacatggaacgcctcgtatccgaagcgttctgcatcgccgccagcctcaacaacgcggcggacgacgacgaataccgggcagcgatgcgcgagggcctgcacacgttcgacatgctgcgcgaacgctacggaatcgcgccggaatacggtctatggagcatggtcgcctctgacgaggagaaccggccccgccgttaggacgcttcccggaaaaagctcagatggtacggcccgaggaaggaaaaccgagcgaatcgggcaaagccgatgctggatcgagagagttcgccggctcgtctcccggcatgatcggctcgatggactcgttcgtcttcgtccagcacgcgttcaggcgatcggccatccgcgcgtccaggccctcgcaggattcggatatgccggcgaggaccttccccgccatacgccgggccatatccgccaccctcgaaccatcgagaccgtgacgtgtcgccagatcctcccaatcctggggcgtggtgtgctccgcgaaggcgtgatcctcgttcaacggcatggtgagttcccaattgaactcgggccaatacctggtggcgaccgcatcatactggggagacaggcgtatccccgatgcgggatcgaggatcagggaatagttcttcgcatgtgcgtcgctgttggcggacgacgtgttgaaggccagcctttcgagccaccggtaggacagggaacccgacgcatcgatgcgttgcaggagatccaggcagtcatcggccgacggatcgtatttgtcgcgggtcggcaatcccaacgcttgcaggaagtcctcttgccgcagtcggacgattcggccttcctccaggcgacggtcgaaccgttccacgatataggccgtcttgcgctgcgccgtgatctcgccgcgtgccggtgtgtcgatgccgcacagttccgacaatcgcatcgtcgccagttccaccttggtcgcctcgggaaggtcatggggcttcggtttgacgatgtgggtggagggcagcatcatatccggccaataccacttgccgtccacgcgggacagtgtgaacttgccctgcgcccctcccaaggagaaccggcagtggctgtcctcgtcccaccagtagttcctggtccgctcgatgcggtcgatttcgttggctatctgggaatcggagatcagacgaagcgtcggcgatgggattggaggttccggggagagggagaacaccagtccgccggtggcgtcaacccggtccagcagatcgaagacgccggccgaggaggcattcaggtgctcacgcatggcctggcggacgttcggattgtcgggcaatagattgtccaggaagttacgcggtgcctggtctctccatccgccggttctgggcaggctcagactgatcggcagaccctcgttcgcgtcgtacgcgaacgatatgcgctcctcgtcgtcttccgagaacacgcccacatgatgcccgttctcccaggcgtgcagttccctcacagcagtctccccgcgtaggcggacggcagcgtttcggtgcggatgtgcagcaggtcgaacatcctgtacacgtagcggatggaggtcagaccggtctccacgagctcttcggcgcttgagagggggaccccggctctcctggcgagttcggcggcgtcgagacccatgacggacatgcgttcgcgcacgcaacggcggaccgacgaggtgtcggggaagaaccgcgccgggttctcctccttctcgtcgggaagacccttgtaggcggtcagggcatcatatttcgacagatccaacgtcacgtgtgccatgctcgtcctttccggttccgaaagccgttgacaccatgatacggccatccgatgccggcgcaccccacgaacctcatggcaaggggtgcgccggcatcggcgtcagcgtgcgttgccgttggtctcgggttgcaggatctgcggcgtcgagacgttggcctggtcgggtatcggctggtccgtggggttcatggaggattccatggcgggactgtattcgccgaacgggtcgggcccgttccattcctcgggttcgttcaggtcgagtggcatctcctcgtatccgtcgggctccccggtcgtcaggtcgccgcctcccgtggtctcgggctcgggtccggatgccggtttgcgttcatcggcggcgggcttcgtatgctcccgcacgggtgtgggggtttcgacgattggcgcggcgtcagcgttctcggtgcgttcgacctcgcttatggtgctgggctcgtctcctgtggccttgttgtccgcgtgcgaggattccggcaggccctggtccttgaggaagctgattcgggaggcggcgtcgtccacgccgttgaccggcgcgcacatcacggcgtcaacgatcctgtcgtggtcgtagcccgtccattggccggtgagccgcgagtccacgaagaacgtggcgtcgtcgccgtgcgcggcctggaacgcctgcgcgtcctccacccgttgcaggtccacgggcacgccggccgtgttgaaggcgttcagggtggcctgcaacgcgggcgactggtcggtgtaggtgatgttcacgtggttggtcaattggtcggctgcggcgtcgatgtgcgtttccgggtggcgtttcgaccattcgtccttcagccgggccttcgcctcgatgatctgcctgcggtagccggggtcgttgccctccagttggtcggcgaccatccatccttgcaagagggacgagtcgcgcatcttcctccagccgtcgccgtcggcaagcacggtcgcgttcagggtggactcgaaccccttgttgaggcgttccctgttgtccatctcccattgttcgaggcggatggattgctgctgccgtctggtctgctcgtagcgttcgttctggacggcgcgttcggcgcgttccctgcgtcgcgcgcggtcgccgctcagctcgttgtgcagggtgcgcagctgctgggcgacgctgttccagctctggaccatgatctggtcgaagccgtcctcgggatcagtttgagccattgtttctcctccttgttggcgtgatggtggtttccttgttttccttgccgcctgcggcggggaccgacaacgtttccaggatcggttcgcgccatgcccggttcgggcgttcgcagggcagcggttcgcccttcctggtgagattctgcttgcagtcgaggctggcgacgatgccacggtccttgtcgaaaacgcggtcgagcatcgacgccgcctggatgtagaagatcatcatctggccgggtgccttgcgcgcgttctcgtaggcgcgccacatggcgtcgagcgggaacacgagcgccggatagcgccaccagtcgctcacccattgcatgttcacgctcgcgctctggtggtagcagaacacgttggccacgaacctttccacgaacgcggcgaggttcggatagtaggtctcgctgcgccgcattcgcgcgccgaactggccggacacgtcccttgcccgcgcgggatcgaggtcgccggattcgtctcggccgagatccgtcttcccctccggcgcgggcagtatacgggtgtcggattcctccgcaccggcctttggaggggtgtcgtcacggtccgttgcgtcttccggcgggttctcgtagccgttgccggtttccccggcatcggccggaatcccggatcggatgggttccgccgcgtgccggcctgccggcacctcgggtgcggtcggcgtcggctcgccttggcccggcatggtttcctcttcgatctccttgtcctcggggatgtgcggcgcttcggggttgggcagtcccttgccgtaaggcacgcccttctcctccaggatggcgcgggtgaacagttccagccatccgcagtccgatgacagcagggtcctggcggcaccgaccgcgcgctcccattcctccccatcagggccggacgtggtgttcgaggtgtgttcgctcattatgcggcctttctctgctcttctcgggctttcgccttggcttgcgtcagggcgtcggcccattgcctgttgcccgtccatggcagggtcttgacgatctgcgcccgggattgggatgcgagcagcagcgcgcggccgacgggccattcggtcaggtcggaaacgtcgaggatgttctccttctggatcgagttgttcacgctgcgccggccggtgccgtcgatgttgacgctgcctcgcacgatctccctctggcccaccagctggctgatctcgccgaggaatttcgcgtccttgatgccgccaaggtagacggtgatgttcgcgttgttgaacagcgagccgaagttcgtctcgccgaacgcggccctgccctggtcggggttctgccagatcgtcatgatcgggatgcccgccgaaccgaaatacgagtacacgtcggccagttcgggccagcggcagatgttcgcggcctcgtccagcacgcagcacaacgggaccggcagacggcggttgttgccggtgaactcggattgggcgcgttggaacgcggtgaacgccaccaccgccgtcaggctggcggtcaacgcggtggagggacggccctgggcggaaagcaggtacagggtgtcctcgctcgtggcgaactcgtaggggtcgaacaggccgcgccgctcgtcgatgttcccattcgtatcccggtgcgggtcgatccagtcgatgatctcggggtccgcgaggaacgcgaccatggtctgaaggctgccgaacacgccgcttcgggtttccggcgtcagcgcgatcacgctggacacgcgcgaggcgatgcccgcgtagcgcgggtattcgctcaggatgtcggccggcgacgtgtcgcgctcgttggagcaccacctgaacacgtcggacacggaacggcctcccagatgcgcggcgaacaggtagtcggcgagctgctgggcggcggtgccggggaagaagtcgtcgccgccggtctgcggctggcccgaggcgtaacgccagcagtcggcgatgcgtttcgcgtcggcgatggactgcaccgaggcgatcaggtcccacacccacggcgcgctcttccggttcgggtccgcgatgcgttcggggtcgaacgtccatatttcgccgttcggatggtcgagcctgcggatcggggcggtcacgtcgaggatatcgcccttgttcgaggtcgccaggcacgggcccggtgccgagagcacggccgggatcgcgtagcacagggacttgccggaacgtgggcccgccagaacgatagccatgtcctcccagctggtgtacatcgacgtgttgtccacgatgttgagccccagcggatatcccggcgacatgcccttgcgccagtggtccgcttctatgagccttgacgccatggcctcggcgcgctggcgcgtcaccttctccacggcctcgccatggcccatggcaggcgcgtacacgtccacgcgggtgcgtgccttggcgccggttgcccacggcacggccttgctggcgatcagccacgcgcccacgccgcacgccacggccagtacgacgagcacggccacggccagcgcccactggcctgcggtcagcgaccattggccggagaccaggtacatgagcgcgaagatctggaagggatgccccgcatgggagcacacgagggcgaacgtcgtgaggatcagggacaccgcgacgatgatcgccagttcgatcttgcggctgggacggaccgtgccgcccagatccttcactcggttcgattgcagtttcggatcgacgtcggccaagattcatttctcctttcaagcatgacggcggaaccgatggaagcggtcccgccgtcgatgcgccagggcttgcgtcatggctagcgggcgttgcccgtcgtgaaatcggatggggtggaaaggaaatccggtgccgcagggtccgccggagcgggagccgcgcccggtgtcggatagcccgacagcggttcgaagggctcgccgttgaaagtgcggggaacgccgtcgccaacgtattcgccgcgcgaggcgtcaacctggtccgtccatggatccgttcgcccggcatcggccacggcaccggcctgttccttgttctggcgtttgcgttcgcgggcgagctggatgcgctgggacacgatggaatcgatctgcatggaatcgccgatcacgaccgggcgtgcgtatgccttaccgtccttctggctgatgaaggcgtcgggatcgcccatgcggccggtcgccaccacggcgtcaccctggcggaaatccatgccgtgcaggagctcggcagcctggccccagaatttcacggtggttctcaccgggccgagcggattgtccgtatagctgccgtccttctgacggactcgcgggcggtcctcatacacggtggcgcgcaggtacgccgagctcgtggtgccgtccgcgttggttttcgccggccagtaatcggggttcgcggcgaggagaccgcgaaccacttgcattgactgtggcatgatgatggtcctttcattcggggaataccagcgccttcaatggcggcggcgactcccatcatccggccggaccggtggcatcgcggggtacggcgtctacgtcagcgccccaaatgcccgccgttctcccacacgttcgccgcctccgtggcgggatcggtttccggcagacggtcgagcacgcttgacgcgaaccggtccgaggcgtcgtagccgatggcctgttcggcgagttcccgcgccttctcaccgtcgcccatggcgaggctgagcatggccttcaggccgatgatccggtagcaggcgtccgtcggcgcgttggcctccaacgggccgaggatccccatcgccatgtcgatgcgcgccggatcgggcgtggtgccgttgtcgatcagccgggaaaacagcaggtcggtgttcaccatgccgtccggcgtattgatgcgttcgcgcaatgccggaagggataggggagcgttctcggccagtatgtcgctggcgatcatcatgcatgttgattcgggcgcgaactgcatcatcacgcccaatacggcgagccggttcgcgtcggacgaccattcgcccgtggagcgtggttcggccatgagcttcgaccagtcgtaggcggcggcgttgcgccaggtggtgcgcacatgttccgagaatccgtcgtaggtcatgcctgagtccagatattcgtgtgtggctgcggtgatcagctcgtccaacggcggttcgtccgtatcggcggctgtggcctcgctctccacgatgaacgggatgcggggttcttcggaggccaggccgtccgtttcttccggctgctccccgttgatgcggtccgcttccatgcggtccacttcgccggcgaaccattcggagcccgcgaaataggtgccgtccatcgaggagagcaccggctggaggatggatgccagttcgtcgtacacggcatcggggttccgcaacgcctcgatggtttcagtcgccgcgttgtattcgatgatgcggttcgccagccgcatggcaccgtcatcgggtcgcacgtcgtcatacgattcgccccaatgctcgatccatccgatcatcgtttcccgtgtgatccgctcttcggcatcggtgttctccaaaggcatgttcggctccttgacaatcctcggcggcaacccgctgttcccgccatgaccccgatcatcagtccaaggccatggcggggtggggcatggcgtctacagggttcttacaggtttcgtcccgtgcggccggtcaggtcgtccacgaggccgaggagttccggttcgggccagatggagttggcgaaaaggtagtcgtccgtcaggggccggtccttgaatatggttcgcgcgtcctcccggatcgaggccagcgagccgtcggcgatcatgccggtgaggtcctgtgtgcagtacaggtcgtatggcgtgaaccctttgccgttccaatcgatgtgatgggtgatcgaatactcgtattcgttccagtgctccatccatggaagggcgtggtcgccttcacgggtgacgaccgagtagcggaaccagccctcgggaacctgtatggcatcgtcgtcatacgggtccgtcagggaatcgaggtagccggcgacgatggattcgccggcatggaattccgtgtaccatgcgaggtcgggattgcgcagcgcggcgtgcagcgagtcgagcagtgcggcgtcgttcatcgtggtcctttcaccggttttccgtttccggcaggatgccggtgttgtcgtatattctgaacgtttcgacggcgtgcgcgacccgcgccctcgattcgccataggtggcggaatcgaccgtctcacgccatacgggttcacgggtttccgcattgccgtacggcttgggctcggtgggggttatcgacatttcgaagtcccatgaggatgcgccgtgctcggcggggcggaagtcgagagtgctgcggttgcccgtcagccgcagcagccgggatcgctcgccgagccggtcgaagagggatgcggagcgtgccacggcgcggatcatgcgtttcatgccggtggcgaggtggtctgtcatcgcagggttcccttctaggcgtgccatttgaggttcgtatcgttgaacccgcttttttcgagcgggcacatctccacgttgatggggattccgggcagtcctcccaatttgatcaggaaacggcccagacccttgtgcgaggcatcggaaccgaagttgaccggggtggcccaatcctccagcatgtcctcctcgcgccgggatacgggcagtccgcattcgccgcgcaggtagcggtccacctcgatgcggctcaaagcgcccagcaccttgatctcgctgcgttccacgaagccgcgcgccttggtgttctgcgccggggtctccatgcacatcaggtccttgaacgtgtgcgtgatcatgatctggcctacgccccactgcctgttcagacgggtgagcaggtcgagcttttcgaccatgagggggctggcgcgcaaagcgcggtgcatctcgtccatgatgatcacgtggttgcgccggggctgcaatccctcctcggcgagcacgtcggcggcgttcttcgcggcgaacgcgctcgtccatgtggtcgccagcacggcggcgaccacatcgtcgcccgactgggccagggcgctgatatcgaagtccacgggcctggacaggtcgatgcgcgcggtggtctggtcgccgaacagacggccgaacttcgtcatgcggttcgagaacccgtgcaggtcggccagaaggccgcgaacctgcgccctgtagagctcgtcgttttccgggtcgtcccagaccgccgccatacgcacctcgtcgggcccttccctcagcaggtctcgcaggtccgcgatgacgggaggctgcggatcgccgccatgccggtcgtggagcacgcgcacggccacggaaaggatatcggattcgcgtgcggtcacgcccctggcaccgcccacgtcgtcggcctcgcggccggtgcgcatgatcgtcaaaagcacctccatgagcgccgccctcgtgtcgttgtagtagtccgtcaggtccttgcgcgccttgccctccaagcgttgcagcgcataatggaggtcgccggggtccaggggattgaccacgccgatgcccgctcccagccggatgacctggccgccgagcatgttgaccagtgaggcgtagtcgggcttcagatcgccggggatgatcgcgttcatgcccagggcgctcagtcccagcacctcgcggcgcacgaacgtgctcttgccgatggccggcaggccgagcaggaacatagagggctgtttgatgatgccggccttgaaccagctgatcgggtcgcagcacacgccggcacccgtcatcaggcttcgcccgaccggcaccccctcggccggcagggccatgtcggtgccgaacggccagaacccgccgcacacctggttcgacgtgccgaagaactcgtctatcgtgggcatcagggccgcatagccgcctccacgcgagcgtttcccccgccacggcatcgggggcacgggctcgtccggtttggccttcaacggaccgagcagcatggattccatgcgtgccacggggtccgtggccgtggcgcttggcatggttcccttccgtttcgacggcttccatggcatcggcatcatgtgtcctccgttcaggacaggagccggccgagggggccggctggagtgtatgatctgacgttcaatccaaggggcaggcttgcggcgaatcccgtgtcctgtgccccgtagcaggggcgcaggtcgatcttcgcgccgcctgcggcctgttccacggcgcgtgacgcggcttcgagtcgttggctttcctgttcgcccctggacacggtgacggtgacgagcatcccgaagaacaccatgaccgcaccctggttcgtttcgacggcctggcggttggccttgcctatctggctcatggacctcaccgtggcgcgtttctcctggctgacctggttggctgccttctgccggttctgttcggccatgaacatggtcttgtcgggcggcagcatccggtagagcacggtgacgcgcttgcggtcgcagtccgccaatgggctgagcagtcgggtgagcgtgtcggcggtcacgttgctttgcggcgggtccaccatctcccatgtgcggctcagcccggaatcgtgcgaataatggctccagccggcctcgtgcatgagcggcccgcaatcctcccatgcgatgtacgggggctcgtcggattcctcgatggtctcctgcgcggccggatcgtaggcgacgcggaccatgcgagtgatctcctccatgcccagggccctcgcggcaccgcctcccgcctgcgctatctgctcgcggatcgagggcagcagcaggcttatgcgacgcgcggcctccccggcctccaggtatttgccgtcacggtcggtgtagcggaaagtcaaggtgagcgtcacgtcgttggaagcgccgccggctgcgtactggtccatgatctgcgccatggcgcgcgccgcgagctcgggagcgtcctccacgatgcgtttgctcagcgtgcggcggaaacgcacgccggaatcgggtgccgtgtccacggtcacggccagttgggtgacgccggtctcggaggcgagcgattccatgagcccggcccacgaggccacgtacgagtcctccacgtcgtcgtcggcgaggctcgcgccctgcggctggcatgacaggagcagcgagtattcgccggtgtgcgcgtgcctgaccaggcagaactcacggcccaagccgtccagcgccgaggtcaggaccaccctggagaggatgcccggcagcatggccttgccgccgtcgatcggcgcgagcaggccggaacggtacaggtttgcgccggtacgctgcgcggccatccacgtgcgtttctccacggcgcggtccaccatgttgcggtgctcgcggtccctgatcgccagcacgaggatgacgcccatgccgaccacgaggatcgcgatggccgcgaccacgctcgccatgctgaccagcagcgtgcaggtcaatacgcccatgcccgctatcgtcaacggtatgccgatgttgcggatgcctcccggcatcggccgcatccaatccccgtatgtcgtgttcgacgccatgattatccgaatctccttaatgcgtcagaatgtcttgcctttgcgcgtggaggaacggtccgcgccgtccggtgcgccctcgcgggcgaacccgccggcatcgttcgttccctgcggcctgttgccgcctgacgggtcgggtggcgcgccatcgggtgccggtggaaccgggcttcccgtgccattgccgttcgttccctgcggtttgccgccgttgcccttgcggttcgctccctgtggctggtcgccggtgttctgtggttcgccgcccgtgggattgccttccagcggcttggcgtgcttgccgccgccgttcgttccctgtggtttgccgtcgccccggccgagtccggaaagcagtccggccaaacctcggccggcaccgggtttggcaccgtccggtgacgcttcgccgccaccgctgtcgccgcctttcctgccgcccttgccgcccatggccttgcgcaggccgccgccggccacggcgactcccatgccgagtatggagggcaggattccgccgccgccaccgccgaccgaggattgcacggcgggcacgatcacgcggatcatggcgggaaggaggatgatgacgctcagggtgagcatcagcgtgatggcctggctgtcgtcgccgggcccggccgtggccatgatcgccgagccggtcgccatgaccagtgcggcgacgggcttgtaggccaggaacgcggccagccagccgatggtcttggcgaaagcctgcttgccggtctccatccagctcatggcggcccacatgggtgccacgcccaccaggatcggcagcatcccggcgcggaagtaggcgaatatcttgctgatcagcccgcagatccacatcacgatggtgagcacgatggcgacgggcgcgccgagattgaagaacgagctcgcggccaggcttttcgattcccaggcgtcgttcatcatgccgcttgcggacctgagcacgtcggcggtccacgtgtcgaatgtggcctggaacgtgttgaccagtccggcaaggcacacggcgctcaggatcgcccacatgaacgccttgcccaacgggatcaggtcacgtccctcctgttgggtgacgagcttccagccggccgcgatcacgccgcacacggccgcgatgataaggaacgggtcaacctgcatacggatgtagtccgacaggaagaacgtggtgccgccgcccggcgtccatgacggcaggtccggattgccgccggacgagcgggagaagaacgtgagcgcgatgctcgcgcacgaggagccgagcagcacgccgagcagtatccagccgatgcggtcgagcagacggccctcgccgccctggccgatgttccacacgatgcgcgcgctcagcacgatcaggctgatcgcggcggctgcgacgagcacgccctgcgcgatgcgcaggtaccggttcaccggtgcgaaccatgaatcgtagttcggcgtggcgttcgcctgcaacgttgataccgtgtcgttcgcggcgaccagcgtgttgcggctggtggacagccattcgatcgtggaatccgattggacctggtacatgttccacagggtcttctccagccaggagagcttgcgctgcttccggcacgaggagtccttgtactcccatttgccctcgtcggacgactcctcctgatacgtgttctccaatgccctgcattgcagttccggagacttcctcagcagatccttcgccgccttcttggtgccgaccgcgaccacgccggtatgggcgggcgggtcgccgtactggtcgatgacccattggatctggctggggccgatcaggtcgccgagcttgccttcgggtatcttcatcacgtaggtggtctgggtgtcgctgatctgcttgtcgccgaacgtgagctccttgctgaacgatccgaagtcgggtccgccgcaggcggcgaggcccatgaggcaggcgagggcgagcggcagcgcgcacaggcgctgccgtatgcgtcgaatccctttcatggctttttctcagcagcttgcggtgacggacaggccgagtgcggcgaggatggcgacagcgcccgcaccgaggaagatgccgatcacccagttgacgagcttgtcgaaggtgtcgtcgcggtctggcacgccgtcgccctgctggcgcaggatgtgcacgccgatgcgcaccagcgcgaccacgccgatcaccaggctcagcgccttcacccagcccagggcggtggataccgggcccgagaatcccggaggcaggcacggggtcgggtcggaaagggtctcggcgaggatcacgcatgtttcatgcagcattgggttgttcctttcgtgttaggttcatgcaccatcgtcagccgacatgggccgtggcgcggggcatggcgtctacgtccttcacgagccgtgagtacgcggccggataacgccggggaaacccgtcgagttcaagccctttgatatggggcagccgccacacgcggacggcggatgacagttggatgcgcgccgccaccaaaggccggggcatacggggcacggggtcggtgatggccgcgcccaacaggatcgatgcgccgaacagtccggccgactggtcggcgagcagcgcgcgcaacgattcgaggccgcgccccgtgcccatggcgcacaggatgatgcgcgagggcatggagggatcctggctcaccggcagcgcgcggccggcgtcggcgaaccgttccggatccgaatggcggatcgtggtgcatccggcaccgccgtgcgcgcccaccagccacacgcggtcggtgacgggtgccgcgaacgacgggatcaacgtggtcagttgtggcatggtgttggtcctttcataggctcgggtcggtgccgggcagttgcgaggggtccgggttcgcgggcaccgaccagcccggagacgcggaaccaccggtcgagccggcggaaccgccggaggaatggtatccgccgccggacgggccggaacccgagcccgaagcggagccggagggcgtgtacgagtactgttgcggtgccggcgtgctctgcgcctgcgccgccgcagccgctgcggcctcctcctgcgctttcctttcctcgtcggccttggtcttcgcgtcgatggaggcgttcaccttgtccatggcgtcggtgatggccttctcgtcgcgcttgtcgatggaggcgcgcagcagggcgcgagaatattcgtcctgcaccttgccttcggaggaggaatacaatcgttcgccctgttcgacggtatgggccagccgtgaggagaacaccgcgcccgccgccttcttcagccgcgagagatttcccgtgtgcttcttttcgatggcttgcagcttggatgtggtggcgttggccgtttccgtgtccgtggcggcacatgcggggattcgctcgccctcggaatattgttcggccagcttgtcgagggtttccagggtttccgggtcggcgagcttgtcggccgtgaccgctttcgcctgtgcgagccggtcgccgtcgagatattcgaccagcttctgttcggctttcttcgccgcagcgtgggcggtggcgcagtccgccgtcgcctgttccagctcgcgtgcggccgtggcggattcatgcgatctccacgcggacatgccggcgaccgtgacgcaggccgcgagcaggatgccgcccgcggtcgtggctatgcgcctccattcgcgcacgggcatggcggcatcccggtcgccgaccggcgtgaggtcgatcgtgtcggcgagatcggccggctccacggcaccgacaacgtgctgcggttccgatgccggggcatcggccgggatatcattccccaccggattcgaggccgatggcagcgggccgatctcccacggatcgacggccgtgttcgcccggtcttcgcttccggcgtcgtccacgcatcgcgcatccggctccagcccgggcccgggctcgggttcgggttcggccggtggccggcgttccggttccggttctcgtgccgtgtcgatggcgacggcggtgccggcggcgattatggggcccatctcccatgggtccgtgctggaggtgttcatcggttcgggaagaggcgctggcgaaggctcgggcggtccggcgcggtggcggccatgccgtcggcggcgtcggcctgccgttcgcgcagctgccgccgttccatgacccatgcgggatgctggccgtgctcgtgcgcgtccatgaggcagcgcgtgacctcgccctcgggcgaaaccgccgcgagccggcccagatggccggtgaacgcggcctcgggatcgccctgcatgaagctcatgtacgcggccgcctcaagcatgccctcccttcgcgcggaatccgggatgctgttggacagccgccacagcagtgcgggtatgtcctggtggaactcgctgttggcgatctcgcgcacgttgtagtcggcctggtaccacggtttgacctggcccgaggcgaacaggggcaaggcgcgcggatcatgctcggcgaccatgaggaaacgggcgcgctccaggcccggcgatatcagcttcgcgcacacggcgtcgcgcagccccgtgtcgccggacagcgacgccagcagtcccgccgtggcatggtccttttccgcgtccgcgccgatgcggtattgtccggcgcgcagcgagtcgagaaaatcgaatacggccaatgcggtttgcctgtcagccatgtgcaacctccagaggaatgatgatggtgcgaacaatgtcagagtcgatgatgcgccgggtcgcgggccgctgcggggcgcaccgtctacaggccccatcgggagcacggttccacgggtctgcggctccacggttccacgggttcacgggttccgggcatggaaaaggcccttcgccgggggagaggctggcgaagggcctgggggttcacacgccgtccggggcacgggattcggaaagctttatgcccctttccggcatgtgaagtcaatggagggcgtcccggccgtcatcggacgacgaggccggaacgccacggggtcacttgcccgcgttcacggccgtgtggcggccggaaccctgtgcgtagtggcgcttgcggaacacgagcagggagccgcccgcgagcagcaccgccagagcgccgccggcaaggccgagcacggccgtgccggtggaggccaacggcttggcacggtagccgttccagtcgtcggtgttgctggcggtctgggtgtcggcgcacagctgcttgccgtcgatctcggtcacgtcgccggtggagtattccggatcggtgtcttcgccgccgtcggtcttgtcgttgaacgggtcgccgttggacggcgcgcattccacgagcggggttccggtgacgatggcgcggtccgtgtgggtctcgccttccttgacgcccttgagcgtgccggtcacgctgaccgattcgcccggcttgagcaccagggtgtcccagtcggcgggataggtgagcgaatccatgtccacgtgcgcgtcgccgacgatggtggagtcgtcgaggttcaggtcgcttgccttgaaccatgcgccgtcgccggtggccgggtcggtcttggaggtgttggtgatgatgaacgtgatgccgatgttgtcggcgtccatcttcagcgcctgcttcgggtcgtcgcggtccgcctgctcctggccgtcctgcttgagggtcggggtatcgaccttttcgaggtggatgctcggggtcatgtccggggtcttggtgacgaccttgttggattcgcgcggctggccgttgatggtctcggtccacgtgttgggcacctcgtcggccacggcgatgcgcttgcactggaggtagagcacccagccggcctcgtgctcgttgtcggcgctcacgaggtcgaggtaggcctgggtcgcgtcggccgtgaccttgccgttctcgtcggcgtccacggtgaacaggttgccgccgaacttcgaggagtcgaagccgctgcccgcgatcttctcgcccttggccgcgagcatctggccgtccctgtacaggtcgcggctggcgtagacggcccagttgcccaggtactggtcgtactcggtgttcagctggtccgtgccgccccagtccgtgacggtctggtaggcgcggtccgggggcaggatgctggaatccaggcggtagaggaacgtgtggttcagatacacgctcttgccgtcgatgctgtcgccgccgacctgcacggtcacgtccttcttcgggttgatctccttcagcgggttggtgacggtgttggtcttgtcgcgcttgtcgttcgtgacctgcgtggcggtgttctccaccgtgtggccgtccttgaccttggtgacggtcatcggcatgaccacctggtaggtgtggcccagcagcgactggtcgatgctcgggtccttcagcgggtcgtaatccttgtcggttttctcgctgtaggccttcaggtcgtcgggttgcgggtcgccgggaacggtctcgccggtcgcggggatctgggtgtccacggttttggcgaaggcgtagagcaccccgtccttgtcctggatgttgaactcgccggtgcggtccctgccggtctcgtcaaggatctccacgtgcttcgcgtcgagggtcaggtactcctggtcgtagtcgtccgtcatgcccagtcgccataccttgtaggcggtgtcggtgagcctggaggcgtcgatgttgacgcggtagtacaccttgtcgcccagcagcgcggtcttgccgtcgatgttgatggtcgggtccttctgcgtgtcctgcttggagggcttgatgaccggcggctcgttctcgaccttgttggacggggtgacgccgttgttgacggtcagcgcggccttgttgtcgacggtcttgtcggtgggcgcgtcctcgttcaccttggcctcgaagcgcagcagcacgcgcgggttggagccggccttccagttggcggcaacccagtccttggtgaacgtggcctcgaacgagtggttggcttcgtcccactgcaccttgtaggcgctcttcgggatgatgccgccggttcccaggtcggtgatctccagggtctgcttgttcgcggtggtgtactcggaataggtgtcgctcagcttgatggcggtcaccgaatatgcctggtccgcggggatctgcgggtccacgcgcacggtgtattccacggtctggccggggaacacggtcttggtgtcgatgctggactggtcgccgccctgggaggattcggcgatgacctgcttgtggatcgggggcacggtcacgcagatcttcggcgtgttggtgtccaccgtgctgccgccgaccgtctggccgcccttgttgtcgaggtcgtcgcccttcgggtccgcgcacgtgttgagctcgtcgccctccgccttgccgtaggattcgagcagcttcacggtgtcgaagttcacgtcgaaggggatcacgacgctgatctgcttcgcggtcttcaggtccttctgcgcggcctcgtaggagtccttcgcgctgaccgtgaccttggtgccctcggcggtgatgtcgaactggtcggtcacgtccctgccggtcttgttcaggtcgttgacgctggcgttggcctcgtcggtggtgtcctgctcgtagaccttgatgttggaggtgtccttcaggtcgaggatgctatcgacgttggcgaagtcgtcggtccacgcgatctcgggcacgcggcccaatcctgtgggcagggtgccggagatgaccgccgccacctcgtcgccgagacggtagtacttgtcgtcgccgcccaccttgtcgcttttggtcggatcgacggtcagctgccacttgccgtcaaccttcatggcccacgccttgttggggttgggcgtccacacgaacaccggcggctcgttggtcggtcgggtctcgttgttccacttctcgtacgccttgttggtcagctggatcttcttgccctcggtggcaccctttttgatggtgcccgtcaggtagaacctgaccttgctcgcgctgttcctgaacatcgtcttcgcgatgtaggcggacttcgcggtggcggtcgcggtcccggccttccggtcgatcgcgatggtgaagttcgcggtctcgtccttgccgtcgacgaacaccttgccggacttccagtcgatccactggttcgaaccggtcagatcatcggtgatggaataggatgccagcgggttgagcaggtgcgcggggatgctgccgttgaccacgacgcccacctggtcgcccacgaggaacgtcttctgatcgacgccctgctggttggtccattgcttgtcctcggccacgagagcgccggactcgtccagcacccacaccttgtccggggtcggcgtgaccttgcccacgctgtcgttgttgccggtctggcagtcggccaggctgccggtgccgttgtctccgttccagcacgccacggaaccgtcgttgatcttgtagtcgccgccggtgggtttggccgactgtggcacgttcagcgtgtagaggccggaatgcggggcggtggcgtgcgccttgaccacgcgcttgccatcgatggaatcgtcgatggaaatgtccgccggcacgatgttgccgttcgcgtcggtcacggtcaccttgctcacgtcgtcctgctcggtgccgccgatcaccacgtccctggtgtcgatcgtgtcgtagatccagaacttgccggaggcgttggaatgcgccttgatgtgcgccgtgtacagcgagccggaggcgatggagtcgttgccgtcccgcaccgtgtcgccggcctcgttggtcagccatttctcgggcggggtggtggtcttctcgccggactccttgccgtcgttctctcccttgtgggagaccgcctcggccatgttgccctgcttcgccacgtcaacgtcccaccagcgcttgcccgcaggccacgactcccacgaggcgtccatgtccttgaaggacgcgctcactgtggcgctgcccttgttggatgcggtgaaccgcttcgccaccgtcttctcggtgccgtcgatgccacgccagtgcagggtcgcggtgccgttcacgttctcggtcttcgacccgtcgctggacagggtgatcgtgtccgaagcgtccttggtgtcgcccgactggcccgacatctccgcagcctgcgtgctcacgctcaagtgatagttcggctgcaccggctcgtattggttcaacatgatgacgatcgcaaccgggctgttattccactgggaggccgcgatcgagtccaccgaacgctcaggagcatcagagaaaccgtcattagtgtcataagacgcaccattattgtggtatttaaccggtgcgatgtttttgttccatgcgtcgctccaataggaggcggtggcgaagccttcgccggaataggagtgcgtggtgggcgtggcgaccacgccgacggcgaccatgcggcagttcgcggtctcgcccggatgcttgtcgttgaaacgggccacgcattcattgttggccatcgtgatcgcggtgttcgccttctcatcggccccgccgttgtagttgttataggtcgcgcccatcttcgccacggccttcttgaacgcgtcaagggtagcgccgccgaaaccgccgttgttgttgtcctcataggcccagccgatcaccgagccgccgacactgccagccgagccgggagcccagccgccgccgccgtcggccatcgcggtggccgcgaccatgccgccgcctgccagcgtcgccaccgcagtcaaagcggccactgccacgcgcagccccttcccgttgcgggcatcagcccgtttcctctcgttgaaaaccatagggtttcctcctgttagattcttgtttccgaccggcctaaaagccggtagccggagtccggaaaacttcggccacaaaccattagaaccccatttcggccggtccagtttggacattttttccgatcagttacgcgagatattgaccacgaggaggggaaacgcctaaaacgcatgattcggggtatttaccgaaataccgaaaccggtaaaatcggtgcataccgaagcgaatgataaaaaaactcgcccgaacgaatcggacgagtttcatgcctgcatgtcagcaagtcagacgccgcacacgctctccgggcaagttccgcccggagtagcagctccatagccgctgctgtagccgaagctcccgccgtaggaggaaccggcggagccgcctgtggaacctcccgtggtgccgcttccgccaccagtggagcctccgccgtaggggtatgagggtgtccaggattgctggggctgagactgctgatagttgtactgctgttgttgcgtctgggcgttcgcagcggcggcggctttcgcatcggcctcggcctgggccttggctttcgcctcctcgtcggccttctgcttcgccgcgatggaatcgttcaccgccttggatgccttggctatcgcggcctcgtccttggcttcgatggccttggacagttcctcgcgcgtcttgtcatcctgcacgttgccgttgctggactccaacagggttttcgccgtgtcgatggtcttcgccagcttcgagtcgttcaccgcgtccaccgccttcttcaggctcccggcgtgcttctcgtaccatgcggccgcatcgtccagttcgtcgatcgccgtttcaagcccgtccttgccgtcggccacgcagccctcgtattccggcgcttccacgtccagcgcggttttcagcgcgtcgatggtcttcgcgtccttcacctgatcggccttgacctccagcaagtcggccgcgtcgccgttgacgagcgtgttccagtcgttcatcgcgccgcgcgccgcgtcggaggccgtggcgcacgcggccttcgcctcggccagtcggcggtccgaccatattttccatccgatgccgccggccaccacaagcgccagcgcgcacaggcccgcgaccagcggcaccagccacttcggccgaacacgcctcgactcctcgacggcggcggtttctccgttcgtgggcggcggggtgttggtttccgtttcctgttccgttttcattcgtgtcctttcatcgttcgtttcggtatgcaccgattttaccggtttcggtatttcggtcattctctgtcggagccggggttgccggtttccgcgcgttcatgccgccgccggtggcgctctgcaccgttccggttcgggcacctgcttgtttcgcacggcgtctcgcgtcatgcgagataggcttcgagcgcgaggtcgatgacctcctggatgcgcatgtcgtgcgcggcggcgtaggtcttgagccgccgccgcgtttcgggcctcatgctcacgctggtcttggaccattcccccgtctgatcggagcggaagacgtcggccatgccggagacgctgcgggtgcgggctgcgggcctgaaagccatgtcgaggttcctcatgcgcgcgcccccatcgcttcgacgatctcgccgagcacctgggggtactcgtggagcttgtcgggggagtgccccatgccggccttgatgtcctgccgcttgcacacaacggcgtcgaaacggggcgtgccggcctcgtcaagagcggcgacggtcgcctggaaggctcgggtgcggggttcggcgcgcacgatgagcaccgcaccgggcttgccatcgggaatcgcgttcatcgtcgcccacgcctgctgcagatcaatgggcgaatcggaggtgggcacgaccacgaagtcggcggccttgacgctttcctcgaacagccggccctgcggcggcgcgtccaccacagcgaagccgccatgcccggcacgggccagccgctggagcgtgctcaggttcgccggcatcacatcggtgcctgcgggccacccgccgttttcctcggccatgtccctccacaggctcgcgctggactgcggatccgcatcgagcaccgtggccccctcctcgaagcgccgcgcgtatgcggcggcgagatagatggcgcttgtggtcttggcgacgcctcccttggcgtttgcgatggtcacgatcatggttgtttctcctatcggtatttcggtgttggattcgtatcggtattccggtttttcggtattccggtttttcggtattccggtaattctggcgtggtcaaaacaggacgccttggatggccggcggaaccggcgtcgcgtcggtgaagctcggcgcgacagacaggcgttcacgtttgcgacgttgcaggcgcttgcgctgccgccagtcgctggagtccgccagtctggttcggtcggcccagtccggatgcctttcaagccagtcgctcacccgttgcgcgggcatgtcgtgcagctggcgcgccgtgatgccgaggtctcggcagaccagtttcgagagtactgtgcgacgcctgtagtcaagacctcctatgaggttgcggtccttccatccgccgacgagactgtcggcgatgcaggtggttcgcagggggcacgtctcgcacaccctgcgcccgagcgcgcgcttctcggcatcgacgacctcacggcctcccaccgtaatggtcgcccacatgcgatccgcgaggtccgggtcttgccgcgcgatcttcgcgcagggagcctgggccgtcatgatcccgccctcgccccggcgaacatgtgcccgccgttcgccttgcgtatgtcggagagccggcgctccatctcctcgcatcttgagcagcttgaccggtttccgatagtccgtgagggtcgatgccagcatgttcctcgtggtcatcggcttgttgatctccatgattcctcctcggcgggcgcggcgacggtgaaccggctgacgaccttcaccccgaagggcagtgggcggccggccgatagggccttgtgcgcccacagggtcgccgcgccggacgggtcggcgtcgcgcgccgtcacggtatggcccagtcgggcgagtgcttcggcggtgccgatggcgctggtgttcttgccgaccccgcccttgaggttgacgaaggccaccgttttcgtgttcgtggtcattgggatcgttcctttcattcgggtttccggcttcccgtgtccacgggtgcacggttccacggtttgccgcgtatacgggtttccggaatggttcgtccttatggggccggaccggttatctgtatcggattgtcttcagaagagggtgtcctgcaagggcggggtgtgtgtggcggcggccggggccttcgccttgccggtcgagcgtgtggtggcgcgccatcgttgctggcgtgcgttgcgctgctcggtcttgcggcgcttgcattcgcgttcgcgtgccgccgccacgatctcggggtttgcgcggatgtaccgggcgagccgccgttcggcggtcgggtcgtcggggtcgaaccggaatccggcctcccgcgcggtcttcagcacctggcgtcgggccctcaacggcagtccgccgtagatgccgtactggtcccggaccatgatgccgaacgcgaggcattcggccctgaccgggcaggcctcgcagatccgcaccgccgcgcggcgcagctcgtattgggttcgctggttgggcaggtcgtcgggcccccacatgcggtccgaccacgagtcggggaaatccgcgcattctcccttcaggaacatgccggcacctccttcggcccacggccgccgatgaaaccgacacgtccggatgccggcccggtctcggccggcttccgctgccgaccgtcgtcctcctccctggataccgcgtccaggaaggcgcggcccgcccgcaatgcctccagcacggcattgcgttcgccttctgcgtcgttcgcggggacgcgcttcaacagccggcgcagggtgcgcggtgcctcgaacccgtcattgcccgcatcgaagtcgtaagggtcgagcagtttccacacgcgccggtccaggttgtcggggatcccgtagttcggcaccttcggcgtggattccgcgctcggcggctgcgccgtttcgcccttgtcggcgaggatgccgtgttcggcgagcaggcgacgcccgtgggggtcgtcggccatctggaggcatacctggtcccagtgccgtgcgagggagcgggggccggtgagcgtgcgacgccagaaaccgtcatacggtttgccggaagcgtcgcccttgtcggtcttggaaggcggcagcgacacccattcggccacggccagcaccagtggcatgccgtggcgggcgatcagccgtcgggcggcgtcgagttcgcgtttgccgggccgggccaacggttcgggcaccggcatcggcggcatggcgcgcagcccgtccgccatcgtgcggcacaccgcctccgcgtcggaaccggcctcggcggattcgctgctcgggggttcggctccggcggcgtcggcccatgaaccgtcctcgcggattccgtcatcgtccggggaggtctctccgcttgcggggagatgccccgtaggggcagaggggttattacgtactagggacgtactgtagctcaccaggtgagctgggggtggggtcacagctgtgaaccgtggttcacccgtgagctggggttttcccgtgtccccgtcgccataaccacggtccacatgtgagccggggtttcccctcgccctgttttccgtggaaggccgtccgcctcgggtcgagtcgatgtcgttcgagtcgaagaagtcggggtcgagctccagacggttccccaggcacagatcccacacgacgggccggtgccactcgctgaaatgcccggcctggcgctggtcgccgcgacggatcagcccgttcgcttccagccatgacaggtggcgtttgaccgtgctcacgctgcacttgcaccacgcggccagcttcctgtgcgtcggatgcgcgttgcgcccctcgtcgtcggccacgttcgccagacacatcagcacgcgagcggcaccgttgtgcctggcgtccacgggcgcgaacctgagcgcccaatcgaccgcgttcacgctcatgcggcaccccctcggcgggagtcttgcagacgtgcgcgcagcatgggcacgcgcggcacgggaacgtcgagcatcatcgacaggtagaagtcgtggctgccgtccgacgggcaggccgccaacaggcccgaagcgaacccatggggcgggaagccgccatgacgcgcggcacgctcatgcgtttcatgcgctctcatggctctcctcactcacggaaccggccgactcctcacgccaacgggcctcgagcatgtcgcggcgcgtggccgcgcggcacagggcgaacgtcagcagataggacgcggcgagaatgatgacgacggcgatcacgagtatgaggtgcatcatcggcccgcccccattgatcgcgcgagggaggccagcagacggaccgcgagaagcacgatgccgactgccagacgcaggaacggcagcagcaggccgaaacaggccactgcgagcaccacgaacagcaggatcaccaattccaccactcatcacccccgctcaccgaaggatgcctgagcatcgagaacaccgcgtcatcgccgctgagggcctccacgtcgcgcatcaacgcgtcgatctcgtcggacaccatgcccgcaccggccctcgtagccgcggttgaacacgcaatccgacggaccgccatggatcagacgacggttcaccgtccgagccggcgacgaagcgttccgcacgtcacgaagcgcgtcatgccggccgatcagataggcgaccgccatgacctccctcacggtcatcgacgcatccacggacagggacaacagggacatgtagtcccggaaattcgagcgctcctcgttatcgagggaacgcgcgccaacggtcatggtcattgcctcacctccgcgtgaagggaccagaaagcgaaatcccaggcatcgcgcgagttacggtcgcaccagcaacccacacaagccaggccgcaggccaccggcaccaaagcgaatcccggcagaagcagattcctcgcggcaagcagaatcgccagaaaaaccacgcacgacaacgcggccagcatccaggagacaagtcccagcagctcgtagcgccgggcagaacgtcgccaatacaaagattcggaaaatgtagacgccatgtcccgcgaaccattcgcgggggcgttaccatcaaaatcagaagtcggcacagcgacttcggttacactagacatttgtgcagcctccataatctaaaaggcaatgcgaacgattcgaagtttggcgactggggaatcgtccgacattggatgtgttgcatacgcccggtttcgatgtatcagatcgagaccgggcattttcttgaaatgagaaaaaccactaacctcctcttctactgggtccagccatcaagtgattgccttctcgcaagagggcaggttattgatgccaagaacgaaatcagcggaaagtccgtagtggtcataaagaaacagcaagtccttctgctgccagcccaaatgcccgttctctttctgagaaagagtggaagcggattggcccatgtcggcagcaagggcagcctgagtcacatcgtgatccttcctccactgtttcatcggagaagccatatctactcttttcctaaagtctttagcctaactaatgtttttagaatacactttggtttgactaaagtcaaatcgcaaactagagtatcttaatgagataaaggtttattgatagaataggattagaatatgcgtacattattatccgcagatcaggcgaatcaggcaccccccgataccttgggcgaatacacagaacgtgtgctcaactacaatgtggacgcccggcgcaagcagctgaagcgaacccagaaatcactgatgcagccgatgggggttacaagcgaaggggctgtatctcaacgactcaaaggcattactcattggtctctgattagcgcggtcaatgttgcccagagcctcgatacaagtattgaaaaactacttgatgacagtgccatgaagatggagatcgaacgccaagcggtcgcactgcgcgttcaactggatcaaataaatcagatgacgggaaacaagaaagccaccgacgacacgccggtggcttcaggtgagctcctgcggctgggcttgaaccagcgaccgtccgattaacagtcggatgctctgccaactgagctacgcaggaatgtctgctgtgtttgagatttctctcgcgcacaagtcacatatcttacatgcctgccacgaaaaagcaaattacatgcgtgtagggcatgtcgcgctgaattccgcagaatcggactcatcggatactatctcatacagccaaaaaccgaacgcggatatacactagcgactaacggtagaggagctggtgtctgcttggcaaatactggaatcggtgaaacggaacaaccgtctgagtatgcgaacccagtgggaacaatcacaagagttctgatgttccgctgtcactgcatggcagcggttgtgacatggatcggccgcggctgaaggtcgaacaacatgacgatgcggcgatactgtcacgcgaaatttcattgtggataacttcggaagctagaaccacataggtcgttttggctggacatcctgtttcggacccctcaaggtgggtatcaccggcaaagaagccggaatcacatcacactcacactatggggaggaatctcatgaatgcaccactgttgtttgattggcgtcgcgacgaagcccgacgtgccagccggcggcgtcagcaggcgcgtcagcgggctcaggaacggcaacggcgtatggatgccataatcgcgttggccgccgttatcggcctgctgcttgccttgggagtagggctggcatccacgcctcagcatgttgcgcatgcggatactgcggtgaccggagatgcggcatacacggtggaggatttcaccgatatgtctgatttggcgtggcgcaatggcaatcagtgcgaatcccgattcgactggccggtcgacgatccacaggtcgaacaacagttcgagcggccgatcaacccgtgggcaccaggtcatcgtggagtggatcttgttgcggagcaaggtaccgtaattctgtcaccacaggcagggaccgtgagttttgctggcaaagtagctggcaaagatgtggtgagtgtacggcatcgtggaggtgtcacgtcgacattcgaaccggccgttaccgagctctcagtgggggatacgatctcccgcagacagcccgtaggcatcgttgaaggcagctcggaccattgcgaagaccgttgcctgcattggggcctcaagcgaggaacggccgattatcttgatccacagcaatatgcggggagtcgaaaaatcgtactgaaaccgtcatgatttaacggtgattgtcggccggaacagggccgtacggaagagacatcgcaggcggctagcggcgtgacgagtatgaatcacagaccggcatcggccaaggaaatatatccggggtcgatcagcgcggacttgagattgctggcgctgacagccagcaacggttcgctgatggtcgggatcttcttcacgccgcctacctcggagttcctgattgaaggcatggaattcagcgcttcgtccttgttgagcttggcgcaggcctgagcgatatccgtggcgatggtctgtctgtcttccatgccggtcatccattgcttgccattgacgatggatgggatgttcgagacatacgcgccgtatccggttactagaggccactgcgagtcacggtccttgtcggaagcggaggtgtcctcgtccgcatcgtcatcggaactggatgagtcgtttgcgttgtcgttttcaggggatttgatcgggtccggcacggcgtcgcggctgagatccttcttgccggtgatattgccgacaatgcccgagatggtgatctgcggattgatatcggcggcagagccggtgtatcccagatcgtccaattccttgacgacctcggaggcgatgtagtcgttcatcgtgatgatgccgtcaatacgggtgagtgtggactgtccgtcggtttttgccagacgcttgtcaagcactttcgcagtggagccttccttagcggcatcgtaggccacggcttgccaatcgttttccgtggatttgccgtccaaggtgcctgaagggctttccacaacgcccttctgatagtaggagcccagtacctgccagataccacggaacgcctcttgggcgaacgtggaatcgttggcgttgcctttttcgtccacggcggtgtatggcagcagcacctcaatgtatttggggttgtctttactggccttatccaacttgagtttggacaccatcttttccgcctgtagcttgccgatggtctgggcgtccgagaacttgacgaaggcgtccggcttatatccctcgatactgttgccgagcaataccacatgcatgccggattccttggccagcttgagcgatgagaccagccggtccacggcctgcgcctgctcgtccgatgcagtgctgtcgctctcagtgttggacgaatcgtctttggacgagtcgtcttcggaagattcaccgtcagaagtagcttccccatccgtggcatcgttggtgctcaggttctggctcacgtaatcgccgtattggcgagtggaagcgtcggcctcgactactggagccacgagcaatgtcatgttgtcgggcgcgatggcaatgccggaatcgtccgtggtgttattcgaaagatgatcgaccacaaagtcttggatggcgcggctttgcttggccaacgagtcggacgtcgtatgatcgatatcgcctttcttgaaaccggcgtcggccagagccttggctaggtcaggcaccagcttcgcccatttgttcagtggcgtctgctggttcagcgtaatgccgtccgaaggtgtgaacacggccacgccgccggcagaattggacgtcaccgtggtttgaccatctacaacggtcttattgtctgaggtgcacgcggtcagtgacagcaccatcgcgcaggatgcgataatggcggcgagcagggtggttgagcggcgtgcgaacaccataagcggcgaaacctcctcaagcgggcgtgaaaacaagctgaatcacgattctagtaggccgtatacgaaaaagtcccggaccagtggacaaatcgccacatatccgggaacaattagaggtattacgtgcgtgcatcgaacaactgtcatgattatcgtgctgaggaacattccagatgaagcacgacaatcatgacagtttgcgacatgacatgacccatgtaggtccgcacgatgtgttcgatgatttactcggccagagccttggccaggttctcgtccagcgcgttcatgaagccgtcggtgtcgagccacggttcgtccgggccgatgagcatggccagatccttggtcatctgaccgccttcaacggtgtcgacgatgaccttctccagcgtcttggcgaagtgacggacttcgggcgtgccgtccagatcggcgcggtgcttaaggccgccggtccacgcgaagatggatgcgattgggttggtggaggtcttctcgcccttctgccagcggcggtagtgacgggtcacggtgccgtgcgccgcttcggcctcgacggtctggccgtccggggtcatgagcacggaggtcatgaggcccagcgaaccgaagccctgggccacggagtcggactgcacatcgccatcgtagttcttgcaggcccagatgtaaccgccgtgccacttcagggagctggccaccatgtcgtcgatcaggcggtgctcgtaagtcaggccggcctcggcgtacctgtccttgtattcggtctcgaacacctcggcaaagatgtccttgaactggccgtcgtaggccttcaaaatcgtgttcttggtggacaagtacaccgggtaatgacgcatcaggccgtagttgaagcaggcgcgagcgaaaccgcggatcgaatcgttgacgttgtactgcacctgggccacgccgccgtcttcgccgtagttgtagaccacgtgctgaatcggctcggagccatcgtccggagtgaaggtgacggtcagctggccggctcccggaaccttgaaatcggtggccttgtactggtcgccgaatgcgtgacgggctacgacgatcggcttggtccagccgggcaccagacgaggcacgttgctcatcacaatcggctcgcggaagatcgtgccgcccaggatgttgcggatggtgccgttgggggacttccacatcttcttgagaccgaattccttgactcgggcctcatcgggggtgatggtggcgcacttgacaccgacatggtgcttctggatggcgtgggcggcgtcgatggtcacctggtcatcggtctcgtcgcggcgctcgatgcccagatcgtagtagtcgaggttcacgtcgaggtacggcaggatcagacgatccttgatgtccttccagatcacgcgggtcatctcgtcgccgtcgagttcgacgacagtgccttcgaccttgattttggccatgcttcctcctgatagatggtgtgaagatgatttagtcatagcgcatgtttgtaacgacttgaagcaatcgtccggtccgtgggaaacggccttgttggcgtcccacccgggcaataggctggaaaccatgtctcaggaaattgaaatcggtttgggcaaaaaaggccgtctcggctacgcactcgacgatgtggcaatcgtcccctcccgtcgcacccgcgaccccgaggacgtctccacctcttggcagatcgacgcctatgagttcgatgtgccggtgatcggcgcccccatggattcggtgaccagcccggccaccgccatcgccatgggcaagatgggtgcgctcggcgtgctcgatctggaaggtctgtggacccgttacgaggatccgaccccgctgttggacgaaatcgccggactgccggccgatcaggccaccgagcgtatccagcagatctatgccgagccggtcaagccggagctcatcacgcaacgtctgcacgagattcgcgccgccggtgtcaccgtggccggcgcgctctccccgcagcgcacccagcagttctactccaccgtggtggacgcgggcgtggacctgttcgtgatccgcggcactgtggtctccgccgagcacgtctcctccggccaggaaccgctgaacctcaagaagttcatctacgaccttgacgtgcctgtcatcgtcggcggcgcatccaactacaccgctgccctgcacctgatgcgcaccggcgcggccggcgtgctcgtcggcttcggcggcggcgcggtctccgccacccgccagaccatcggcgtgcaggccccgatggccaccgccatcgccgacgtggccgaggcccgccgcgactacatggacgaatccggcggccgctacgtgcaggtcatcgccgacggcggcatgggcgactccggcagcttcgtcaaggccctggccctcggcgccgacgcggtcatgctcggcgcgccgctggcccgcgccaccgaggcccccggcaagggcacccactggggttctgaagcccgccaccagacgctgccgcgtggctaccgcaccacggtcggcacggtcggcccgctcgaacaggtgctgttcggaccgagccaccaggcggacggcaagaccaacttcatcggcgccctcaagcgcgcgatggcctccaccggctacgtcgacgtgaagaacttccagcgttgcggcatggtggtcaacccgtattccgcacgataatcccgattgccccctgaaaatgggggtttgccctccatgcaggaggcttaacttgcccgaaggcgcgctcaagtagtttgacttggcgcgcctttcgtgatgttgtagtacagacgctcgccgatgatggtgagttgcaagggggcttgaagggggtcatcatggagtattcgggatttttccacggcacatatcagtacgggccgttgccgagttatgacggattcatcgttgtggagctgtcggatcgcccggtgcggtatcacatccaacccacattcataggcgggctgaatgcgaaggaatgtcattccatggccatggctgcatgccgcatcgcctgcacatcggcggacgcgatacgtggcaaactcagcgtcgcacatctcaacagagccatgacaaaaccatgcctggaccggctgcaaaccatgcaatacctgctcggcatccacatggtcactcatccggagctcaaagcgaaattctgctatctgcccactgtccccacattgatcgacggcatgatcaccggcaaggacacgctggaaatggcggtattcatgaccatcggccaggaaaatctgcgagtcaacctcaaactgaagtacatcggttctcgatggatgtgcatctatgccgatttgggctgaccagacggccccgcccgcacaccgattcctacgctggtagcggaagacggttctgccgtgtcataggctggttcgcctatagtagtgaccatgcgtgaacatgtagaagaacccagatatgtcaccaccgatgacgacaccgtctactcgctgctgtccaaacgagcagctcgcacgccggatgacatcatcgcggaatggcaggatgacaacacccaccaatggcgcagcgccacagctactgaaatgctgtcccgcgtacgcgaggtggccaagggcctgttgggacttggcgtcaaagccggcaccatggtgctgatttactcgcctacctgctatgagtggggtgtggctgatttcgcttgcgcggcaatcggcgctgtggttgtgcccgtctatgagaccgattccgcccgtcagaccgcgggcatcgtcgaggaagtcgatcccgccatcgcctttgccggcgacttccagcgcgcacagacgcttgagcagatccgtgtcaatcatccgggcatgaaatacgtgttcaatttcaaggccgatggccttgacgctgtcgttgacttcgggcatggcgtatccgatgagacgttggatgcggctatcgctcgtatcaaagccgatgatctgctcaccgtggtctacacctccggttccaccggcaagcccaagggcgcgatgctctccaaccgcaattacacgcacatcgtgcttaacggctacgagattctgcgtggcatgctgtacgacgacaaccgtctgctgctgttcctgccgctggcgcactgcttcgcccgctacatccagtacgtgtgcatcggtggctgcggcgtggtcggatacattcccgacgccaagcgactgctcgccgatatccgcagcttcaagcccacctacctgctgggcgtgccacgtgtgttcgagaaggtgtataacgcggcctcgcagaaggctggtgccggcatccaggggcatatcttcgcccagtcggtcaagcacttcgtcaagtggagcaaggatgagcaggccggtcgcggccattcgttcatcgagcgcatgcgccattcgttctacatggccacggtgggcaaatccattcgttccgctctcggaccgaacctcaaatggctggcctgcggtggtgcgccgctcaacgtggatttggcccactttttcaacggcatgaatgacatcaccttcatccagggttatggcatgaccgaaaccgccgctccgatgctcgtcaattgggaggacgacaacgagatcggttcggtcggcaagcctgggcctggcatgggcgtgcgtcttggcgaagacgatgaaattgagctgaccggcccgaacgtgttccttggctactacaagcagcccgaactcaccgcacagacgatgactgccgacggctggatcaaaaccggcgatctgggtcgtatcgacgaccgcggcttcaccttcattaccggacgcaagaaggacatcatcatcaccgccggcggcaagaacatcagccccgccccgatggaggatgtcatcgacacctgcccgatcgtggctcatgcagtagtagtcggcgacggcaagccgttcgtgtccgcacttatcgagctcgaccccgaaatgctgcattcctggctggaaggtcagggcctcaatgccgacatgacactcgccgaggccagcgacaacgacgcggtgcgcgcctttatccagcagtacatcgaccaggccaacgccaatgtctcccgcgctgagtccgtgcgcaaattcgcggtgctggatgaggaattcagtcaggagcacggcacactcaccccgagcatgaaagtggtgcgtcccaaggtattgcagcgctacgccaccgtcatcgaggaggatctgtacgcgcccaagccatccaacaagccgctgcccgccactgccaagatcatcgacagcacgctggagaccgtcaagaaatcctccgaatcggtcaagcaggcgtccgaacaggtcaaacaggcctcggaacagatgaaaaccagcgtgtctgattcgattgctagcgtgtcggagaagatcaagaagtcgaaggccgaacccgaagagggcgagaccggcgattccgctgacaatgccgctgacaccggcagcaagccggaccagccggctgacgagaagaatgaggagtaacgagaagtggccatccgtgagatcagggtcgtgcccgacccagtcctgcgcaccccctgcgatgagatcaaggaaatcaccccggccgtgcgccgcctggttgacgacctgttggaaaccgtggacgatccgggccgagcgggcctgtccgccaaccagatcggcgtgagcctgagggccttctcctacaacatcgacggcaaggtcggctacgttctgaaccccgtactcgaggagaagtccggcgagcagtatggcgatgaaggttgtctgtccgtgcccggcttgtggtacaagacccgtcgtgccgactacgctcgcgtgcgtggcatcgacttggacggcaacgaggtcgtgctcgagggctccgggctgatgggccgtatgcttcagcacgaatgcgaccacctcgatggccacgtgtatttggatcgcctggaaaaggaagaacgccgcgaagccctgcgctacatgcgcaatcgtcaggcgaagtagtccatactcggctcccactggctggagccgtcgaacgtagtgagactgagggtggttctgccggtaccgcccgtgactcccctcagtcgcctacggcgacagctcccctcagagaggggagcctgtttttttttagtaccggctccgtgctattctcgaaactcgtgtgccacccggcaacggacgcagtcgctggcgtccagagccacccaatattgtcaaccggcacacaacaaattcgcgtcatgctcgcgacggcttgtgtcggtcggctgcacaactcgtgaaaccgggggagcagctgcacgcaggtgcgcatggccaggcaagaaccgacaatgaaaggtagtaataccatggctcagatcactatgagcgatatgctgaaggctggcctgcacttcggccaccagacccgtcgttggaacccgaagatgaagcagttcatcctcacccagcgcaacggcatccacatcatcaacctgttcaagtcgctcgacatgatcgacaaggcgtacgacttcatcaagaccaccgtggctcacaacggcaccgtgctcttcgtcggcaccaagaagcaggctcaggaagctatcgccaaccaggccacccgcgtgaacatgccctacgtctccgagcgttggctcggcggcatgctgaccaacttccagaccgtctccaagcgcgtcaaccgcctcaaggaacttgaggaaatggacttcaccgacgtgcacggttccggcctgaccaagaaggagctcctcctgctcgagcgcgagaaggacaagctcaacaagcagctgggcggtatccgcaacatgaaccgcaccccgtccgcgatgttcgtcgtcgacatcaccaaggaagccctggctgttgaggaagctcacaagctgggtatcccggttgtcgccatcgtcgacaccaacgccgacccggacaccgttgagtacccgatcccggccaacgatgacgccatccgcggcatcgaactgctgaccagcctgatggctgacgccgtcgccgaaggtctgctggagcgctccggcgccaacaaggccgagggtgaagccgccgagcagccgatggccgcttgggagaaggaactcctgaccaacgaggctcctgccgaggcttccgctgaagccgccgctccggctgccgccgagggcgaaaccgccgaggcccccaaggccgagtgatgctctacgatgggaagtgcctgaatgagcgcttcccatcgttcatgggtaagcaaaatttctcaaggagaataatcaatggcagcaattaccgccgcactgatcaagcaggttcgtgaagacaccggcgccggcatgctcgacgtcaagaaggctctgaccgaagccgaaggcgacgtcgcccgcgccaaggaaatcatccgcgccaagggtatcgccgcagccggcaagcgtgaaggccgcaaggctcaggaaggcaccatcgcctccaaggtcgtcgagaccgccaatggcgagaccggctacgccgtcgagctgaactccgagaccgacttcgtggccaagaccccgaagttcgtcgagttcaccgaggaagttctcggctacgccgtggacgccgacgccaactccgctgacgagctgctcgaggccaaggctggcgacaccaccgtcaagctggctgtcgaagaggccgccgccctgttcggtgagcacgtcaaggtcggccagttcgccaagatctccggcgagcacgtcgaagtctacgctcacaagaagtccgccgagatgccgccgagcatcgtcgccatgatcgccaccgacaaggccggcgccgccgtggctcacgaagctgctctgcagatctccgccatgggcgccaagtggctgacccgcgaggacgttccggccgatgtggtcgagtccgagcgtcgcgtggccaccgagaagtccctggccgagggcaagccggagaagatcgttccgaagatcgtcgaaggccgtctcaacgctttcttcaaggaagtcgtgctgcttgagcagccgttcgtcaaggacccgtccaagaccgtcggcgacctgttcaaggaagtcggtggcaacgccaccgcattcgctcgtgtcgaggtcggcaagggcgaagaggagtgagcctaaggcttactccacgcgcttagcgtaatttcaacgaaacgccatccggttattcaataatcggatggcgtttcgctattccaagggtgtcgttgctagggggtgtcgtcgtaaaccgatacgcttgtctacggataatttcgcactttcggttttgagaaaggcacaatatgactgatagcgacaatccgcgcagagttctgctcaagctgtccggcgaagcattcggtggtggcaaggtcggcatcgatacccaggtgattcgtcgcattgccgaggagatcgttccggccgtacaacagggtgtgcaggtggccatcgtggtcggcggcggcaacttcttccgcggtgccgaactgcagcaggccggtatcgatcgttcccgtggcgactacatgggtatgctcggcacggtgatgaactgcctcgctctacaggactttctggagcaggaggggcaggccacccgcgtgcagaccgccatcaccatgggacaggtcgccgagccgtatattccgctcaaggccatccgtcaccttgaaaagggtcgcgtggtgattttcggtgccggtgccggcatgccgtacttctccaccgacacggtttccatccagcgttccctcgaaatccactgcgacgaggtacttatgggtaagaacggcgtcgacggcgtctacaccgccgacccgcgcaaggacgagaacgccaagcgttttgaaaccctgagctacaatcgcgccctcgtggacaatctggccgtcatggacgcctccgcactgtccatggcccgcgacaacaagaagcgcatccgcgtcttcggcctcgaagagccgggcaacgtgacccgcgccctcgtcggcgatgaaatcggcacgctggtctccaccgccgaatcgcgcgtggccgagtaagccgcaaacgcccacaatcgaatcaagcgttcatagacgaacaacactgacgaacaccaacacacaaggagtgaatatgtcttttatcgaccaggccaaggaacagatggccaagaccgtggaaaacaccaaggaaaacttctccggcatccgcaccggtcgcgcaaacccggccctgctcaacggcatcaccgtggactactatggtgcccccaccccgattaaggccgtcgcctccatcggcgttcccgaaccgcgcaccctgtccgtcaccccgtttgacgcttcccaggccggtgccgtcgaaaaggccctgcgcaactccgatctcggcatcagcccgaaccgtgatggcaacgtcatccgtctgaccatgccggaactcaccgaggaacgtcgtaaggaatacgtcaagctcgccaagggcaaggccgaggatggcaaggtcgccgtgcgcaacattcgccgtaagaccaaggaaaccatcgacaaggccgtcaaggacggcgagatgggtgaggacgaaggcgatcgcctgctgaaggatcttgacaaggtcaccaagtccgttaccgacgagatcgatactctgctggagaccaagcagaaggagatcatggaggtctgattcagaccaggtccggagaattatggaacgcaacgaacaaccccatgaagaggccgaggagacgctcgaccagatcaacaagaagaccggccgcaacatgccgcaggccatcgccacaggcgcggcactggtcatccttattgtcgcgtgcctgctgctcagcgtcgacctcttcgtgctgctggtagtcgtgttcatgattctggcgctgtgggagctcagggtggacttcgccaccgtgggcctgcacctcccggtgtttatgctgtggctgtgctcgtccttcaccctcattgccacctactattccccgtaccatctcatcacgatgtcgctgagtatcatcgtgtcgattattctggtcgccatcgcggccagcgcaaaaatcagcgtcggcaaccgcctatctctggcggttgccggcaaactgtccaacacggatgccagcgcgcgcctcgaatcctcgtttaatcatgagggcggggaacagcatcattcccggctcagccatgtggctgtgtccgtgcttaccgtgttgtatattccgttgttggccagctgcgtcatcatctcactgacttttaatgggcatccgattgcacacgccatcatgctggtgttcctacccgccctatccgatacgggcggtttgtttgccggtgcctggctcggcaaacacaagctcagcccgcgcatctcgccgaagaagtccgttgagggccttgtcggctcgatgctcttcgccatggctggcgcatttgccgtattcgcatgcacgtatgatgcctcgaaatgggccactcgttggtgggtgccgatcgtggcgggtattctcatcggtgccgtgggcacgttcggtgatttgtgtgcttccatgctcaagcgcgatatcggtatcaaagacatgggccatctgctcaaggggcacggcggtgtgatggatcgtgtggattccattttgatgagtgcaccgttcacctgcgccttgctgtggatcaccggactgtgattcgcatgtctcgtgcatgaacaatgtggcatcgtgtgtatatcgcacggtgccacatgccatatatggggaaatcatcgttcaatatgcgttcgctatgggctaagacatgggccatctgattcgtatgcggcacgccgtatggtggattttgatattactattgcatgtttgactattttctgatattgagagcgaagcgaacccatcatgaccacacagcatcctgacactccggaaaccggcattactcccggcggcacatcaggtgccttccgtgacgtgctatccaaggaccatgcccgccgtggtaagccgccgctgcactttgtggatatgacgcccgagcagcgcatcgagaaagcggccgaactcggattgccgaagttccgagtcaagcagctcgccaaccattactttggccatttcgatgtgaatgccgccgaattcactgattttccggcagccaagcgcagcgaggccgccgccgcgttcttcccgcagctcatcaccgaggtgacccgccaagtggcggacgaaggcaccaccatcaagaccttgtggaagctgttcgacggctccctcatcgaatcggtgcttatgcgatacccgacccgcaccacgctgtgcatctcctcgcaggtcggctgcggcatggactgcccgttctgcgccaccggcaagcttggcctgacccgtaacatgtccaccggtgaaataatcgaacaggtgcgtgtggccgccaagatgatgcgcgacggcgaagtggccgggggagagggccgcctgagcaacatcgtgttcatgggcatgggcgagccgatgggcaactacaactccgtgctgtccgccgtacgacagatttccgccatgcctcccgaaggcttcggcatttccgcgcgcaacatcaccgtatccacggtgggcgtggtccccggcatcaagaagctcactgccgaaggcattcccgtgcgtctggccgtttccctgcatgcccccagcgacgaactgcgtgacgagctggtgccgatgaacaagcgtttcaataccaagcaggtgttggatgccgcgcacgattattggctggcctccaagcgccgcgtcagtatcgaatacgcgttgatgcgcggcatcaacgaccaggccgagcatgcgcagttgctggccaagaggcttaaccattacggcgacaactgggcccacgtcaacccgattccgctcaaccccatcgagggctcgaagtggaccgcctccaagccggaagacgaacagcggttcctggagatcctgcaccgcgcgggcatcaccgccacactgcgtgacacccgcggtcaggatattgacggcgcctgcggccagctcgctgccaaggagcggtagctacttcagcgcatccttgattgcgcccacgaagtagtccagatcgtcgggcttgcgggacgtgatgagcttgaagccgttggcgtcgtccacgtgcagctgctcgtcgacgtaatggccgcccgcgttctcgatatcagcggcgatatagcggcagggcgcggcggtcttgccagccaccagacccgcgttgaccagcagccacgcgccatggcagatcgcggcgatcggcttaccttcgtgcgcgaactcctgcgccagcgtgatcgcatcctcattgacgcggatacgatccacattgcaggtgccgccgggcaccaccagcaggtcgtagtcggcagcctgcacgtcggacaggcgcgcgtccggggtcagcgtttcaccttcgtagcggtcgtgctgcaccgtctcacacgggtccaaggtagtggcggcaagcgtcaccttggcgccggcggccttgagatcgcgcagcgggcgcgtcagctcggtctcctcgataccccagttgttgacgatgatcagtaccgtgctgttttcgacagccatgccaatctccttgattcggcggacaacttccacgagccattctctcacgccgagcggctgccatgtcggtgctcaatatgatgattctcatattccagaaacaggtgcggcgcatgtaacgggcggtaggtagtctgaaggattgtaatgcaaagccgaacaggggagtgaagcatgtcgttggcggtacgagtcatcccgtgcctggacgttgacgccggtcgcgtggtgaagggtgtgcatttcgagaacctcaaggacgcgggtgacccggtggagctggcggccgaatactaccgtcagggagccgacgagatcaccttcctggatgtgaccgcatccagctcccaccgcaacacgatgattgacgtggtctcctgcaccgccgaacaggtgttcatcccaatgactgtgggcggcggcgtacgcacgcccgaggacgtcgactcgctgctgcgctgcggtgcagacaaggtcggtgtcaacacggcggccatcaacgacccgtcgcttatcagccgtgtggccgatcgtttcggcaaccaggtgctggtgctctccgtggatgcccgccgcgaaaagggtgagcagcatacgcagtccggttttgaggtcaccacgatgggcggccgcaaatccaccggtattgatgccatctggtgggtcaagcgcgccgagcagcttggcgccggcgagattctgcttaactcgatggacgccgacggcaccaaggaaggctttgacctcgagatgattcgcgccgtgcgcaaggaagtcaagattccgatcatcgcctccggcggtgccggcaaggtcgaggacttcccgcccgccatcgaagcaggtgccgacgcggtgctggctgcatccgtgttccattacggcatcctgactatcgccgatgtcaaggcggaactcaagaagcacggctacaccgttcgctaaacgaatacaccttgctcccgctgggcgaacaatccagtgaattgttcgtggcaatgcgctatgcgcacgtcgcacataatccgggagctgtcagcgaagctgactgagggtagtccacaaaaagaagataggtatgacagacactacatacgacaattccactgaactcgatccccgtattgccgcacgcctgaagcgtgacgccaaggggctggtcgccgccgtcatccagcagtacgacacacgcgaggtgctgatggtcggctacatgaacgacgaggcattacgccgtacgctgaccaccggccgcgtgaccttctggtcccggtcccgtcaggaatactggcgcaagggtgatacctccggccatgtgcaatacgtcaagggcgtgtccctggattgcgacggcgacgcactgctcgtcgaagtcgaccaagtcggtgccgcctgccacaccggcaagcgcagctgcttcctcgaaggcggccccctgcccgtggtcgaaggccatcgcccggccgagcagtagaacgggctttcctgactgagggaagccgagcgaccgcgtactatgaaacaagacatcgagttgtaagcaaaggagcgaatatgagcgaatgcagcgtcaaacacctgaagtggggcgccacctggcccagtcgcgaacagttccacgaactggccgacgccggataccgtgtgattccgattgtgcgccgtctgctcgccgactcgctcaccccggtcggcttctacgagcgtctcgccggcggccgatccggcaccttcatcctcgaatcggcggaatacggcggcacgtggagccgttacagttttatcggcgtcaactcgatggcccagctgcgctccaacaacggtcaggccgactggctgggcaaggtcccggtcggcgtgcccgtcaccggtgacgtagtcgaagtcgctcacgccacgttgaagactctgaaggccccgcatgtggaaggcctgccgaacctgaccagcggtctggtcggcacggtcggctgggatgccatccgccactgggaaccgaccctgcgcgccgaagctccggacgagaccggccagcctgagaccgtgcttgccctggccaccgatatcgccgtggtcgaccacgtatccggttcggtatggctcatcgccaatgcggtgaatgtggatgataaatccactcgcgccgacgctgcctacaacgaggccgtcgctcgactcgaccagatgcagcgcgatgccgccaccccggctccggacgagtcccgcgtcaacatcctggacgaaacggtcgcccaacccgagctgcgcttccgcaccgagaagagccactacgagcaggccgtcgaacgagccaagcagtacatcgtcgacggcgacgtgttccaggtggtcatctcccagcgcctcgacatcgattcgcctgctgacccgttcgacgtgtaccgtgtgttgcgcacgctgaacccgagcccgtacatgtatttcatggcgttgaccgacgctcagggccgcgacttcaacgtgatcggctccagcccggaaaccctcatcaaggtggacaacggccacgcgatgaccttcccgattgctggatcccgccctcgcggcgccacccctgaggaagacgagaaattcgccaaggagctgcttgccgatccgaaggaatgcagcgagcacatcatgctcgtcgacctgtctcgcaacgacctgagtaaggtgtgcgtgccgcagtccgtggaagtcgtgcagctcatggacatcaagcgtttcagccacatcatgcacatctgctcgacggtcaccggcaaggtcgacccctcgctgaccgcattcgatgtgttcaagtccgcgttcccggccggcacgctgtctggtgcgcctaagccgcgcgcagtcgaaatcatcgatgagttggaaccggccgaccgcggcatctacggcggcaccgtcggctacttcgatttctccggcaacatggacatggccatcgccatccgcaccgcgttcctgcgcgaccatgaggcgagcgtgcaggccggtgccggcattgtgctcgactccgtgcccgccaccgaatggcaggagacgcgcaacaaggccgaggccagcgtcgaatccatccagatcgccgcccagttgcgcgaactgtaacgttcaacgcatagcgatgcccccgctgacagaagttgtcggcgggggcatcgctgtctgtacgttagtgggtttcgcccatgatgtcggtggcgtcggtttcggtgctcacagcggcttcgatggcagcttcgataccgtgcgccatggtcgcgatcaccataccgggcgtcgcattcttcaccttgccgatcagttgcgcggctgcgtatggacgcatgagcgtcggctgagcccggtcggcatggtgttcgctatgatggacagtcggactttggtaagagacagtattcgtaacaggcaagtaggttattcatggctattgaggtgcagggacttgaaattcagatcggcgcgcgcacgctgcttcaccccaccaacttccatgtggccaagggagacaagatcggtctggtgggccgcaacggcgccggcaagaccacgctgacccgcgtgatcaccggcgacatgctgcccaccgccggcaaggtgcgcgtctccggcaagctcggctacctgccgcaggacacgcatgcctccgatcccacacagaccgcgctcgaccgcatgatgagcgcgcgcgacatcgccaccatcatcaaccgcatccgcaaggccgaaaaggatatgaccgacccggatccggacgtgatgagcaaggccatgacccggtacgacaaggccatgcaggacttcgacaaggccggcggctacgcggcccagtccgaggcgatctccatggccgcctcgctcggcctgccgcaggaggtcatggagcagcagctcggcacgctctccggtggccagcgccgccgcatcgagctggcgcgcatcctgttctccaatgccgacaccctgatcctcgacgagccgaccaaccacttggatgccgattccatcgaatggctgcgcggctacttgaagaagtacgagggcggcttcctggtcatctcccactccaccgaactgctggacgaagtggtgaacaaggtctggcatctggacgcgcagctcggccagatcgacatgtattcgcttggctggaaggcctacctgcaccagcgcgtggtggacgaggagcgccgccgccgcgaacgcgaagtggccgagaagaaggccgaccgtctcatgaagcaaggcattcgactgcacgccaaggccaccaaggccgtggcggcgcagaacatgatgcgccgtgccgaaaagctgctggaaaacacctccgaggcgcagaaggccgagaaggtggcggacatccgtttccccgagcccgcgccctgcggccgcacgccgatcatggccaaggatatttccaaggcctacggttccaacatcgtgttcgccggcgtgaacctggccatcgacaagggctcgcgtgtggtgatcctcggctacaacggtgccggcaagaccaccacgctgcgcctgctggcccacatcgaggagccggacaccggttccgtggaatacggtcacggctgcaagatcggctacttcgcgcaggagcacgacaccttggatctgaacgccaccgtgttggagaacctgcagcatgtggcgcccgagctcgataacacgcaggcccgttcgattctcggctcgttcctgttctccggtgacgacgcgatgaaaccggctcacgtgctttccggcggtgagaagacccgtctggctctggccacgctggtcacctcgcgagccaacgtgctgctgctcgacgagcccaccaacaacctcgaccccgcttcccgtgaggagattctgaaggccattgccaagtatgagggcgccatcgtgctcgtcacccacgatgagggcgccgtcgaggcgctcaaccccgagcgcgtgctcctcatgcccgacggcgacgaagacctctggaatgattcgtatctcgaactcgtagctgaagaatagtagtaaactcgtagccgaagaatagtagtaggagaggtctgccatgccaaccacaacaggtaagaaaatcgccatcgtcaccggcagcgcgctgggcttgggctacgagctcgccagccagctcatcgccaacggctggctggtggccggtgtcgacttcaatgccgaacgtcaggccgaactgaccgcgcagtggcccgatgactcctaccgcgcctacgtcggcgacatcaccgacgaagcgttcgtgaaggaatccgtggcggatatcgccacgctcggccacatcgatttgctcatcaacaacgccggccagccttcgttcaaggtgcccaccgcctacgaggccgccgacgtcgacaaatgtctcaagggactcaaaggcatgattctgtggacggtggaaaccctcaaggcctgcggcgagcagaacgtgaaaatcgcccagattatgagcaccgccgccacacgcggcaacgcgaacgaaagcgtgtactgcgccaccaagtggggtgagaaaggctacaccaagagcctgcaggccgcatacaagggcaccagtgtcaaggtggtcgccgtctatccgggcggcattgataccgctttctaccgtgacagtcgcgactacgtctccgaggccaagcagcacaccttcatgcagcccggcccgctggccgaagtcatcctcttcaacctgatcaacgaggccaacctcaccgtcaccgacatcgagatcaaccgcaacagctgagcctgctagtctgagatttcagcgccttggtacatacttggtgccaaggcatttcgcgtgtggagagcgaatgcacatcagtgacgatgagtttgaacgggccattgaacaggtgttggatgatttgcctgaacggtttgcgcgggtgctggagaatgtcggcatcgtcgttgcggacgaacccaatgagcgcgaactggctacaatgagcaatccgtgcggtgagctgctcggactgtatgagggcatacccgtcacgaagcgaactacgggctacagcggcgtgatgccggacgtcatcaccctgttcaaggggccgcatgaacgcgtatgctcaacgcaggccgagctgcgccaacggatccgcaaaaccgtgttgcacgagatcggccattttttcggcttcgatgacgagtatctgcactcgcacggctactgaagcgatgctagtttcactagtggggagccgtcactgccgtatgttgccaggtctactgcaagtggtgcaacgcgcggatgatggcgcaacggtcctcgacggttccctcgttggcgcacatggtggcgtaccaacgcggattgcgcaaggtctcgacgccggtggcctcatccgtggcgacgagcgtgtgcagatcgttggcgtactggaaatgcaggtggctgagcagcccgccctcggcgaacgccttgcgcgaaggcagcggattgatggcaagtagccagcggaacgggctgtcttcggcggccggatcggtggtgtggaacacgaaggtgggggagccttcgagaccgtgctcgatgacatggtcgatggtgtattcgtaggtgtcgaggctggtgtcgtcctcggcgaaccattcgatggcgagcgcggcatcgtccgtggagccggattcggcggccggctcgttcacacgccagtagccgatatggatgatgttctccgggctggtggtggagcaagccatcgaccagaacgtcctgatgccgcgcgcggccatcggggccatcttcgggttggcgagcaccgcctgctcggcggcttcccaggtctgctggatggcggcgtcatccgaatcaatgtaatgctcgaagctttcccattcaccgagccagtcggtgatgtcgaaggccgtggaatccgtggtgttgctggcggtcattgcgcgttcctttcatgggtggatgcggtggcgaaattggtagaggcattagggttggggctgctggcatctgggttactggcatgcgagccgttgttcccggaatcgtcggcgccaagattgacaatgcggtcgcaccagccggcggcgagctcctcatcgtgggtgaccacgagaatcgccttgccttggctcgccagttgccgcagcagttcgccgacctgctccatgtggtagcggtcgagtccgctggtgggctcgtcaaggatgatgaggtccttgccgcacatcaatgccgagccgatggcaacccgctgcttctgcccgccggacaggctcatcggatgccgttcgacgaacgctgcaaggtcaagatcggccatgacctgattggcttgagcggtgatgccggcatccgtctcgtcgagtccgatgagcagttcctcgcgcacgctgtcggagaacagttggtagttgacatcttgcatgaccaggaatccggcgcgggtcaggtcgcgcggtttcgcgggcacgccgttgagctcgatgcggcccgaaacaggcttgatgagtccggtcaacgtgcgcacgagcgtggtcttgccgcagccgttgttgcccatgagcccggtgatttcgccggcacggaaccgcaggtccgggatggcgcgggtgaagccgtccttgcctttgtatccgatggtgaggttatgggtgccgagcaatgccgaagtgcactcatccgcggccgggcttgaagccagcgtcgcaatccggtgccgatacggttgcaggtccaacgcccgcaatcccatggcggccacgcagccgggggagagggacaggaattcatcggcctcgtaatcctgcacgatatgcccgccgtcgaataccacgtaccggtcggccacgccgttgagccatgcgagtcggtgttcggcgattacgatggtgagcccttcgtccttcatctgctcgatcatggcgcgcatgtccgcgatggcgttcgcgtcgagattgctggtcggctcatccaataccacgagcctgggccccagcatggtggccgccgccacggcgatgcgctgcttttggccgcctgacaggtggaagatgctgcgatgcagcagatgcccaatgccaaagcgctcagccacggccgtgatacgacgattgatgtcctcggccggcagccctatgttttcggccgggaaggcgagctcgtcggtgacgttcgcgttgaaatactgggttttcgggttttggaacacgctgccgaccagcggggtgagccggtcgatcggcacggtctccacatccagcccgcacgtggtctggttgccggcgaacgcaccatggaagaatgaggggatgagcccgttggcaacgcgcgtatagctggttttgccgcagccgctcgccccgcacagcacgatgcactcgcctgcgggcacggtcaacgtgatgtcgcgcaatgccggctctgcggcatggtcataggtaaaggagatgccacgggaggcgatggttcccgcagacgtgtcgagtgggccacccttgccggtcccaataatggcagttgcattcggctgcgattggttgccacccatcagatcacccccgcgatatcgagcgcgagcggcaaagtgaccacaatcatgaccagccagtcgaccacggtcatacggatcagcgtgcgcgaggtgtgctcgccctcacgcccgagccccttggtcagtgccgccaccgacaggtcctgtgccacattggtggcgttcatcagcagcggaatcagaatgtattccaacgattgggccgggtgacgaaccagcccccagccgccggaggcgatgccgcgcaacgccatcgcattgcgaatctgccggtaatcctcggcgatggtcgggaagaagcggatgaccaccacacagggaatcaccacggcctcaggcacgcgcatacgccgcatcgcgcagatgaacgcgctcgcggacgtggtggtgaacgtatacgcgccggtgatgaaacagggcagcatcatcgtgacgcccacggccagcgcggagaccacatgcagccacggcagtcccagggcatcggggtcgagcattcccagcgcggtgagtactgcataggtcacgccgaagttcaacgcggttcgccatcgggcggccgccagcaggggcagcaggaacagcacgaccatgacgatttgcgtggcgagccctacgtggaagaacagcatgaggttcgccaccagcagaaggtagagtttcgcgcgcggatcgagcgtccggcgggcaggattcatcaggcgataccggccttgatgaagtgcttcttcatcatgcgctggccgaaccagccgccgagaaccgcgcacaccagaatcgcgatcatcgagatgaagaacgtgccggtgttgatgttgacgaatacgccgtcgatgtaggctgcgtccttgccgcgcgcctgcaggctcgccacgtaggcgtccttcatgaaccacaggggcaggatcgggccggtcaggccgtaggagaacaccacgtagctgacgagcagtagcgccttgctcttatacttgccggcgcgcgcgatgaggtcggccgccaccgggaacacgatgctggcgatgaacgaaagcacgaaatgcccggagatgaacaggaacagtccgatgatcacgcccatgacggtgatgccgccgaatttgccgaggcgtgcggccagcagcatgtacacgcagccggagatgagggccgtgatggcgggcaggaagatggagccgaagccgccggtgaacagggtgctcaccagtgtggcgatgcacaccatcacgaagtacagggccgcaaacacgccgatggtgatgaggtcggagacctccagtttgccggatttggcgggcttgttgagctggtcagaggtttcggcgggcgtgttcggtgcggtcacgatgttttccgtttcgtatgcattgacaatattcctctcgccaatctaacgatgatttcccgcaaaggcaatagtctgtctgtgatttttagcatggcttggcgcccctccctgtggggggcgaaggacgtggcgcgggcggggtgtggttcgcggctatcggctagtatggtgcggtcacgacagagggaggcatgctgtggccgatgtgatgcgggagctggaacggctgcgaccggtgtatgagacgggcgtcctgcggttgctgttgcgccagaacgcgatgctgtacgtgtcgctgctgcgttccacgttcgacccgctcaccggcgagctgccgcgcgagaccgtggaggagcggttcgcgcaaagtctgaacgctctggccgacgccggcgaatatgcgccgcgcgaggaccagaccttcgccgaggccgctcatcagatcctcgccgacctgacccgtgaaggcgaaggcgactacgcctggctcgccaactcgcatgatgcggcctcacaccgattcctctaccgtttgacggcccgcgcccaccgcgccatcgaggcgctgagcaggctcgaagacgaatcacgcgccctgtccggcgcgcaggccaacagcatcatcatggaaatcgagcacgcgcgcatgcagctgaccgccgaccccggcgagcgcatcaaactcctcaaccgtgaaatcaaggaacgcaagcacgagatcaaacgcatccaacagggcaagcagcatgccacgctgagcgaagcccaggtggaggacgtgatcgccgtgatccacaacacgctgcgcggcgtgcccatcgacctgcgcgaactcgtgctcgacgagcgggacaacggcgacgccttgcgccggcgcatgcaggccggcgacatcagcgtggacgagaacctgacccgctaccacgatgaataccgccgctcgttccgcgaatcagacagcggccgccgcttcgaggacgccttccaggtgatcatcaccgacgagggccgccagcaaatcgacgaagccctgcgcgctatcgccaaaaccccgtatctggccggcgaatccggcgtgctgctcggccagatccgcgacgaactggcccgcatctacgacggcatcgaagccgtgcgccgccagatgcgcgtctccgacgaggcgatcagccggctcgtgcgccagcaaaccgacactcgctaccgtacgatgctcacccgcttgaaccgactgtacgcgcgcctcaacgcggatgcgaaaacccatatgggagacgcctcgcgcccgtacgacacggccacctcggacgcgctgttcgcgccattgccgatgcgcccggccaaatccatgacccgcgccaccgcacccggcctgagcgacctcgccgccgaagccccgcagtcgactccggtggccgatctgcgggacatggtcaacagcggcggcccccgactcctgcgcatggtcagcctcatccggcgcaacccggtgaccgttgacaggtccgatgacaggcccggcgcaaccctcgtggacatcgccgccagcttcaaccggctgcccgaaagcgaacgccgcgaaagcgagatcgtcggcttcctgggcgggctgggagccgtaagcggcaacgccatcgccgacgagccgtccactgacggcgtcggcgtcggggtcgacagcgacatcgccaccgagccggctccggcgcagcgcggcgatactgcgacctggcattgcgtatcgatcgacggcgagccccggaactggatcactagaccggtgctggccgacatggacgagctgagcatcattgtggaggaaggatgaccgtggccgaggaacacgaggaacacgaggagcatatggacaacgccaacccgtacgccctgttcgaaggcgacatcggcgacatgccggccgaggcacgcatggccgccatcgcccttaaacgcgaccgctatatcagcgggcccacctacgacaccgtgctcgacaaccgcgacgccgtcgtacgctccctgaacaacgacctgctcgacttggtgatcaacgaacgctaccgcatcatgtacgccacgcccgtggccggcgacgacgtgaccctgcgctcgctcaaaacccgtgtcagcctcaaacgcgaggaggccgcgctgctcgccttcctgcgcatccgcgtcctcgaatacgagaacgtgcacgccgaccccgccgactggctcgtcagctttgaggagatccgcgccgcgctcgccaccggcgccggctatctggccgcccgcaacgacgaggaaggcgtggcaaagcagatcggcgccatcgtctccgcgatgatcacctacgggtatttggtgcgcctggacgacgaagccatgtaccagatcacgccgctcgtgcccgtggtgctcgaccgcgaactggccgacacctggctcgacgtcgcggaacacggcgacggcgacacggaagatgacgatgacgacgagaagggagccgaatgatgcaggcgacagacgtgcagatgatcgcggaccggtggatgctggaatcccgccgactcatcaactggggctcctatgagggctaccacgaattccgcccctccacggaccacaagctgccggtgaccctgctcgccggcgccagcgaatccggcaaatccacgctggtcgacgcgcagatctccctgctgtacccaaccggtacgccgttcaacaaggcctcgaactccggccgctccgaacgcagcgactacacctacctgcgcggcatggtcggcgtgggcagcaccgaaaccggcgacgagccgctctacctgcgcggccgcgacgagaacggcgcaccgcaacccgtgtggggcgccatcgtggacacctatcgcaaccagaccaccggccaggtgctctcctgcgccaaattcctctacctgatgcccggcgacggccgcggcgacgtgcgccgacagtacgtggtctggggcaagcccgtggaccccaggcgcatggaccaataccgtgacgccccgttcacgccggcccagctcaaagccacctaccccgactgcctcacattccccagcgccgaagcgttccacacacacatctggagcgcaatgggcctgagcgaggccgcctgtcgactgctgcacaagatccagtccgccgacgcgccctcccggctcgacgacatcttcaaacaaggcgtgctcggcgtgcccgaagccctggacctggcccgcaccacggtcgaggactacgaacgttacgacgagaacttccacgccatggacgagaagacccgccgcatggacacgctgcgcggcatccaacaggcctacggcgaatacgccgccgcacgcggcaaggcccgcgccttcgaaccggtcaagccggccgtcgacggcacggtaccggccgtgctgcgcgactgggcattggcccgcatgcgcggcgaagtcgccgtccaactgcccgccgaccgcgccgaacaacagaacagcgaggcggaagccaagctgctgcgccgccgaaccgaagacctgcgcacccgtctcgacatgatccgcggccagatgcagggtctggacggcggcaacctgacccgactcgaactcgaactcgaccaggcccgccgcaccctcgaagacgtgcaagccaaccgaacacgaatcgaacaaacgttcgcatccatcggcgagacgctgcccggcgacgaacaggcctggaacgaacgccgcatcaacgccgtgaacttcaaacgcgaatacaacaaacgagacggcgaatgcgaggaagccctcaccgccgccatcaacgcgtgggccggcgcacgcggcgacctcgaacgactgcaacgcgacttcgaccggcaacgctcccagcgcacccgcatctcccagcagatggacgaaacccgcgccatgctctgccgcgccaccggactcacccccgccgaactgccgtacgtggccgaactcatggacgtgaacgaacacgaggaagactggcgtctcgccatgaacgtcgcctacgcgcccatcgcccagaccatcctcgtcgacaagcgccacgaacagggcttcgccgccaaagtcagcaccatcgacccgcgcaccatgccccgacgcacctggcagttcgtggacaccgcacgccactacgacgacaccggcgcgcacgcgaacatactcaccggagaacaggacggcgactggctgtccggcaaactgcgctaccgcgacgactcgcccttcgccgactggctgcgctcgcagacccaggacgaacgattcgacgccctatgcgtcaccgccatcgacgacaccgaccgcaccaaccgtcaggtgcaggccgacggtcagatcaaatccggcgcacgcggccagcacggcaccaaagaccgcgcccaggtcatcggattcgtcaacgaaacctacctcaacgcgctcgcagcgcaggtcgacgccgcccgcaacgcgctcagccaagccgacaccgactacacggccgccaaaacacagtccgataacctccaccgcgaactcgaactggccaaccagctcgtctacacgtcctgggagcgcatcgacatcgccggcgcgcaacggaccatcacggacacgcaggacgccatcgcatccatcaaaaacgatcccaagctcgccgaactcgccaaacagcgcgacgaactgaacgccgaactcgaccgtgtggaacgccagcgcatcgaatccgaccaggccgcggcccgcgccggcagcgccgtcgaagcggcgctcatctggctgcgcgaccatgccgacaccggcacgacggacgccgccggtgccaccgccgacaatgacgatgacgccgcgtccggcccgctgccggacgaagtcacggcggcgctcgccgaatcctacgacaaccgattcgccggactggcggacgccgccatgcgcgcgcacatgatcatcggcgcgggcgcggcaggaacgcaggcaccgggggagagcttccccgaacgcaccatcgccggcatcggcaaggacatggcctcccgcatcaacctgctgaacggccaggccgatgccgcacgcaccggcgtcgaatcgaaaatgagcacctacatcgcgctctacgcggccgacgatgattcgctgaccgccagcgtggaggactaccggtactatctcgacgaactcgccagcctcacccagctggccgcggtcgccgccaccgacgccgaataccggcgctgcctcgaacagctgctcaggagcttcctgaccatcaaacgcgccatcgacacggatgccagcgacatccacgaccagcttgaccgcatcaacgccatgctcaaaggccagcagttcggtcccaagcacggcagcctgtccctgcacgcggacgtgcgccgtcccgagcgcaccttctgggcgcagctcatccgcgtcatcggcaccctgaacgattggaaatccgccgacgtcaacgattccgacgcctcgcgcaaggctttcgcggcctgcgcgccgatggtcgggctgctgcgcgccgaactcgcgcaggtcaaggacgcgaacggcgtgaaaagctacggcgcccgcaacctcgacccgcgttgccgctcgtccttctacgccatcgtgcatcatgccgacggcccggatgaacgcatcacctccaccggcggccgttcgggcggcgccttgcaggagcttacctcattcgtatacggcgcggcgctcatctacctgctcggcggcggcctgaccagcgagccctcgtacaccacgctgttcctcgacgaggcgctcatcaaggccgacggccgttacacgcagcgcgccctcacggtgctgccgcgcctcggattccaggtcatcgtctccgccccggaaagcaagaccggcgaaatcctcgaggtctccaccaaggcctacgtgacctacaaggaccccgacaccggcctcacctccctgcgcgaggccgtgctgcatcagaatgacatggacgatgaatcatcgtcggatatattgaaggatgacggggttgccgaatgagcagtcctggcgtcgccggtattaagacgattcggttcgactcgacgatgttcgaaagcaggtgatgggaactatggccggcatgaaagacatcgctgcgatcaccacatgcgtgaagaaacatatgcgttcacatatgtacgacatcgaaccggcatggccatttcccgtgccggtgggattgccggaccaagcatttttggaaaccaatgcgattgcggtgcatgacaacaacaatgagatacggcaatgggcaagcaagaatggttgcgaaatcataaccaagcatcgcaccataggcacctctgtcgagctgatctccaaagtcgtcgttcctgacgaatcaatagccatgcgtgtggttggtcgtacgctggcggcggaatgtcgcgaagcgcgccgccgcatagcatgtctggttgctgcttgtgacgttgctccggaaacaatcgaatcggccgctcgcatgacaggccatgaacagcctgacgacttcgatctgcttgtcagcgcagttcgatatttcaggcatcatgacgtgaccggtatgacgccgcgacagattccactgacaggattcagcggcaaatggctgaatgagtcaaaaaccaatcgtcgtaaggccatttgccgactgctcggtgtcgaaacgttgggtctgtcaaaacggccgaccgaactgcggttccgttatctcgatccggtccgcgacgatgctgagctcgaacgcatcatatggtgtccgtgggaaggcgaagcgttatccggcattaaatatgctgtcatcgttgagaacaaagacacgtatcagactatgccgccgattgcgcagggcatctgcatatggggttctggtcgcgctgtaagcgatgctgtacctgcggttcctgcactgcgtgacatgcgtatcgtgtattggggtgatatggatgcggatggactggaaatactttcgacattacgtgaatcaggtatcgaatgcgactccatcctgatggattgcgatgcatacgatcggtaccacagatttggtaccgatcgtactgaacgcagcgcgaagattgctatgcgggagcctaagccgacgcccggccttcaatcggcggagcgacgtctttatgaacgactgtgtgctgacaaaacaatcgcttatcggcgtatcgaacaggaacgcattcccatgcgtgatgcagttgacgaattacgcaagcttggcatccccgtggagtccattgaaaatcaggatttgccgatttaggctgagtgattggggatgttgccaagagctagaacggcttagctttttctcgtctcacattatgccttccgattaataatgcaacggcattgcatagctgcaaggtccggcactgctatccgatactatcgaactgttgttttgcgttgcgcgagaagggacaaacatggcaaccgcttggggtgacgagagtgtgcggaaaaccggagttccctcgcctatgtacttgatgggcgcatgcgtatgtgatgatacggaaaccgaaacaaggcaaagattggcgttgcttaagcccaaaggagcaaggaaattgcactggcgagacatgcggccatcattgcgtggcaaagtcgttgatgccatggctgcaatggacattgatcatgtcattgtggctgcggtaccaatgagccagtggaataccgccgaacgcgctcgccgtaaatgtttggaacgtcttctgcctctgctggaaacagaatacaacgtggacacgcttgtgcttgaacggcgcgagatttcacaggacaggaacgatatccgtttcatcgatggattgagaagccgcagatttatcgggccaattcgtgtcgaactctgtgcaggggagactgatgcaaggctatggctccctgatcagctgctaggagcgtacggtgatgcccaggccggtactggaagatacgatgaattcctcggccatgttcgaacagtgttcatcgacagtgattgatgtcctaaaaccgtgtatacttcatggtaagccaaccccgctggggaaatggaagtgagagccggacgccccgagtatcttgggggccggctcttgcgtttcggtccactgatggtccggaattttgcatactctggttcagttttccggcctgacacgccatcgaacaagcgttcgaatttggtcgtgtgttcgggtatccttgggacagatttggcgcgcgcatgaccgtgcgcgcgggaacggtgagatggaaggtggggtgtggctgtggcggcaatgcagactggcgcaaggcgcgcaacaagcgcaacgggcgcgaaaaccggcaagggcaagaacggtgaggtcatcgtcgaaaaggtgatgaccagcgactccttcctgagccgggagatcaaaaaggcgccgctgattgaacacgatggttcgctggtagctgatatctcgcacatcccgaacgatctcaagatcacgattcaaggtgcgcgcgaacacaacctcaagaacgtcgacctggcgattccgcgcaatcgcatggtcgtgttcacaggcctgtccggttcgggcaaatcctcgctcgcgtttgacaccctgttcgccgaaggccagcgacgctacgtcgaatccctatccgcctacgcccgccagttcctgggtcagatggacaagcccgacgttgacttcatcgagggcctgagcccggccgtctccatcgaccagaagaccaccaaccgcaacccgcgttctaccgtcggcaccatcaccgaaatctacgattacctgcgactgctcttcgcccgcaccggcatccctcactgccctgaatgcggcgagcccgtcgcctcccagaccccgcagcagatcgtcgacacactgctcggctacccggagcgcacgcgattccagattctcgcgcccgtggtcaagggccgcaagggcgagttcgtggatatgatcgagctgctgcgctccgacggctacgcccgcgcgctcatcgacggcgagatgacgcagctgtccgacgacatcaaactcaccaagcagaagaagcacaccatcgaggtcgtggtcgaccgactcgtggtcaaggacggcatccgccaacgcctgaccgactcggtggaaaccgccctcaagctcgccaacggcagcatcgtcatcgacttcgtggacgaggaggaaggcagcccggcccgccgccagccgttctccgaacaccgcagctgcccgaacgggcacacgctcgaactcgacgaggtcgagccgcgcaccttctccttcaacgccccctacggtgcctgccccgcctgcaccggtctcggcttcaaactggaaatcgacccggatctcatcatctccgacccggacaagtcactggccgacggcgtcatcgaaccgtggagcggcaccaagatgacctcccagtactacggccacatcctcgaaggtctggccaaggaaatgggcttctccatgaagaccccttggaagggcctgccggacgacgtcaagcacgacatcctctacggccacgacttcaaggtcaacgtctcctaccgcaatcgctggggacgcctgcgcgaatactccaccggcttcgaaggcgtgatccgcacgctcatgcgacgccacgacgaaaccgattcgcagtccatgcgcgaatactacgagtcgtacatgcgcgaagtgccctgccaggtctgccacggacgccgtctgaagcccgaagtgctcgctgtcactgtggacggaaaatccatcttcgacgtgtgcgacatgcccgtcgtacgcgaactcgcctggatcaacggcctgaaactcgaaggctcggcacagctgatcgccggcgaagtgctcaaggagatcaaggcccgactcggcttcctgaacgacgtcggcctcgactacctgaccctctcgcgcgcggccgccaccctgtccggcggagaagcgcagcgcatccgactcgccacgcagatcggctccggtctggtcggcgtcatgtacgtgctcgacgagccgtccatcggcctgcaccagcgtgacaacgaacgcctcatcgaaaccctgcaccacctgcgcgatctcggcaacacgctgattgtcgtcgaacacgacgaggacacgatacgccgcgccgactgggtggtcgacatcggccccggcgccggcgaacacggcggcgaagtcatctactccggccccgccaagcacctcatagaagccaagcgctccatcaccggcgactacatcgcccaccggcgagagatcgccgtgcccgccaagcgccgcaagatccacaagacccaggtgctcaaagtcgtgggtgcccgcgagaacaacctcaagaacatcgacgtgagcttcccgctcggcgtgctcaccgtggtcaccggcgtctccggctccggcaaatcctcgctggtcaacacgatcctctacccggtgctcgccgacaagctcaacggtgcacgcatcgtacccggccgccacacgcgcgtggaaggcgtggaccaggtgcgcaaggtgatccacgtcgaccagaacccgatcggccgcacgccgcgatccaaccccgccacctacaccggtgtgtgggacaagatccgcaccctgttcgccaagactcccgaagcccaggtgcgcggctacggccccggccgcttcagtttcaacgtcaaaggcggccgatgtgaggcctgccacggtgacggcacgctgaagatcgaaatgaacttcctgcccgacgtctacgtggactgcgaggtctgccacggcaaacgatacaaccgcgagaccctcgaagtcacgtacaacggcaagaccgtggccgacatcctcaacatgcccatcgaggaggccgccgacttcttcaaggcgtacaccggcatctcccgatacctgaagaccctcgtggacgtcggcctcggctacatccgactcggccagcccgcacccaccctgtccggcggtgaatcgcagcgcgtcaagcttgccaccgagctgcagcgccgatccgacggcaaaaccgtgtacatcctcgacgagccgaccaccggcctgcacttcgaagacgtgaacaagctgctcaaggtgctgcagtccctggtggacaagggcaatacggtcatcgtcatcgaacataatctggatgtgatcaaggaggccgactggctgatcgatctcggtccggagggcggcgacggaggcggcaccatcgtcacgcagggcacgcccgaacaggttgccgaatgcgaagcctcatggaccggcaagttcctgaaacccatgctttagccttccattgcagctgacctcgggtgggttggggtgtgtgttgctggacacgctccgggccgctcaggccaagtctttacggtccagcaacacacaccccaacccacccaatccctgatgattggcttaatagcgaggaggattatgacgaacgatattgagcggcatagtccggatgagtggcggaagactgcggcggcgttaatgtcggaaagcgtagctgtgggtgccggggaaacgacggcgaaggtgaatgcgaatggggcacctttgctgggggattctcgcgacctgttccgacccaagacctcggatattcccgccaaacccggtgtgtacaaatggcgcgacggggaagggcgcgtcatttatgtgggcaaggcaaagaacctgcgcaacaggctcaccaattatttccagccgctgtatctgctgcatccgcgcacgcagaccatggtgctgaccgcacgcagtctggagtggacggtcgtcgccaccgaactggaatcactgacgttggaatacacgtggatcaaggaattcgacccacggttcaacgtgcagttccgcgacgacaagacctatccgtatctcgcggtcagcacgggggagcgaattccgcgcgtgtgggtcacgcggtcgcgcaaacggcgggatacccggtatttcggcccctatgccaaagtgtgggaattgcggcacagtcttgaccggttgctgcgcacgttcccggtacgcacctgcaccaccaacgtgttccataaggcgcaactgaccggacggccatgcctgttcgcttccatcggcaaatgctccgcaccctgcgtgaaccgcattgaagcggacgaacaccggcggctgtgcgaacagctggtcggcgtgatgaccggacgactcggacggccatacatcgcccagttgacccgcgacatgaaagaggccagcgccgaactcgaattcgagaaagccgcccgactgcgcgaccagatccaaatgctggaaaccgtggtgcaacagaacgccgtcgtcttcgaccaggatgtggacgctgacgtgttcggcttcgccagcgacgagctcgaagcctccgtgcacgctttttatgtgcgcgccggctcgattcgcggcgaacgcaactggagcgtcgaacgagttgaggacatcgatgacgccgacttgatggccgaccttctggtgcaggtgtattcggacgccgccggggataatcacccccagtcggccgcgaccatctccaccaatcgcgaggccatcggctccacgcaaaccatcacggccacggacgctgtggcacgcgcccaggccacccgagaacgcaacacccgtcaggagaccaccgggcgcgcggacctgctggcacccatcgcaccggtaccgcgcgaaatcatcgtgcccgtcgaaccggcccgccgtgaggaactcgaaggctggctgaccaatctgcgcgggggagcggtgaccatccgtgtggcctcgcgaggcgacaagaagcagcttatggaccgcgccaacgagaacgccagccaagcactgcaacgcagcaagatgagccgcatctccgacatgggcgcacgcacccaggccatgaacgatgtggccaaggcattgggactcgcggaagccccgctgcgcatcgaatgctacgacatttcgaacactgtgggtggtgccttccaggtggcctccatggtggtgttcgaagacgcgatcgccaagaaatccgaataccgacgcttcgccatccgaggcaaggacggcaaaggcgcggtggatgatctgtccgcgctttacgagacgctcacccgccgcttcaagcacggcaacatcgccggcgactccggcgaaagcatcgacgcggaacagcgtgtggcctcggccgccggcaagatgaccactgccgtggcggcggagacaatcgctgcgaacggtaacgacaatggtgagggcggttccgacatcagtggcaaggggcacgcggtgccggtcggagtgcagaacgatgcgcgggagtccccgcccgacatcgtccagcagaacacaaaccggcatcactttgcctacaagccgaacctggtggtggtcgatggcggcaagccgcaggtcatggccgccgccaaggcgcttgaggactgtggcgtgaacgacgtggccgtctgcggactggccaaacgcttggaagaggtgtgggtgccggacgacgactatccgatcatcctcaaacgccagtccgaaggcatgtatctgctgcagcgtgtgcgcgacgaatcccaccgcttcgccatcacctaccaccgccagcagcggcgcaaaggcgccctgcgcagcgcgctcgacgagattcccggcatcggcgaaagctaccagaagcggctgctcaaccacttcggctcggtcaaagccatgcgcgaagccagtgtcgaggacttcgagaaggtcaaaggcatcggccacgccaaagccgaagcgctgtacaccgcgctgcacgagcagtgagccggcccggtccagcagcccagagtaaattttcggttgcggggcctgtggttgacatattcgaagcaaagtgtcggctagcatgggaacagacatcaaggaggggatatggccaatcatcgttgcgctgtactcggcaaacccgtcgcacactcattgtcacccgtgctccacaacgcggcctaccgttcgctgaaactcgacgattggctgtacgacaagcacgaggtgggggaagacgacctcgacgctttcctcaaaggccttgactcgacgtgggctggcctgagcctgaccatgccgttgaagaagaccatccaaccgtacggtgttccggaaaatttgtgggccaaggaactgaaggtggcgaataccgcggtattcgactggagcgtggctgccgatgattccgcttggccgaacggcaagccgggcatcaagctatacaacaccgatgtcatcggcatccaactcgccttcgaccatgccaatcgcgaactcggcgaacaccacaccgcgtcgagaagcggcaccgcgctgatcatcggcaatggcaacaccgccacttcggcgttggccgcatgctgcatgatgcccgaaatcggccatatcgtcgtcgccgcccgtcaccccggaaaaaacaccgggcttaaaccagtggccgaaaagttcgtcaacgtgcataacccgtacaacgaaatcgaattaggcgacgatcaggccctgcttgaggcagcccgcaacgccacctatgtcatcaacacgattcccggacacgcggccgacaacgtcgcggatgccctcgccaatgccggaaccgagccattctccggactgctgttggacgtgatctacgatccacgccccaccaagctcatggaagcctggcgcgctcatggcggtcacgccatcggcggcgaagaaatgctgctgtaccaagctctcgtacaggtattgctgatgaccggtatctgggatgacgacccgcccagcgatgccgaccagcgtctgcaggacaccaccaccgaagacgaccagctggagatcgcgatgcgcaaagctcttgaggaggcgctgtaatgaatcaacagacaacgaaccgcgataccggcgaggcggccgccacgaatgcgccggcgaattccgcgacatccacatcgactccggacaaccagccgaccccgcttgatgccttcgaagtgctgctcatcaccggtatgtccggcgcaggccgctctcatgccgctgactgcgtggaagacatgggatggtatgtggtcgacaacctgcctcccaaactgcttatcccgcttgtcgacatgatgaccacctccggttccggatcggagtcaggcgtccacaagcttgccgccgtcatcgacgtgcgctccagctatttcgacgagctggccgccgtgctcggccatctggatgatctcggcgtcaaaacccgtattctgttcctcgacgccagcaacgaagtgctcatcaagcgctatgaatccgtgcgccgcccgcacccgctgcagcacggcaaccgactgatcgacggcatccttgaggaacgtcacctgctggaagacctcaaggaacgagccgactgggtcatcgacaccagctccctgagcatccaccagctgtccaccaaactctacgaggcgatgctcggctccggccccaccaccgtggcagtacacatcttcagcttcggcttcaaatacggtatgcccatcgacgccgatttcgtggccgacgtgcgttttctgcccaacccgttctgggtgcccaacctgcgcgagcttaccgggcacgacaagccggtcgccgactacgtgctttccagcaagggagccaaggaatttctcgacgcttatgagaaagctatcgagattgcgttggaaggatacgcccaggaagacaagcactacgtaaccatcgccgtcggctgcaccggtggtcagcaccggtcggtggcgatgagcgaagagctggctcgccgcttacgcgcacatgggctcaacgtaaccgtttccgcgagagaacagcacaagcgtcactcatcgtaagcaggcgtcgagcggtcatcgggcaagtgttcggtgaccacactgcgagaaagcagggcccataatacgtatcaaacgggttcgcttgtccaccagattaggtatcacagaaagccgatggcttccgaccgtgtgacagcagatgacggcacgaagcgcctgaagcattgagaagaacgggactgtaggaggtagatcttggctcttctggacgatgtcaaaagcgagttggcagcctttgaaggcgattcgccagccgcgatcaaggcccaagctgcggccatgatccgttttggcggcggtcttcgaccggtacagaatacatacgttatccaagccgtattcacctcgcttgacgttgcagaatggctgaagaacacgttgaggaacacgttcgggcacgaagccgaggtcaatcacctcacacgtcagaccccgaacggccctgtcgagacctacgtggtgctcgtcacccgcaacgtagtggccttggctttgcagaccggactggtcgaccgccgcaagcagcaggtccgtggactgccgtctgaagtggtcaacggatccatcgcccaaatcaaagcggcatggcgcggcgccttcatggcccgtggcttcctgtccgatcccggtaaggccagcttcctggaaatcgcttgccccacggaagaggccgccatggccctgtgtggcgtggcccgtcgtctaggcatccaggccaagcatcgcacgctgcgtagctccgagcgcgtgacactcaaggatcccgacgccatcgaacgcatgctcaagctcatgggcgccacccgttcggctcgcgaatggaccggcaagcgttccgatggcgaggcccgcggcaaggccaaccgtctggccaacttcgatgacgccaatatgcgccgttccgccaaggccgccgccgaagccagcgaaaaagtgcagcatgctttcgaagtactcggcgataacattccggacaacctccgtcaggccggccagctgcgcatcgatcacgtggacaagagcctcgaggagctcggcaagatcgccgaaccgcaaatcaccaaggatgcgattgccggccgaattcgccgactgcttcaacttgccgagaagacggagaaggctcgcgcagccgaaggcaagtaacccgacaatccgatttgccatgcctattcggcaaaacgcgacaacgatgtgacaaaacaccgcattcagtcagtagacgaatgcggtgttttgttccggaatgcctgtaatatgcaaagtggcaaaattggccactttgacgtgcgattcgtcaaggaaaggatattcatgaagacactcaaggaccttggagatctcaagggcaagcgcgttctggttcgcgctgatttcaatgttccgctggacggcaccaccatcaccgatgacggtcgaatcaaggctgctctgccgaccatcaagaccctgcgcgaagaaggcgccaaggtcatcctcatggcccaccttggccgcccgaagggcaaggtcgttcctgagctgagcctggccccggttgccgcccgcctcggcgagctgctcggcgccaacgtgccgctggccaaggacacctacggcgaggacgctcaggccaaggtcgccgccatgaacgatggcgacgttgtgctgcttgagaacgttcgtttcaacccggaggagacctctaaggacgccgacgaacgcgccgcttacgccaagaagatcgccgccctcggcgaggccttcgtttccgatggcttcggcgtggtccaccgcgctcagggctccaactacgacgttgccgccgatctgccggccgccgcaggcctgctggtcgagaaggaagtcaaggccttgtccaaggccaccgagaacccggagcgtccgttcaccgtggtgcttggcggttccaaggtctccgacaagctcggcgtcatcgagaacctgctcgacaaggccaaccgtctggtcatcggcggtggcatggtgttcaccttcctcaaggccaagggctacgaggtcggcacctccctgcttgaagaggaccagcttgagaaggtcaagggctacatcgagaccgccgagaagaacggcgttgagctcgtgctgccgaccgacgtcgtcgtgaacgccggcttcccggccggtgacaccccggttgctccggaagtcgttgccgccgacgccatcccggccgacaagatgggtctggacatcggcccggagtcccagaagctcttccacgacaagatcgtcgactccaagaccgtcgtgtggaacggcccgatgggcgtgttcgaggttcctgagttcgccgccggcaccaaggccgtggcccagggtctggtcgacgccaccgcagccggtgcgttcaccatcgtcggtggcggcgactccgcctccgccgtgcgcaacctcggcttcccggaggacggcttctcccacatctccaccggtggtggcgcttccctcgagttcctcgaaggcaaggagctccctggcctgaaggtgcttgagtaatccattttctagctcccctccttgaggggagctacgtttttttttagaagggaaacatatggcgtccaaacgcattccgttggtggccggcaactggaagatgaatttcgaccatcttgaagccacttacttcgtgcagaagctggtatggctgttgcgtgacgctcacttcgactttaaacgctgcgaagtcgcgcttttcccctcgttcacgtcattgcgcagcgtgcaggtgctggtcgaagccgacaagctccatgtcgcctacggcgcacaatccgtttccgtgaccacccaaggtgccttcaccggcgatgtgtccgcggacatgatcgcccatcttggctgctcatacgtcatcgtcggccactccgaacgccgcaaataccatcctgaagatgacgccaatatcgtcgatcaggtacgtgccgtgctcgccgccggcatgcagccgattttgtgcgtcggcgaaagcttcgaggaacgacgtcaaggcattgaactcgatttcgccgtgggccaggtacgagacgtcacccgcgatctcaacgaagaacaagccgccaaactcatcgtggcctacgaacctgtctgggccattggcaccggcatggtggccactccgcaatccgcccaggatgccgcaaacgccatccgcaacgatttgaagaccacttttggcacgaaggtatccgatagcgtacgtatcctgtacggcggatcggtcacctcgaaaaatgcggcggaactcatttcccagcccgacgttgacggcttcctgatcggaggggcggccctggacgttgaggaactcgccaaaatcgctcgactggcactgaaatccacgaaatcacggaactaataccacggttttcccgtgtgtgcgctatgctggtcaacagtccaatcaatccggaggtaccctgtgaccgctcttaagatcacgctgcaagtcatcgtcgtgctgctcagcttcgtgctgaccctgctcatccttatgcacaagggcaagggcggcggtttgtccgacatgttcggcggcggtctgacccagaacgccggtacttccggtgtcgccgaaaagaacctgaaccgttggaccgttatcatcgctctggtgtgggtggccttgatcatcggcctcgacatgatgaccaagttcaacctcggctgatcggcttgcacgccatatagacttgtcgctcgcgacccatgaccgttaccgtcggtcatgggtcgtatgcgttctatcgagtattacgaaaggacatcaccatggtcactatgaaccgcaacaaagtcgttatcgtcggcaccggccgggtcggtgccaccgccgccttcggcatcgtcacgcacggcctgtgcaatgagcttgtgctcatcgactgttccgccgccaaggccctgggggaggcccgcgacctcgatgatggcagcgaattccaggaccgccacgtcaaggtgcgcgccggcgactacgccgactgcaaggatgcggacatcgtcgtcatcaccgtgggccgcaagccgccggccaactccaaccgcatggccgaactcggcttcaccgtgggtcttgtgggcgaagtggtcgacaacgtcatggcctccggttttgacggcgtgatcgtcatggtctccaacccggtcgacgtgatggcttggtatgcctggaaacgttccggtctgcctcgcacccaggtgctcggtaccggcaccgcgctcgacacctcgcgtctcaagaccatcatcggcgaagagaccggccttgacccgcgcaacgtgggcggcttcgtgatgggcgagcacggcgactcccagttcaccgcatggtccaccgtctcgctcggcggcaagccattcgcccgcttcctggccgacaaccaagaccgtttcgcctccgtgtccaccaccgaaatcgaagagaagacccgcacccgtggcaatgagatcgtcgcggccaagggcggcaccaacttcggcatcgcctccaccgtggccggcatcgtacagaccatcctgtgggacgaacgccgcatcgtgcccgtctccaccctgctggacggcgaatacggcgaacatgacgtgttcctcggcgtccccactgaactgcgcgccaatggtgccaacgagatcgtcgaactcgatctgagcgaggacgagcgggccaaactgcaccattccgccgaactcgtgcgtgaacactgtgaggggctgctgtgattctcgacgccatcacgccgaaacaaccccgactgctggtcgccgacctcgacggcacgttgctgcacgacgccgaggtattcgaggaccggttcattacccagcgcagcatcgacaccatcaaccgcgcgcacgatgccggaatgcaattcgccatcgccaccgcgcggccggtgagtaccggtctccagttcgccgaaaaactgccggtggacgccgtaatctatctgaacggcgccctcatcgatttcgacccggcccactccgacttcgacctgctcacctcaggtgccacgccggccgatgagaaccatttgatcaagattggcttctcctcacggcgtgcctgcgaagtctgtctgttcctgctcgatcgcatgcccggcctgaagctcggcatcgtgatgaacgacgtgcgctacaccaacttcgatgtgcgcgtgtattggaaaactcaggccttccaatacacgaacttccacgacgtgcccgaaggcgtggcggacaagatcaccatcttccccgagcctgaacagtggaacgagctgcgtgcgctgattccgccggacttcgacatctccatcagcgaaggcgtgatgtggatgctcatgaacccgcaggccaacaaggagcacgcgctgcacctgctgtgcgagcgactggacgtgccgcttgaacagacagccgccttcggcgacgacctcatcgatatcaacatgatgagcgaatccggccggggcgtggccgtggccaacgcgaaccccaaggtgttgtccatcgccgacgagatctgcccgtccaacaacgaggacggcgtcgcccaatggattgaagcgcagttgggctgaaccggtcgagactcgagaacacgccaaaattgaacttgtgttgaaccgggggtatgctttgaaccgttgttcaaaagataaattgaactcccggttggaggcataaggatatgagcgtatcggtgtttgcggaacgtctgcgcaatgcgatgaacagcaggggactgaagcaggtcgatttggtgcacgccgccgaacatcgtggtgtaaagatgggcaagagccacatcagccaatacgtggccggcaagaccatgccccgcgaggacgtgctcgaattcctggccagcgaactggacgtcgacatgaactggctgcgcggcgaggaatccaccacgcaattgaactcggacgcctccaacagcgtcacggacggcgaacacgccgccacaccgcttgccacgggtgcctccaagccccagacggacagcgagattcccgtgggccgccgccgcaccttcggcaaatcgcacaagctcgacaacgtgctctacgacgtgcgcggcccggtcgccgacgaggcgatgcgcatggaggccaacggcacccacatcctgaaattgaacatcggcaacccggcacccttcggcttccgcacgccggacgaagtcgtctacgacatggcccaccagctcaccgacaccgaaggctactcgccgtccaagggcctgttctccgcgcgcaaggccatcatgcagtacgcgcagctgaagaacatcccgaacgtcaccatcgacgacatctacaccggcaacggcgtcagcgagctcatcaacctgtccatgtccgcgctactcgacaccggcgacgaagtgctcgtgccatccccggactacccgctgtggaccgcctgcgtgaacctggccggcggcaccgccgtgcactacctgtgcgacgaacagtccgaatggtatccggacatcgacgacatccgctccaagatcaccagcaacaccaaggcgattgtcatcatcaacccgaacaaccccaccggcgcactttacccaaaggaagtgctccagcagatcgtcgacatcgcgcgcgagcaccagctcatcatcttctccgacgaaatctacgatcgcctcgtcatggacggcctgcagcacatctccatcgcctcgatggccccggacctgttctgcgtgaccttctccggcctgtcgaaatcgcacatgatcgccggctaccgcatcggctggatgatcctgtccggcaacaagcgcatcgccaaggactacatcgagggcctcaacatgctcgccaacatgcgcatgtgttcgaacgtgcccgcccagtccgtggtgcagaccgcgctcggcggccaccagagcgtcaacgactacatcgtgccgggcggccgcgtgcacgaccagcgcgacctcgtctacgacatgctcaaccagatccccggcatcaccgccgtcaagccgaaggccgcgttctacatcttcccgaagatcgacgtcaaacgcttcaacatccactcggacgagcagttcgcgctcgacctgctgcatgacaagcacatcctcatcagccacggcggcgcgttcaactggcatcgccccgaccacttccgcgtggtgtacctgccgcgcatgggcatgctgcgcgaaaccatgggggagatctccgacttcttcagctactactggcagagctgatccttggcgcaaacgaacacgctcgattgtttcgtgatatgaaggagatcttatgccggtggtgtcgcgtcgtgcgcaggaagcgctgtatcccagcgatcgcgcgaaccgcggcatggtggtccgcgctatgccaaggtgaaggcgatgacgaaggccgtggcggacagtgcggttgccaggagcagatagcacacggcggctgaatttcgagagccatcggcattggcagcgttaccgccgttatttgcgttgcgtgcagccaacgtgatggccgtaatcgccgaaagcagggagaacaatggcagcacgcacaacacgacggtcagcagtcccaaagcttcatggccgatgcaataagcgacaagacctgcattgtcagttgccgatagcgctgggcagaaatcggtgtgtctaccagtgttgtagctgtaggtaaagaacgtgatacctgaccagaacagggcaacgggaacagagcaattgcgtatggcggatgcgttgatgctgatggtgtggaacaggtcgtgcaaggaggtagcccgtataccactgcgttctggcgtgattcgattactgttgttttgcgagtcgatggtaagagaggcgcattgcaccagcgcatatgccgcaagtccaagtccgcaagcgatggttgcgccgccgctgaagttgacctcgtcggatactgaatattcggtgacgaataccggcatcacgccaatctgccatacgaacaacagtcgcgcgattcgtatccaaccgttgctcagatatgaggtgactatggcgtgcaccagccacgtcaccgcatacatcgcccacaacgttacaatcttggtattcgcactcaacaccaatatgatcgcaacagccactgccgcaataagaacactaaacaccgaacagagccgatggcgcgaaaagccctgtactcccgcaacagtcagacagagaatcgcgacaacactcagcgcagtcaccgtcataaaccacagtggtgaggtgacgcaggctccataatcgtcagttgcttggcccgagagatagtaggtcattctgccaatcgccggacaattcggatgcaacatcatgccgccccaaatgcgctcatataatggcgcgaacgatacaccggcaccactgagcgtcgcaacaaccgccatcaccatggccggaatcagcccaagctcgcgattccggccggtttccgctatctgtctatcactggtgtccatgactcaccccaccttatgccgttatcgccgtcgtcgatgatgctagtataactatggcagatgggcggagaccagcggcatacaggaattctgtatgccgctttataggagggatactgcggcagccgccatcaccgaccgaccgccagactccggcacagaccgggaagaactaccgtcgcggagcatcggcgataccaatggcaacaccgaggatagccgggaccacccagccgagctggtattgctgcaaaggcagcatagccagcgccgcgtccagccagccgatggaaccgccgaagacggcgaccaaactggagatgcaggtggcgaaggatgcgatgcccaccagcagcacggtccagaagtagacgcgcgggaatcgcgcgccgagcgacttgtgggtcagcgtcagcagtaccagcacgatggcgatcggatacagtgcggacaacaccggcacggaaaccttgatgatcgcgcttagcccggcattggacacgatgaaactgaacacggtgaagatgacctgccaggtgcggtagctcaacgttcggccggcgacggtccggaaccgagtatggaagtaggtggcgcaggtgccgatcagtccggtgcatacgttgaggcaggcgatgacgaacacgatgccaaggaacgcggtaccgaacgtgccgaacagggatgaggtgaggttggtgagcacggtcgcgcccgtgtctttggtggggtcgatggtggcgatggcgccggacaccacgcccacgtagcttagcgcgccgtaaatcacgatcagcagtacgccggtgccgagcccggcatacgcggtctccttctgcacttgcgattcgtcatcgacttgttgggcgcggatattcgcagagatcacgatgccgaagtagagcgcggcgagcaggtccatggtctggtagccgtcgaggaagccgcgtgcgatctggtttgtggagtagtcgcccatcgggttggccggggtgccgatgccgtggatcaggcaggcgatgaacaggacagcaatgagcaccagcagcaacggtcccatgaatcggccgagcactttggagagtttctcgggatgctgggcaaacaggaacgccagcgtgaagaacacgagcgagtagatgagttgggccagccagccataggaggacggtacgaaaggagccaccatcatttcgaatgaggtggtcgccgtacgcggaatcgcaaagcacgggccgatggtgagcatgatcgccacgccgaggaacaaggcgaatttgggggagacccggctggcgagtttgtcgaaaccgccggcgaaggtgaccgccagcacgccgagaatcggcaggccgactgcggagacgatgaaaccgatggccgccggtatggtcgcggaaccggcctgcgcgccgacgaacggcggaaaaatcagattgcccgctccgaagaacatcgaaaagaaggtgaaggtcatcaccaaccgctggcgtgcgacaagtttgttcattacgattcggcctttctctcatatgctcgtaccactgtagcaacaaacgaaagaagccccgaccgttggggtcggggcttctgtgagctaatcaactagtgcgctaaacacgcatcagtcgtcaaatctcaggcgttcacgcggtcgatgccggactggacgtcagacagcacggaatcccaggacttgatgaaggcagcgacaccgtcggcctccagcttgtcggtgacgtccttgaggttgatgccgagctcagccagcttgttgatgatggcgtgggactcttcgtaggtgccctcgatggacggagcgccgttgccgtggtcggccagagcgttcagggtcttctccggcatggtgttgacgatgtgcttggcaacgagctcgtcaacgtacttgcagtcggagtaggcggcgttcttggtgccggtggaagcccacagcggacgctgaaccttggcgcccttggcagccaggtcggcccaacgcggatcctcggcgaacttcttctcgaagagttcgtaagccaggcgagcgttggccacagcggccttgccctccagagccttggcctcgtcggagccgttggcttccagcagcttgtcgacagcggtgtccacgcgggacacgaagaaggaagcgacggagccgatgtgcttcaggtcgtggccgttggcggcagcctgagcgatgccctcgatgtaagcgtcgatgacctgctcgtagcgctcgagcgagaagatcagggtgacgttcacggagatacccttggccagggtggcggtgatggccggcaggccttcgagggttgccggaatcttgatcatggcgttcgggcggttgaccttctcccagagttccacagcctgcttggcggtgttctcggtgtcgtgggccagacgcgggtcgacctcgatggagacgcggccgtcgacgaagtcggtagcctcagcgatctcgcggaagatgtcggtggcgttgcgcacgtcggtggtggtgagctcgcggacagcggtctcaacgtcaaccttgccgagctccttgagctgagcgtcgtacgggccgacctggctcagggccttctggaagatggacgggttggtggtcacaccgacgacgttcttgttggcgatgaggtcctgcagggagccggactcgatgcgggagcgggacaggtcgtccagccagatggaaacgccgttgtcagacgtacgctgagttgcttcagtcatttatttttctccttatattccgtattggaacaaatctttaagtagaccccctctaacgagagggccgatcaggtggagtcttgagtacaagcctccctcgtcagagggaggttaggggactcacttggcggcttcgacttcggcgatggagtccttggcggcttccaccacgtgctcggcggtgatgccgaggtcgatcatgttctgagcgccgtcgccctgcaggccgaactgctcgatggagacgggcttgccgtaggagccgaggtacttgtaccacggcatggcaacgccggcctcgacggagacacgagccttgacagcggccggaagcacggcctccttgtactcggcgtcctgctcctcgaaccattccatggacggcacggacacgacgcgagccttgacgccctcgccggccagggtcttggcggcagccacagcccactggacctcggaaccggaagccatgaggatgacgtccggagtgccctcggtgtcgaccagaacgtaagcgcccttcttgacaccgtccttggccttggcggcggtctcggcaagaaccgggacaccctgacgggtcagaaccatggcaccaggcagggtgttcttcttctcgaagaagtaacggtaagcctcggcggtctcgaaggcgtcggccgggcgaatgacctcaagctgaggaatcgcgcggaaggaagcaaggtgctcaaccggctggtgggtcgggccatcctcgccgacggcgacggagtcgtgggaccagatgtacaggttcggaatctccatgagggcggccagacgaacggcggaacgctcgtagtcggagaacatgaagaaggtgccgccgaacggacgggtgtgggagcccagcaggatgccgttggtgatgcagcccatggtgaactcgcgcacgccgaagtgcagctggcgaccgaactcgttgcagttcggccactgcttggtggcgcactcggccggggcgaaggtggcagcgcctttgagatcggtcttgttggagccaccgaggtcggcggagccgccccagagttccggcatgacagcggcgatggcgttgagcacggagccggaggcgccacgagtggcgacacccttgccgacttcgaaggtggcctcaaggtcgtcaagagccttgtcgaagccttccggcagttcaccggccttcagacggtcgtacagggcagccttgtccgggttggccttgcgccaagcgtcgaacttctcgtcccattccttgtgggcttcgagaccgcgctcggcaaccttgcgagcgtgagccagagcctcttcgtcaacgtggaagttctcttccggatcgtagccgagggcttccttgaggccggcaacagcctcggtacccagcttggaaccgtgggaggacgggtcgttggtcttgcccggggtcggccaagcgatcagggagtgaaccttgatgagcttcggctggtccggagcggccttctcggccttggcgatgacgtcagccaggccctcgatgtcctccttgtaggagccgtcgggctggatgaagctgaactcgtcggtgtaccagccgtaggcctggaagcgcttgagcacgtcctcggccagcaccaggttggtgtcgccttcgatctggatgcggttggcgtcgaagatcacggtcaggttgccgagcttctggttggcggccagggaagcggcctcgccggagatgccctcctcgatgtcgccttcaccgcagatggcccagatcttgtggtagaacggggaatcttccttcggggtctccgggtcaagcagaccgcgctggaaacgctcgccgtaggcaaagccgatggcggaggcgaagccttggcccagagggccggtggtcatttcgatgcccggggtcaggccgtactccgggtggcccggggtgcgggtggcagcgccgccacggaagttcttaaggtcgtccaaggtcacgccgtagccggagaagtacagctggacgtactgggtgagggaggcgtggccaccggaaaggatgaagcgatcgcggccttcccagttgggatcattcggatcgtgcttgatgaagtgctggtacagcgtgtaggcgacgggcgccagggagatgggggagccggggtggccggagcctgccttctcaaccgcgtcagccgaaaggaccttcgccatcttgatggcgcgctcgtcgagctcggtctccttgaattcggtcatggattactttccttccaattggtcgggccgcgtatccggcttgtgccgggcgcttgacgccctcacattgcgattaccatgctagcgtcggtttgcgacgttgtggtgcagttttggcgtgttttggtagtttgtgttctgttagcgttcacagtgaacattgctacgctgcaaacgaacgcattagcactcaagcctaaggagtgctaatacaatgttctagggtgaagtgcgccacctgcacgtggcggagccaagaaagaggcaatatttctgggttcccgcgtgtcgcggcgtggcgaaccgaccgtcggggtacgccctgagtgaaccgtgactgatatgaatatgtatgtatgtataaggaggcgcgcatgacgcaatcaaggcgcatgttggtgctgcgcgccgtggtggaggattacatccgttctcaggagcccgtgggctccacttcgctgacgcgtgaccatgatctcggcgtcagttcggccaccatccgtaacgacatggccgccctggaggacgaaggctatctgattcagccgcacacttcggccggtcgtgtgcccaccgaaaagggctatcgatactttgtggaccgacttgctaccgtggtgccgctcagcgaggcgcaacgccgcggtatcaacagcttcctatccggatcggtgagtctcaaggatgcgttgcaacgttcggcacgactgttgtccgaaatcaccggtcaagtggctgtagtcgcctcgccatcgctggccaaggccacattgcggcacgtggagatggtgcccgttgccatgaccacgttgctcgccgtggtgattaccgacaccggccgcgtggctcagcacggcctgaccatcgcatccatgcccgccgtggacgagatcaaccggctctccaacaccgtcaacgaacaatgcgacgggctgtccctatcgaaatccgcggagaccgtgcgatccatcgccgccagcgccggctacgagtcggtgcgtggcgtggccgacacgctggccgacgccttcgaatcgatggcattggacgaacatgcgaacgaactgtacatgtccggcacctcgcacctggcccactcccggtccctggccaatctggccccgctcttcgacgcgctggaagaacaggtcgtgctgatgaagctcatgagcaacctgagcgaggagacgaatgcatccggcgtgggcgtggccatcggctccgaaatgcacacccccggactactgcatgcttccgtggtcagcagtggctatgggcgcagcggagcggcgggcgaaccggcggggaacgatcccgtagacgaactcgaaaccgaatccgagacggagagccagacgaacgatacggaacccatcgccttcgttggctccatagggccgacccacatggactacgcggccactatggccgccgtcagggccgtagccagatatttgaccgccttcctctccgagggccggacccaagactgaccgccgtctgtggcacaatgacccgcagaccaaacgaacacaaaggatcaatcaagtggcagattattacgagacgctgggtgtggaacgcggcgccagtgacgacgagatcaagaaggcataccgcaagctcagccgtaagtaccaccccgacatcgcgggccccgaattcgaggacaagttcaaggaagtgaacaacgcctacgatgtgctgtccaatccggacaagcgtcgtatgtatgattcgggcgtcgacccgaacgatccgaacgccggtgccggcggcttctccggggcgggcttcggcgatatgagcgacgtgttctccacgttcttcggttccgcgttcggcggtggctcacagggcccggtgccgcgtacccagcccggccgcgacgccttggcctcggcgtccatcgatttgaagacggcggtgttcggcggcaccgcgcatgtcaagatcaatacgttctccctgtgtcaggagtgcggtggctccggtgcccagggcggcgcacagccggtcacctgccccgactgccacggacagggattcatgcagaaggtcgtgcgcaccatgctcggccagatgatgacctccgccccctgtgaacgttgcgaggggcacggtaccatcatccagaacccgtgccccagctgcatgggccacggccgtgtgcgcaccacgcgtaccgtgggcgttaccgtgcccgccggcatcaacgacaacgcgcgtctgcggttggccaaccagggcgaagtgggtgagggcggcggcgctgccggcgacctgtacatcgacatccgcatcaaggcggataagcagttcacccgtgatggcgacgacctgcactgctggattcaggtgccgatgagctgggccgtgctcggccacgatctgtccattgacacgttcgatggtgagaagaccgtgtccatcccggccggctgccagcctgaggatacggtgacgctgaagggactgggcgtcacgaacatccgcaacaaggacgagcgtggcaatctcatcgcccacgtcaatgtacttatccccaccaagctcaacgaaaccgagcgtggcctcatcgaacagttcgccgcctcgcacgattcaggcgccacgcacgtctcccaggcatcccgtccacaggccggtcaaaagaaaggtttcttcagcaagttgaaggacgcactgagctgagagcggatgcgttcttggctcccctcagagagggagccaagtctgttacttcagcatggagcggcacatggagcggtattcgttgacgtagccgccgccgaagaagacacagtggccggcgatggggtagagctgccagagcgtgatacgctcctgccatccggccttcaacggatgcacggactggtagccctcggtgatttcgctcagatagctcatgccgaacaggtgcagcatagccagatcctcctcgcgatgaccgccatgtgccgccgggtcgatgagcacagcctcgggctgcccggaatcggcggtccacatcacattgccgctccacagatcaccgtggatgcgcgccggcttgtcggacgcggctcggcccatcagatccggcaacgcttcaatcacgcgctcggtcagttcgacatcgcgcttatccagctcgccacgcctcacaccaaggttgaccatcgggcgcagacgtccatcagcgaaatagctgatcgggtcggtccactcgccggtatccattttcactgggtcctgcaatggtccgaaatagcatgtgccgttatatccgtcaggcgcagacccgaaatattcggcacccacatcatgcatatgggccagagccgcaccaaaagctcgtgccgcctgaggcgtgggggacgcgctgcccacacgttcgatatccagataatccttgccccagccgtatacctgcaccacgcgcgggccgccctgcgcatgagccgctcccaaccattcgagtcctcgaccctcgcattcgaagaatccttccggcgcgaatgccctgcttttgcgatacgtggccataatgctcccttcgtcgcttacgtactatatccactttcattgtagaagccgtggatgttaccgattcttagtgttgttctacacccccttggatagggtgttcatcgtcataacacatcaaatacttagaaatcacgaggggtcatgaattttttccaagcgatcattctcggcatcgttcaggcgctgaccgagtatctcccggtatcctccagcgcgcatatccgtattttcggcgatttgatgctgggctctgatcccggtgcggcgtttaccgccatcatccaaatcggcaccgaacttgcggtgattctgtatttccgtcacgacatcatcaatatccttactcactggttcagctgcctgttcggcaagaacggcaaggattggaaggcccgcatgggccgcggcgacaattacgccacactcggctggaacattatcgtcggctcgattccgattatcatcctcggcttcactctgcagaacgtcatcgagacctcgttgcgcaacctgtggattacggtaaccgtgctgttggtattcggcattctgctgtggatggtggatgccaaggctcgccagaacaaaaccatgaatgatatgacgtatcgtgatgcgttcctcttcggtttgggccagtccatggcgctgattcctggtgtgtcccgctccggcggcaccatcaccgtcggtcgcgcactgggctacacgcgtgaggccgctgtacgtctgagcttcctgatggccatccccgcggtgttcggctcaggtttgctcgaagccatcaaggccgtgaagaactacaaaaccgatgcgatgttccccggctgggggccgaccctcgtagccatggtcatcagcttcgtactcggctacatcgtgatcatcggattcctgaagttcgtatcgaacttctcctataaggccttcgccatctaccgcatcggtttggctgtggtcgtcgccttgctgctgattgtgggcgtgctgccggccatcgatccctccgtggtggctgcggcataagacgggtcgataggcgactcaatattaatggtgctcccgccggcgggagctgtcagcgaagctgactgagggtggtcactggaatatgccagcagaaccaccctcagtctcgctacgcgagccagctcccgtcagcgggatattgtgtatatagggctaattgcccatctggcgtagaaacgcttccgcttctttgactagttgttcagcctggggcgctcccaatgaagcctccgcctcggctttctgctgcaagtcgtagtcgtgctccaaatgctccacataatcatgaagctggtcattgcaacgaaccagtatcgatgcctgcgccttccactgttcggctttctgcttcaggtctgccgtatcgaagatgaagccgatatacttgcccaacgcatccagcaatcgtatagtgccggcagagcattcgtcgctgcccaaatattgggggatggacacccacatcgaggaatgagcaaatccttgttgtgcggcagctacatccagaacagtaggaatgcccaccgggccgttatacgaccggtctccttcgcattgacagtctccgtcgctgacggcgatgggcaacggacgggtatgcgggcaatcggagaacatcgaacctaacgtaatgatccgattgacatccagctcatcggcaatggccagactctggctacagtattccttccaccgatagtttggttcgggggcgatctgcgcatagatacgcttgcctgcgtccaacgtgatgtcgtagaacgtggtctgtggccagataagattggtgcgacccgaaacatggcacagcataggacgggcaacctgatagtcatagaaatcatcacatctaatatgacgaatctcgcgggactcatatcgcttgaccagatggcgcaccgcgttcgtcgccgcctgacaggcatcattccatccctcgaatgcggcgatcaatactgcgccggtgtccttcgctgcttcactcatacctctagagtaactggaattcattgcccgaagcgcacgctttagccataagcgagagtatgcaattacaggcgacacgccgcagctggacgaactacacgcatgtgagtatagtaaacactcgtgcttcggtagggagacctcgccaaggaaacacacgcggacatagcttagttggtaaagcgcaaccttgccaaggttgagaccgcgggttcgagtcccgttgtccgctctaggtccgtgagttgacagaccttacggtgggttagccaagcggttaggcagcggcctgcaaagccgtatagacgagttcgactctcgtacccacctctcagaccagcgaagcaattcaatgggatgaaatatgacccgggcggttggcgcagtggtagcgcacttccctgacacggaaggggtcacaagttcgaatcttgtatcgcccacgaaagtcgaagcaattcgactggatataactgaagaaccgagtattcgggcgattggcgcagcggctagcgcacttcgttcacaccgaaggggtcgtaggttcgattcctacatcgcccactggattccgcttctcacggcggattcctttgcggacatagcttagttggtaaagcgcaaccttgccaaggttgagaccgcgggttcgagtcccgttgtccgctccacaacgaaacctcgcttcggcgaggttttttcgtattggttcagatgctggtggtatttgtcgcacgcccaacctatcgtgtcctacgttgattaaccagtccaggcctgcacattagtaccgtgggccccgatagcaaaggacaaatcatggcgcaagctaccatctccataaccgtcaacggcgaagcgaaggaggtggaagcaaccaccaccggcgtagaactgttcgcggaagacaagaacatcatcgcggtcaagatcaacggcgagaaccgtgacctgtacacgccgctgaacgatggcgataccgtcgaccccatcgccctcgactccgaagacggcctcgcaatcatgcgtcactcggccacccacgtcatggcccaggccgtgcaggaagtctacccgaacgccaagctcggcgtcggccccgtcatcaaggacggcttctactacgacttccaggtcgaccagcccttcaccccgaacgacctcaaggacatcgagaagcgcatgcagcgcatcatcaagtcctcccagtccttccgccgtcgttccgtgaccgaggaagaggctctgaaggaagaggccgaccagccctttaagatcgaactgatcgaagacaaggaagcacacctcgacccggccgccgccaccgagatctccgaaaaggagctcagcttctacgacaacgtagaccgtgatggcaatgtggtttggaaggacctgtgccgcggcccgcacctgccgaacacccgctacatcaaggccttcaagatcgagcgttccgccgccgcctactggcgtggttccgagaagaacccgaccatgcagcgcgtctacggcaccgcatgggccaccaaggaagacctcaaggcctaccagacccgcctggaagaagccgccaagcgcgatcaccgcaagctcggcgccgagatggacctgttctccttcccggatgaaattggccccggcctggccgtgttccacccgaagggtgccgccgtgatcaacgctatggaggactactcccgtgagatgcaccgcaagcaccactacagcttcgtgcagaccccgcacatcaccaagggcggcctgtacgagacctccggccacctgcactggtacaaggacggcatgtacccgcccatgcacctcgacgaggagaaggacgcggacggcaacatcaccaagccgggcgccgactactacctcaagccgatgaactgcccgatgcacaacctcatcttcaagtcgcgtcagcgctcctaccgtgagctgccgctgcgcctcttcgagttcggcaccgtgtaccgctacgagaagtccggcgaggtccacggcctgacccgcgtgcgcggcctcacccaggacgactcccacatctactgcacccgcgagcagatgaaggacgagctcaccagcctgctcaccttcgtgctgaacctgctcaaggactttggcctgaccgacttctacctcgagctgtccaccaaggacccgaacaagtacgtcggctccgacgagatctgggaggaggccaccaacacgctcgccgaggtcgccaaggaatccaacctcgagctcgtcgacgatccgtgcggcgccgccttctacggcccgaagatctccgtgcaggcccgcgacgccatcggccgcacctggcaggtctcgaccatccagctcgacttcaacctgccggagcgcttccagctcgagtacatcgcgaaggacggcacccaccagcgcccggtgatgattcaccgcgccctgttcggctccatcgaacgcttcttcgccgtgctgctcgagcactacgcaggtgccttcccggcgtggctggcccccgtgcaggtgctcggcgtgccggttgccgacgagtttgccccgcatctggccggcttcgtcaagtcccttgaagatgagatggtccgttgcgagatcgactactccgacgatcgcttcggcaagaagattcgcaacgcctccaagtccaaggtgccgttcatcctcatcgtcggtgaggaagacatgaacaacaacgcggtcagcttccgcttccgcgacggcagccagctcaacggtgtgccggtggacactgctcgcgagcagattctcaccgtcatcaagaagcgcgtccaggtgaactccgccgacgacttcaacgctgctgtggctgagtgatgtgaatggtactggctcccctctctgaggggagctgacgccgtaggcgactgaggggagtcctgcatggctcgcactcccttcagtccgtttcacggacagctcccctcagagaggggagccaagaaagggtgcgaaaatgactgacgtgcgtgtcgataatccggcggactttccgcctcaggaggacacggtcgaacgactgtggactccgcagcgcatgacctatgtgctgcgcaacagcgaggatcgcccaaccaagcccaagacgaaggaatgcccgttctgcgccggacccaaaaaatccgacgaagacggcctcatcgcctggcgtggcacgcacgtgttcgccatcatgaacctctacccatacaatgtcgggcatctcatgatttgcccgtaccgtcacgtcggattcatcaccgaactcgacgatgccgaactgttcgaattcgagaaggccaccaccctcgccatgaaggtgatggagaccgtctcccgtccggacggatacaacatcggcatcaatcagggcgaggtcgcgggtgccggagtcgccgcgcacctgcaccagcatgtggtgccgcgttggaatggcgatgcgaacttcatgcccatcgtcgcccagacgcgtaccatgccgattctgctgtccgaccagcgagacgcctatgcccaggcattcgaacagctggccccgcagtatcatttgccgcttgcctgaccgggtgcggcacccgcgcaaccggttttatcggtacgcgcaataagacaatcatcggaaacattacgggtatgtctgattaacggcctacaatcgtttcgtttgacatcatccgtttcaataattgctaggagcattatgtcaggtcattccaagtgggcgaccaccaagcacaagaaggccgccatcgacgccaagcgcggcaagctcttcgccaagctcatcaagaacatcgaaatcgccgcccgcctcggcggcggcgacccggacggcaacccgtccctgtacgatgccatctacaaggccaagaaggcctccatgccggccgacaacatcgctcgcgccgtcaagcgtggtgccggtgctgaagatggtgccgccaactacgaagacatcgtctacgagggctacgctcctgccggcgttggcctcatcatcgaatgcctgaccgacaaccgcaaccgtgcggccgccgaagtccgttccaccctgaccaagggcaacggctctctggccacctccggctccgtgtccttcaacttcgagcgcaagggccagattgtggtgccgtccgagggcgtggacttcgacaagctgttcgaaaccgccgccgaagccggtgccgaggacgttaccgatgacggtgaagtgttcaccgttgtgaccggtccgtccgacctgttcaccgtgcgcaaggctctgcaggaagccggcttcgactacgattccgccgaccaggtcatgcagccgaagaacgaggtcgagttgagccttgaggatgcccgcaaggtgtccaagctcatcgacaacctcgatgacctcgacgatgtgcagaacatctactccaactggaccgcttccgacgaggtgatggcccagctcgacgaggagtaatcctcgtgattatccttggcgtcgaccccgggctcacacgttgcggggtcggcgtgatcgaagccggcgagcaccgccggctttcgtttattcacgtggacgtggtgcggtcctcaccggatatcacccaggatctgcgtctactggccatctacaacggcctgtccgagaaaatggaccgattcgcgccggacgcggtatctatcgagcgtgtgttcgcccaatccaaccgcaacaccgtactcggtaccgcacaggccgccggcctcgccatgctcgccgccgcgcaacgcaatattcccgtggcgttgcatacgcctaccgaagccaagctggctatcaccggtaacgggcaggcgcagaagattcaggtggagcgtatggtgacacgtattttgaacctcaccaaaatgccgactcccgccgatgccgccgatgccttggctttggccatttgccatgcgctgcgcccggcaggcgcattgcagggcggcgaacgcgaacaacatctgaccgccgcgcaacgccagtgggctgaggccgcacagaactccacgcgccgccgcatcaaccacgaccgaggcatgtagtatactttcgaacagttgttcgagtcttgaatcctggagcgctgaaggagtacctgtatgatcggcatgctgaccgggcgggttgaatcagtcgaaaccgataccgcattgattgatgttgggggagtgggctacgaagtgcgcatgtccgccaccgacctgagccgtctgcacgccgggcaagacacccgcgtcttcacctatatgaacctctctcaggatgccattaccctgcatggattcctggatcgggacgccaagaaaaccttcctacaactcatcaaggtctccggcattgggcctaaagtggcccaatcgttactctccacactgacgccgagtcagttggcccacgccatcgccgacaacgacgccaccgcgctggccaaggctccggggctgggtaagaagggcgcacagaagatcatcctcgagcttaagggctctattgatttgagtcagatcgagggtgcttccgctcaggcggcaacatccaagtctccggtggataccggtacggaacaggttgtcgaaggactgatttcgcttggctggcgtcagcaggacgcccagcaggccgttgccgaggcttgcgccgaaaacgacattcccacgccgcttgccaccgacgatgtgccgcgtgtgctacgtctggctttggcgctgatggataggggccgctgatgagcgagacaacggattacggagcctccaacaccggtgccaacgaagagtcgctgcgcatggtctcctcccagccgatcggcaacgagccggtcagcgacgaggagctgcgcccccatgttctcggaggctttatcggacagccacggctcaaggcccagctgcaactgttcctggacgcggcccgcaaacgcgatgtgccaccggaccatattctgctcgccggccctcctggcttgggcaaaaccacgttggccatgatcgttgccaatgagcttgaagtgccgattcgcgtgacttccggccctgcggttcagcatgccggtgatcttgcttcgattctgagctccctcgacgtcggcgaagtgctgttcatcgacgagatccatcgtctgccgcgcgccgccgaagagctgctgtatatcgcgatggaggacttccgcgtcgatgtgatggtcggcaaaggcccgggcgcaagctccatcccgctgaccctgccgcgattcaccgtcatcggtgctaccacgcgcgaaggtatgctgccaagcccgttgcgcgcacgcttcggcttcaccgcacatctcgacttctatccgcacgaggagctggaaaagctcatcgaacgttcggccaacgtactgggcgtaaaccttgatacgggttccgctcatgagcttgcgttgcgttcgcgcggcacgccgcgtatcgccaaccgattgctacgccgtgtacgcgactgggccatcgtccacgacctgattgtggtgcggccggacgacgtcaaggaggcgctggccctgtaccagatcgactccgaaggcctcgaccggctggacatcgccgtgctcaatgccatcgtgcgcaacttcaacggtggacccgtgggcctgaacaatctggcggccatggtgggcgaggaatcggaaaccgtggaaaccgtgtgcgagccgtatctcgtgcgcgaaggttttatgattcgcacgcccaaaggccgtgtggctaccgagaaggcatggcagcatttggggattacgcccaaagatgatgtcagcaagctcttctagactttctcctgtttgcacactcggcagcgtttcgtcaatgtcgctcgtttgaaggagttgtttcgtggaacagtacattatgctcatcgtgatcgtcgtcgtgttcggcggcatgatgtggtggcagtccaagaaggccaagcagcaacagcaggagaagcaggacttccgtcgcaatctgcagcccggcaccgaggtcatcaccatcggccaggtgatcggcaaggtcgtcgaagtcgacgagcagtatgaggagatcgtcatcgactccgaaggctccaagctgcgtttcggcttcaatgccatcgcccgtgagtacatccgcccggcctatgtgtccgatgatgaggtcgacgagaacggcaacccgctgcccgacgaagacaccgaggctccggctaacgatgaggctggtcaggttccgatcgaggcgtccgtcgtgtccgaggaagacaccgctgacgagaccggtgacgacaacgaaaccaagacgaagtaagctgttcgattcggtagcaccatccgcgtatcgcatcgcaaaggcataaaaggggcgagcactatggcacagtcggacatcaccatcgacgcattgagcaaggtagggcaacaggacgccgaatatctggtgtccttggtgcgttccgtaccggggtttcccaaggaaggcatcatcttccgtgatttcatgccagtgctcgccgaccccaagggcttgaagattctgctcaaagcacttgaagaggccctgccggtgtccccgagcgaattcgactccattgccggtctcgaatcgcgcgggttcctgttcggcccggccatggccgcccatttgggcaagggtttcatcgccgtgcgtaaggccggcaagttgccgcctgaaaccatcggtgaatcctatgacctcgaatacggcacggccagtgtcgaaatcgaaaccgacgccgtacaggcagggaagcgagtgctcatcgtcgatgacctcatcgccacgggcggcaccgccaaagccgccaccgaccttatcgaaaaggccggtggcaccgtggtgggcttcagtttcgtgatgcggctcgatggcctcgacggtctggataagctcgacggcaagcccagcagctcgctgatcgcgatgccggcctgagatttcgtctcacccaacgtacagtcagttttcaaggtccggcatgtactgtgtacagttacatgccggaccaattacatagtcagggaaggatcgatggatctttacgaataccaggcgcgtcagctgctcgaggaacaggacattcccaccccggacgccatctttgcccagaactcccatgaagtcgctgaagcggcggacaaaatcggctatccctgcgtaatcaaggcgcaggtcaagatcggtcatcgtggtcaggccggcggcgtcaagatcgcccataaccgcgacgaggcgattcttgaatccgagtccatcctgccgatgaccatccacgggcacaaggtttccggcgtgcttgtagccgaagccaagaacatcctgcacgaatactacgtgtccatctccgtggaccgcacctcgcgcgacttcgacgtgctggccaccgctaacggcggcaccgaagtcgaggaaatcgccaaggaacatccggaggccgtcaagcgcctgcacatcgatgcgctcggtgacttcgacctggccgctgccaccgaaatggcacagagcatcggcttctaccacgcggacgtcgatcaggccgcacagattctgctcaagatgtggcgctgcttcaaagacaacgacgccacgctcgtggaaatcaatccgctcgccaagatcggcgacccggatgacgaatccaccaagcagctgagcgccttggacgccaagatctccttggatgacaacgcctccttccgccatgacggctgggcgcgtttcgtggatcccatcgttcccgaccccttcgaacagcgcgcccgcgaacacggcctgcactacgtgcacctgcacggcgaggtcggtgtgatcggcaacggtgcaggactcgtcatgagttccctggatgccgtctccggcgctggcgaggaacagggcaccaacatcaagcccgccaacttcctggacatcggcggcggcgcctccgcagccgtcatggccgaaagcctggagatcgtactgtccgaccctcaggtcgaatccgtgttcatcaatgtctatggcggcatcacctcctgcgtggaagtcgccaacggcatcctcgaagcggtcgccaagctcggcggttccaagccgatcgttgtgcgcttcgatggcaacgccgccgccgagggtctgcatatcctcgcctccgccaataacccgaatatccatgtgtccgaaaccatggaaggcgcggcagccaaggccgcgcagctcgccggtgaggcgacccagtccaaggaggttcgctgatgctgttcatcgaagacggcgctcccgttatcgtccagggcatgaccggccatcagggcatgacccatacggctcgcatgctcaaggccggcaccaatatcgtcggcggcgtgaacccgcgcaaggccggcacatccgtcaccttccccggtgccaagaacggtgccgacgcggacatccccgtgttcgccacctgcggcgaagcacgtgaagccaccggcgccaaggccagcgtggtgttcgtgccgccgaagttcgccaagtccgccgtggtcgaagccgtcgaagccggcatcgaactcatcgtggtcatcactgaaggcattccggtggccgattccgcatacttcgtcgaactggcgctcaagaagggcgtgcgcatcatcggaccgaactgccctggtctcatcacgctcggcaaccccggcgtcaatctgggcatcatccccgacggcatcgtcggccgcggcccgctcggactggtctccaaatccggcaccctcacctaccagctcatgggcgaattgtccgatatcggcttcaccgcatgtctcggcgccggcggcgacccgatcgtcggcacgacgctgctggaagccctgcaggcattcgaagccgaccccgacaccaaggctgtcatgatgatcggcgaaatcggcggcttcgccgaacaggacgccgccgcatgggccaaggagcacatgaccaagccggttgtcgcctacatcgccggtttcaccgcccccgaaggcaagcagatgggccacgccggcgccatcgtctccggaggcaagggcaccgcccaggacaagaagaacgcgctcgaggcggcgggcatccccgtgggcaagaccccgggccaggccgccgaaatcatgcgtgacgtactcgccaaggccaacatcgactgatcggttccaaccaatcgtgatgaaagccgtgattcgccaatgggtgcggggagccatagtcgccctcgcatccatggccatctatgccgttgcattaggctgctatacagcgctgatgttattggtcgtctctatggaagagggcggcgacaatctcaccgtcggcacaacctcgctgacacaggccgttgtgcttctgagtgagggatcgggctttagaaccgattcgttcaccctcaccattacgccattgctgttgaccatactgctgatatggctgatcaatgcactcatcatgcgaatcaaagcatacgggccgcatgcgtatgttgccggattgattgtttggctcgggttgaacgaggcattccggcaatccgtgcacctaggtcttgtcgatgaccagtggctggtgttgctgaaagcagccatcgtattctcgatcggtttcctatgcgcagccgtaccggaatcagccaaaatgcgagcattcagggactggactcgcaagcaggtgccggcggacatacgccactgcctgaaaatcggcgtcgccttggccgtcgcgatactgagcatatatctggcaattggattgattaccgtcatcgtatggtcggtacgcaaccatgccgctgtcgtatcgttgttcgaattgtccgggatggaaaccggttcacgaattctcaccaccgtcgccatgctgatctggctacccaacgtcatgctctgggctgtttcctggctcttcggcggcggattcgccatcggtgatttggccagtttcacattatggctcggccaatccaaagagcttcctgcaattccggtattcggtattctgcccgaaccggtcagcagtgaactatggcgtaccgttgccttgaacgcgcctctcgccatcgctgcgctcgtgggcctgctggctgtattcctaccgcaaggattcgcctgcagaccgttgaatgtacggaatacgtccacccgcggcccggtactggtttcgctgatctactccgccggggcattctgcctgagcgcgatgctgatctcactggcatccacattgctgttcgctctgtccaatggatcgcttggcgatcatcgtcttgctcacataggcgtcgacgtcatggcctccaccagagtcgtcggtcattcgaccgcactgggacttaccgcggcatggctgctcgcgctgattggcatagcgctcgtttttccgatagtctggttggttgagagaatcaaggattcccgcaccaccgccacgacctcgaagaccgccaccgttcatcaggcgcggttcctagcgtcacaaccacaagaatccaaggaggaacaggatgacaaacacgaaccgaccgatacgtcgagcactggtctcggtctttcataaggaaggcatcgaagtactcgcggaagcgttcgtgaaggccggcaccgaagttgtttccactggttcgaccgccaagaagcttgccgaactgggcgtcaaggtaaccgaggtgtccgatgtcaccggattccccgaatgcctcgacggccgcgtcaagacgctgcacccgtacattcacgccggcattctggctgatatgaccaaccccgagcacgccaagcagctcgaggagttcggcatcaagccgttcgacctggtggtcgtcaacctgtacccgttcgccgacaccgtgcgctccggcgccaacgaggccgataccatcgagaagatcgacatcggcggtccctccatggtgcgcggcgcggccaagaaccacgccaccgtggccatcgtcaccgacccggccgattatgcactggtcgcctcccgcgtggccgacggcaccggcttctccttggacgagcgcaagtggcttgccgccaaggccttcgcgcacaccgccgcctatgacgccaccatcaacgagtggaccgccaagcactggcccaagccggcctctctggacgccgtcgaggtggacaaggacgatcagggcactgaagtcgattccgccaagttcccggcccagttcacccgcacctgggatcgtgcgcacaccctgcgctacggcgagaactcccaccagcaggccgccctctacatcgacccgctcaaccagaccggtttcgcccacgccgagcagctcggcggcaagccgatgagctacaacaactacgtggacgcggacgccgcctggcgcaccgtatgggatatggctcccgccattgccgtggccgtagtcaagcacaacaatccgtgcggtctggccatcggcgcgaccgcggccgaggcccacaagaaggctcacgcctgcgacccgatgagcgcctacggcggtgtgatcgcctgcaactccaaggtcacccttgagatggccgaaagcgtgcgcccgattttcaccgaagtcatcgtcgcccccgactatgagccggccgcgctcgaactgctgcagaccaagaagaagaacctgcgcatcctcgaggtggccgagccgccgaagggccacgaggccatccgccagatcgatggcggcctgcttgtgcaggacactgatctgatcaacgccgtcggcgacgatccggacgcctggaagctcgtggccggcgaggccgccgacgctgacacgctgaaggacctcgtgttcgcatggcgtgcaatccgctgcgtgaagtccaacgccatcctgctggcccacgaccaggccacggttggcatcggcatgggccaagtcaaccgcgtggactcctgccatttggccgtcgagcgcgccaacacgctggccgatggtgccgatcgcgccaccggtgcggtcgcggcatccgatgcgttcttcccgttcgccgatggtgcccaggtgcttatcgacgcgggcgtcaaggccatcgtgcagcctggcggctccatccgcgatgaggaggtcatcgaagcggccaagaaggccggcgtgaccatgtacctcaccggcacccgccacttcttccactgatcgggactctctgaggggagcagctcagccaaaacgcacaaaggtgggattccgcctgacccgtcaacgggtccaagcggaatcccacctttgctattcgcctgctattgtggtcacgtaaccgttcgacagaaggaatcgcaacatgcacaaccatccctatgtatccgaagcacatgagggcaagccatggtttgaatggtgcgtactcggcgtcgtcgccgtcatcacactgctggttgctttcggatatacgatggccgccacggtcatacttgccgtgacggccatcatcaccgggcttgttcgcctgattcttcaggacagaagcccatggaaagtgcgctcagtggcgttcgactccttcatcggcatcgccttgggaatcggcctgctgattacctacttcagcttctttggactcttcggcaacatctttttccgctgaatcgccatcagacgaggcggcctgatcgaagaattcgccatcgtcgagcgtgtccgcgtttgcatcggcatccgtctgcggaagatcggcggcagccggcactttgggagtggtcatcatctgcgcgatgatcatgaccaacgccaccacagcggcggccaagaccgggctaatccagaatacccacagctgctgcagcggattttgcgtaagaccctcattcatcgcggccagtgcgatgccggtggaacgggcgggattgagaccggcaccggtaaccgggtagctgatggcggtggccagaccataggcaagacccatggcaatgacatgacggtccgaggactcgccgtgatcacccagagaagacatggcggtggcaacgacaatcagagaggcaacgacctcgacgacaatcgccagcgtaatcgagaacgtaatgccatactgggtcagcagcgagtaagacacggagccgttttcgaaaccgttaacggccggagtcagccacactttggcagctacctgctcggatgtgggcagcagcttgaccacggcgaagccggcggcgatggcaccgatgacctgagcgatcacatagaggatgccatccaggattttcgtcttggaaaccagcacggaggctacggtgatggccggattcagctggccaccggacacgcgggagaagatggcggtgactgcggcatatgccaagccggtagccaacgcgaagaacacgatattgatgccatacacggccgaaccccatgtggagaaggcgtaaatggcaaagcacagcaggaagctgccggccaattcggcgcacacgcgcagagccagcggctgttgcttggtttcttccatgattgttcattccttttcatctgttggaagacgggcgaacccgcacaaacggttgccagtctagcagcagtcctacgttgcggtatgatatataggttggaattgactgggattccagtccgccaactctgaagtatgtatacaaatcgacagtctctgcgatgacagaatctgtccggccacgttgggagaacgatgccaaacgcatattcccgcgctgcgaaagcgcaagacgattccaattccattcgactccagaagctgcttgcccaagcgggattcggttcccgccgcaagtgcgaggacatgatcaccgaaggccgtgtcgaggtcgacggtgaactggtcaccgagctcggaactcgcgttgaccctcataagcagcaggtgcgcgtagacggttcgcgcgtacgcgtcaatccgaaccacgtcactctggcgctgaacaagccccgcaaggtgctctccgccatggacgacccgaagggccgctacacgctgcgcgacatcgtgggcgacaagtacgagcgcatcttccacatgggccgtctcgactacgattccgagggtcttatcctcatgacgaacgacggcgagctctcgcagcacgtcatgcaccccaagtacgaggtcgagaagacctacgtcgccacactggaaggcaagatctccggcaccgtgtgccgtcgactcgtgaccaccggcgtgcagctcgacgacggctggatcaagctcgaccactgcgcgatcatcgactcctcgcgtgaccacacgatggtcaaggtcgtgctgcactccggcaagaaccgcatcgtgcgccgtatcttcggctcaatcggcttcccggtcaagcgcttggtgcgcacccagatcggcccgatcaagctcggtgatttgaagcccggttcctaccgcgtgctgtcccagacggaagtccgttcgctgtccaaggaggttggtctgtgattcgcgttgccatcgacggccccgccggcgtgggcaagtcgtccacgtccaaggcgctggccaagtatttcggatacgcctaccttgacacgggcgcgatgtatcgtgcctgcgcttggtggtgtctgaagcaggacatcgatctggacgccgaaaccgtggatgagcgtgtcatcaccgaagcggtgggcgagttcttcaccggcgaccatttcgatatctccgtggacccggacaacccccgcgtattcgccgacgacgaggacatctccgaggccattcgttcctccgaagtctccagccatgtctccaaggtgtcgaacgtcatcccggtgcgcaacgtgctcatcgccgcccagcgcgcctacatcgcccgcgaagcgtcggccgactccttctccgggggtttgggcatcgtggccgagggccgcgatatcaccaccgtggtgtccccggacgccgaggtgcgcgtgctgctgaccgcccgtgaggaggtccgtcaggcccgtcgcaccggccaagccgtcaagggcgtgggtgctgaggatgtggctgcgcgcgacaaggccgattccaaggtcaccagcttcctgaccgccgccgatggcgttactaccatcgacaattccgatttggacttcgcccacacgctcgatctgctcatcggtctggtcgaggacgccatcgagaaccaggagtacgagcagtatgccgccaatctcgaaggctatgagctggacgaaggcgatgaggatctgatttccggccgcggtttcacggaaggcgcgcgcaaggccggccccaagccggtgggtgtgctgactgttgtaggccgtccgaacgtgggcaaatcatccctggtcaaccgtatcctcggccgccgtgccgccgttgtggaagacacgccgggcgttacgcgagaccgtgtgagctatgacgcggaatgggccggcaccgacttcaagctggtggacacgggcggctgggaagccgacgtggaaggcattgaatccgccatcgcctcacaggcacaggttgccgtgaccttggccgatgctgtgatattcgttgtcgatggtcaagtgggcatgaccaccaccgatgagcgcatcgtcaagatgctgcgtgccgccggcaagccggtcgtgctggccgtcaacaagatcgacgaccaggccagcgaataccttgccgccgaattttggaagctcggtctcggcgaaccatactcgatttccgccatgcacggcaggggagtgggcgacctgctggacgtcgcgctcgacaagctcaagcaggccgagaagacttccggctacctcacgccttccggcctgcgccgcgtggctctggtgggccgcccgaacgtaggcaagtcgtctctgctcaatcagctggcgcgcgaagaacgtgccgtggtcaacgatttggccggcactacgcgcgaccccgtcgacgaaatcgtcaacatcgatggcgaggactggctgttcatcgacacggccggcatcaagcgacgccagcacaagctcacaggcgcggaatattattcctctctgcgcacgcaggccgccatcgagcgctgtgaattggcgctgatcctgtttgatgcttcgcagccggtatccgatcaggatttgaaggtcatgtccacagccgtggatgcgggccgtgcgatcgtgctcgtgttcaataagtgggatgcgatggacgagttcgacaagcagcgtctcgaacgcctgtggaacaccgaattcgaccgtgtgatgtgggccgagcgtgtgaatctgtccgccaagaccggctggcacaccaaccgtctgacgcgagccatggataaggccttggaatcctgggatcagcgtattcctacaggcaagctcaacgccttcctcggcaaaattcaggccgcccacccgcacccgttgcgtggtggcaagcagccgcgaatcctcttcgccacgcaggcatccacgcgcccgccgcgtttcgtgatcttcgccaccggcttcctcgagcacggctaccgccgctacatcgagcgttccctgcgcgaggaattcggcttcgaaggcacgccgattcagatctccgtgaacatccgcgagaagaagaagcggaagtgacacgcgcgtaatttgccagatttcaaatatctggtaaattatctactcggtgcttttgcaccatcgggccgtagcgcagtttggtagcgcacttgactgggggtcaaggggtcgcgggttcaaatcccgccggcccgaccgattagccccggaattctgccacttttgagtggttgtcttccggggtttttccgttttcagacaatatgagacaacatgacgacggacttacctttgtaagccattcgtaatgaattatcaccgacaattcaccgcctccgcacccccgtcgtatgcgtttgccccaaacaggggctagactggttcctattgatttgacgaaagggacccgaattgacagaaataaacgataaggcccaactggatatcgccgccgctgacgacaccgacgccgttacctcggacacccccgaagaaaccgtaaacacccccgaagtggatgagactttcgagctttcggccgccaagatgcgcgagcatggcatgagcgaaaccgccatcaaccagttccaccatttgtatgacgtatggcgccatgaagaagcctccagctggattcgcgaggacgacatcgagccgcttggccacgtgcccagcttccacgacgtctatgagaccatcaaccacgacaaggccgtggacgccttcgccaagaccgcattcctcaagctcaatggcggtctgggcacctccatgggattagacaaggccaagtcgctgttgccggtgcgtaggcacaaggccaagcagatgcgcttcatcgacatcatcatcggtcaggtgcttaccgctcgcacacgcctgaacgtcgaactgccgctgacgttcatgaactccttccacacttcggcggacacgatgaaggtgctcaagcatcatcgcaagttcagtcagcatgacgtgccgatggaaatcatccagcatcaggaacccaagctcgtggccgccaccggcgaacctgtgagctaccctgcgaacccggagctggaatggtgcccgcccggccacggcgacctgttctccaccatctgggagtctggtctgcttgacgtattggaggagcgcggcttcaagtatctgttcatctccaattccgacaatctcggtgcgcgcccctcgcgtacgttggcccagcacttcgaaaacacaggtgccccgtttatggctgaagtggccatccgcaccaaggccgatcgcaagggcggccatattgtacgagacaaggccactggtcgcctaatactgcgtgaaatgagccaggtccatccggacgataaggaagcggcccaagacatcaccaagcatccttacttcaacaccaactcaatctgggttcgcatcgacgctttgaaagacaagctcgccgaatgcgatggtgtgttgccgttgccggtgattcgtaacaaaaagaccgtgaatcccacggacccggattccgaacaggtgattcagctggaaaccgccatgggcgccgcaatcggtctgttcaacggttctatctgcgtccaagtggatcgtatgcgcttccttccggtgaaaaccaccaatgatttgttcattatgcgttccgatcgattccacctgacggacacgtatgagatggaagacggcaattacatcttcccgaacgtcgaacttgatccgcgatactacaagaacatccacgatttcgacgaacggttcccctacgccgtgccatctttggccgcagccaactcggtttccattcagggcgactggacattcggacgtgacgtcatgatgttcgccgacgccaaactggaagataaaggcgagccaagctatgtgccgaacggcgaatacgttggtccgcaaggcatcgaaccggacgattgggtgtgatttacaacacggtcgaacgataaaaaagatattatttttgtgaaatggcgctcaagtgcggaaaaagcctctaagatagagtgagtgtggggaaactcatacgcacttataacgaaacagtaactatacgtgaggactaatggcagagggcacaagcggacgtcggcgtttttccgacaaatggggcaagcacgagctggacgtactggctgtgttgtcatccgcgttcccgcaatggctcacatcccgccaaattgcgcagcgcgtcaaggcttacgccgactcgtatggagagctggcagatcaggccgccaaggccgcgttcgccaagcagttccagcgtgatcgcgccaagctcgccgctatgggcatcgccatcgaatcacggcagcctgagtattcgtccaagtcggaaggccaggacttcgcgtcctaccgtctgcagttgggcgacgaaccgcgcgtccgtctgatgttcgagccggaagatatgccggtgcttgccgccgccaactatctggctcgttcgatgtcgatttcctccgagccggatcagtcccagctcgcccaacatgcgtcgcgcaccacgccgcgtgtgccgcagacccctattcccggtctcggtttggattcgattgcgcctggcttgggcacgcagcccattccggactcgctggtcaaggttatcgattcgcgtcgctttgccgccaccgttgatgtggacggcgaacacctgaacgtggcctacaccgattccgacgatttggccatgtttgtgctggagcatccgggtgccacgattgtcagcccgcaggaggctgtggacgcctatcatcgccgcctgcacgccgccagccgattcactctggctgacgaatccgccagccctgtaagcgcctcggtggtttccccgtcgattagtcgcgatgttcgtgagccgggtgatcccgagtcgatcaaggcccagaacaagaagaacggccccgctttccaaacgggcagcgaggtggatcgtcgcctgcgtctgatgctgttcctctccgctcacctgggtgaggaattctcgatgagcgagctggccgagcgctttatcggcaaaccgaagaacgacgacgagctcaagaaattcgtcaacatcattcataaggacatcaacaccctgaccaccgtttccgacgatggtgagatggctggcagccagttcttcgatatcgactggccgctgctggatgccgagggtattgtttccgccaccaattcgttgggccttgaacgtcttgccggcatttcgccgcaatacctcagcatgctcaccgcctcggtcagctacttggcgcattcgccgttactgccggacaagcagcgtgggcaggccgaatccctgtatgagcgtttgcgccgccatgtcagcccgggccagaccccgtggctgagcctgaccggctatgagctggagccccgaagcttctccatcgtcaagcgcgcgatcaacaccgattcgctgttggacatggagtactccgacggtaccggtagtacccgtcgcaagctggtggcccccgccaagattttcatcgacgaaggcgtgtattatgccgccgtctacacggatgtcggttccgccgcccctaaggacaagaaggcctacgtctccaaagacaagaccatcgacaaggcgaacggcaagccgcgcatctggcaggtgctgcgcttggcccgtatcgaaaaggcggaactggtcaagcccaccaagcagatcaacatcccgaacatgccggtgagcgaactgcgcaagtggagtttcgacaacggtaccgacgcggtgttcatcaccgatcagcgcgatctggcattcatcaagacattgccgggcgctaccgtcgaacaatgcggtgccggtgaaaaggtgcatctgaccgtttcctccgactcctggttcgtggccttctgcatcgcacacgcgcgtcatatcacggcggtcgccccggaaacgttgcgcaccatgatcgtggcacgcgccgaacgcgaactgagcatcagcgagaacaagtaaggagcctttcatgccttggtggatatggctgattctggccctgttcatgctggccatgattgttgccggactcatctatgcagcccttcatggaatccgtgccctgaaagacatgtccgacatcggcggccagctcggtgaacgcgtggccgcgatgggggagtctggcacctctgccgacaccagcgagccgcctctgttcactcagccgctcagcgtggcacagaatcgttatgccgaggcccatgcggacgtgattcgcagcaaggccgccaagcgcgaacgccacacccaggcatgggcccgctggaagcgattcaacaactaacggaaagcagcaatggcacgtcaccaacaccataagggcaatgccgattcccagacgctgagcccttcgcagcggtacgcatcattccaaaaagtccagcgccatcgggcgtccgcagcagcgcgattcgccgaatccctgcccttcgaactggacgacttccagaccgaagccaatgacgcgctcgaagccggcagcaacgtactggtcgcggccccaaccggtgccggcaaaaccgtagtggcggattttgccatttatctcgcccaggaacgcaacgtcaaagccttctataccacaccgatcaaagcgctgagcaatcagaaataccatgatctggtcgacgtgtacggcccggacaaggtaggcctgctcaccggcgacacctcgatcaactccgaggcggacatcgtggtcatgaccaccgaagtgctgcgcaacatgctctacgagcgttccaccacgctgaacgcactgcgctacgtgattctcgacgaagtgcactatctggccgaccggttccgcgggcccgtgtgggaggaagtcatcatccacctgcccaagacggtcaagatcgtcggcctgtccgctaccgtgtccaacgtggaggatttctccaactggattgcctcggtgcgaggcgacaccaaactggtgatcagcgaacaccgccccgtgcctttggaacagcacgtcatcgtgcaggcggacgaacacaccgagcctgaggtgctggatctctatcgccgcgacggcaacggcgagcagaccaccaagctcaacgccgaactcatcaaccggctcgaccagttggaccgcaaggccgcacgccggcgcggcgaggaacgccccgataagcgcaagggcttcggcagaggccgcggcggcaaaggcgccaagggccatgccccgaaagcggaacgccacaccccgcgccgctgggccgtggtggacgagcttaactttctgggaatgttgcccggcatctacttcatcttctcgcgcaacggttgtgaccaggccgtggaacagtgtatcaacgctggactggagctcaccaccgatgaggaagtgaccaagattcgccgcatcgtggatgagatggtggaggggcaactcactcaggaagacctgaaagccctgcagttctccaagttccgctttgcgttggaagaaggcttcgcttcgcatcatgccggcatgattgccctgttccgccagatagtcgaacgattgttcgaagaaggtctggtcaaaatggtgttcgccacggaaacactggccttgggcatcaatatgccggcccgctgcgtggtggtagagaaactcgagaagttcgacggtaccggtcatgtgggcctgacgcccggcgaattcacgcagctcaccggtcgtgccggtcggcgcggcatcgacaccatcggccacgccatcgtggttgaccatcacggttttgtgcccgccacggccgccgcgctgtcatccaagcgtgtctacccgctgcactcgagcttccgacccacgttcaacatggccgtgaacctgctcaactccagcgactacgagaccgcgcacgttaccctggaccagtcgtttgcccagtgggaggccaacgaatcggcctggcagctggaatcgcagatcaacacactgaagaacgcgctggccggatacgaacaggcgttcgcatgcgaacacggcgacttcaaacagttcatgaccctgcgtatggagctgagcgacatcgaaaaggaaggccgccgcaaactgaagcacgaagtgttcctgaccgatcaggagcgttcacgcgccttccagaaccttgaccagcgcattcgcgatttgcgcaaggcggagcacgagcatccatgccgcaactgcccggacctccagcaacacctcaagtggggccaccgctgggcccgcgagacccgcgaactgcagcgcgtcaccgatcgctacgactcccgtaccgggtccgtggcccgtcagttcgatcgcatctgcgatattctcaccgggcttggttacctcgaacgtcatgtcaatgcggccggccacattgacatgacgttgactgaaaaaggtctgctgctgcgccgcatctacagtgaacatgacctggaactgtgcgaggcgctgctcgccggcacgttcgacaagctcgacgccaacggactggccgctgtgctctcttcactggtatacgaggccagacgcgggggagacggcgaaccgaggcactacccgggcggcatctccgggcccatcgccatcgcttcgtccaagctcaagggcatttgtgaagacatcgatatcctgtgcgaggatcacggtctggacgagatgcagcggccggacttcggcattctcgacatcatgtatgaatgggcggatggcggttcgctgggatcgtgcctgtacggcaccgacatgaccggcggcgacttcgtgcgcactgccaaacgactggctgacgtgctgcagcagattgctgtcgcccagccgctgccgttcgacgggggagagcggctggcaggcctcgcccacgaagcggccgaccgggtcaatcgtggcgtggtggcctactccggcgtggactgacggggctgtttgacgggagtttgtcagccgacgtcggaagcttggaatagcggccaagtccgaactgttgcgtaaattagtagggttaaagatctttcaaggaggatgccgatatggcagaacgtagcctcaggggcatgagcatcggagcgaaatcgctggagtccgacgacaacgtcgatttcgccgcgcgaaacgatgtggcgtatgtatgcccgaagggccaccgcaccatcctgccgtttgccgagggtgccgaaatcccggacgagtgggagtgccgttgtggttccgtggcccaccgtgagggcgacgccgaccgtgagggcgacgaaatcagcaaacccacccgcacccactgggacatgctgctggaacgccgtagcgaagaggaactggccaccctgctcgaaaagcgcctgcaaatgcaccgtgacggttggattcccgactacgagtgatctcctactgaacaacacgtgaacttgatgcccagtcatcccgactgggcataatcattgttggaacaagtcgcattgtttgacgaccattcaaagcagtcgacatgaacaagggggagtggaatctcaatggcacagcatccgatgaaagtggtcctgttggatctcgacggcacgcttaccaagtccgacggcggcattatcggctccgtcatcaagaccttcgaagagatcggtcgaccggttccggacgccgccgaactgcgacgcttcatcggaccggcgattattgaatctctgcgtcgcaatcatgtgcctgcggaagatctggatcgggccgtggacatctaccgcagctactacggagaccgtgccgtgttcgacgatccgaacgagcccggcaacaaggtgcccggacgactggtgaacgtcgtattcccaggcatccgtgaacagctgctcaaactgcatgccgacggttactacctggcactggccagctgcaagcccgaataccagtgcatgcctatctgcgaccatttccacctgaccgaactgttggacggcatctatggtgcttccaaagacaattcccgtctggacaaagatcaggtgattcggtactgcttcgacaaaatcggttttgatgctgcagcgggggacagggccgtgatgatcggcgaccgctacaccgacattgacggcgcccacgcctgcaatttggacgccatcggctgccgctggggctacgctccggccggtgagatggaggaacacggcgcgtacgagatcctcgagaagcccgagcagatcgaagaagccgtaaaccgttatttccaaacgcactgaaacacaacggcgaggacttcttcatgatgggatgcgatggagcctgcgccgcgggcttcgacctggttttcatcggtttgccattgctgtcgctgtatgagattcccatgctgatatggttcatttggcgagcattccactggaaacgagatgacaaggattggctgaaaggcacggcgattcttgcaattgcggtggtcgctccggtgctcctttggctgttggcctggtatgctccggtgctcctttggctgtcggccttggtatgcgtggactagttgatgcaggcgaccgaatccttgtcaaggataactaatctgacataacgtacattatcggctaatagtatgtggtgattttagccgaaccagtagtatctagctgcggattagcctcgccgcagagaatcggctacttcgcaacatcatccttattccggtgagaagcaacgcccaaacgcttgtccatttcgttttccgaagcgttgcgtgcctgcagatacatggcgatgagttccagcagcaccagcgcgaatatgatgattgctccgggcaattgcgcgtggtcgtagaacgcgagcatgcgagcatccatcagatccgctgtaaacgtcaacacgggaaacgggatcagcgccgccgcaaacgacatgaaatgcgttttcaccatcgaccagtcgaccggatcgaccggcggtcgccggcgtttcggcgtgaacagatgacctcggctgaccgttatagtgatgatggacacagcaaagatgacggcgaccatccacagaacgcccggcaacaatccgacaacaatcccgttcacccggtcctccaatcagtcataataatcaccgcaacatataaaaacataagatggcaggcaacaaaagcaacacatacaacaaagcgacctgccgaccaaagccggcaagtcgccaacaaccatacatgtatcaggcggttgcgcgttgcaagcgctgtgcctcgagcttcttgcgcatcctcatggcagtcagttcatcaatcggacggcccgtggcaatcgtcagcggcttggcctcaagatcaacatattcttcctgttccaaggccgtctcaatctggtgccacaacgaacccaccgacacggcgaacactgccttaccgctttgcaacagttcgagcatctgttcgctggttgtgcattcatgtacgttttgaccatcgcacatgatggtcacattggccagctgatcggtgctgcgttgagtcaagaatccgatggccgccgttacgttctgcagattcacaccggcatcaagcaacttcttggatacagcgagaatcaccacatccttaaacgagtatagtcgtcgtgaaccggagccatgagacggcgtgatggacggctcaacaatctgcttgcgtgcccaataatcgagctgtcggtacgtgatgccggccaccttggaggccacagtgccacggtagccgcgcttgatctcctcagtatcgacgttggagaacaactccccctgaatcgcgtcagcgttcagattctgacggtcctcaagcgaaacatgaagatgcagcccggtctgtcccatggcactcccctaactcatgcgtgtctcgcatatgactcacactggtgtaatcacatgattgcaatttctgcaatcagtctaaccccgtgctgggtgtggactattgggaaataatggcagatttcgtgaagaacacgaggcggaatttaccgatcatgatttcgtcgccgttcttcagcgtcgcctgatcaacacgctgacggttcacgtaggtgccgttcagacttcctgcgtcaaccacaaagaactgaccgttgaccctgcggaacacggcatgctgacgggatacggtggagtcgtcgagcagaatatcagctcgcggatcacggccgacggtgatttcatcctcgtcaagcaagtaacgagaacctgagaccgctcccctggcggaaatcagcaatgccgttccctcggacaatctggtgatggtgtccagatcctcttgagtcagcggtcgatcgccggtggtggtaatgggcagtacattaatcgcgggcaggccgataatggtggtttcgcctgcgctaggaatcgggttggtcataatcccctattctaccgtctttgcatactggttttgcgtagcttcgcgtacttcgtcgataatgatgctgtcagaaggctgtacattgacgttggacccgtatttcacctggagctgagcgcccacaccgccggcgatatcgactgcgttggacagttcctgcggattgccaatggccttcaccgtgtatgtgggcttgatggtggtgccatccacgatcaaaccttcctcggcgtcctgaatgtaggtggaggtgatgacgcgcacgttattgatggcgattacctcggcaccggcattgcgaagttcctcgataaggttgaacatgattgaggcgtccactttagtcgtcaagcctcgtccgattcggatggtcacgccttgaccctttgccgggagtctgccggagatcaagccgctggtctcctcgttttgcttggcgatcttacgcgcctgctcctgctcgttagccgccgatttcagcgagttgagctggctgttcaactgggttttacgctgctcgagattggagatttgcgtattcgactcgttcagcagccttaccagttcactctcgtccatcgtttcgtacgtggatttagtgttattgatctggctcatgtaggcgaaacccaacaacgcgcacatcagagcgatgagaatcgaggatagtaaccgtgatttgttgctggcacggttgagatccttccggggcttcttacgcaccgtgggaaacgacccggtttccatccggtcgttgaccttgtcttgtgcatgctggtcgcgcattttctccagcatgttgtctgattgtgctttacgtgccatacgtcagtacccttgtcagcctcggaagatgaagcgtctgatcgcggacacgttggagaagatgcggatgccgagtacgacgatgacggctgtctgcagctgcgaaccgacgccgagctggttgccgaggaacacgagcagtgttgccgtcaccacgttggcgaggaaggagatcacaaacacgcggtcggagaagctgcgctcgaaataggctcgcgcggcacccagcagggcgtcaagagcagcgaccaccataatcggcagataaggctgcacgatgatcggaatgtccggcttgacgaacacgccgatgacgacgccgatgattagtcccagaacggctgccattattcattcctttccgcgtacttcacttcgccagtgactgctgcctcaagtgtaatcgaattggatttgctcacctgcgggtagataccggcttccttgaaggaatcgtaaagacttgcaagtttcttcttccccatcgcttcggccaaggcgctcttatcgcctatggcttcaatggtataggggctttgtatcgcggtcatgccgatgagaatatgcccgccggccttgcgtatcgaggtttgcgcgccgagcctattaccgttgatggcaatggcttcggctccgttttggaacatcagggagaccagttgctgcagatccagatcggtgatgactcggatgttcgtggaggtgccgactctcgtcgaggaggattgatccgactggcttgccgcgattggatcggccagcgtcatggtgattccttcgccttcgaccaccgtggcaccattgaccatttcgtcttggataagcgtatcgcttttcacgctgccggatattttcttggactgttcgtcaacttgggagcgcaaattattgacgtccgtggtgagttcgtctatttgcgagttgcgattctccaattgcgtggccaaagtctgccgtacctgcttacgcggatcggattgcaactgttgcacgaataggctgcaggcaaagccaacgccgacgcagatgatgaatacgacgatgcgattaaaccagatggagaaggtcgaacgatgctcatggaccagtcgtgagtcggagaacatcggatccatcggacgattgacaagatcatcgatgagctgaagcgaatcgtcgttggttttacggcgacgtctggtgcggatggcggcggcgtcatccggggaaagcgcatgatgtgattccgcgcctcggactgagtgggagaacacggcgcggcgtcgtaccggctcattctccttgggtacggggaatgagaccggggccgtggcctcaagcgccatacttctcccccagttccttgcgtagcaatccgacgccctgcttggtatagatatatccggcgagccaatacatggcgatgccccagatgccggcggccagcgcggcgatgtagagcaagtggaaaaacgtactggtgcccaaatcggcgaaaatcagaccgacgatggaaatcatcagcagcgcggtaccggccttgcccacgaaatgcacgggcagcggaccataaccgtactgggcaagccatagcacctgaatcgccatccacagatccctcagtcccacgataatcagcatccaccatgggatgatgccggcgacgctgagagccagaatcgagcagaaaatgagcagtcggtcggcgatcggatcaagaatctgaccgatcttgctcacttggttgaatctgcgcgcgatgatgccgtcaagtccgtctgaagccgaggaaatggcgatcagggctagcgccgcaatcatctcgtgcttggagatcagcacgctgatgaaaggaatcgagatgattcgcagcgcgctgatcaaattgggcacagtgaaatagatgtcacgtgcttccggactgtatctggcgttgactttctggttggtcatatcgactaacagtctacatgcgggaggcttgcagagcggtaacgatgatgccgcgtgcgccgacttcgtacaaatcatccatcagctggttgaccttggccttgggaaccatgactcgcacggcgttccactgtttgtcgtgcagcggggagatcgtcgggctttcaaagccaggggtcacggccacggcggcggcgaccttgctgatcggaatgtcatagtccatcagcacatactgatgcgcagtgagcacgccttgcagacggcgggtcagcacggccagacgtgggtcctgctcgttcagacgcggcgaacgaatcaggcaggcttcggagtgcatgagcggttcggcaaacacgcgcaggccggcgttgcgcagggtggtaccggtggagaccacgtcggcgatgagatcggccacgcccagctgcacggaggattcgaccgcaccgtccagatggatggtctcggcctggatgccgtgctcgaccagatagtcgtgtacgagcttatcgaatgtggtggccacgcgcttgccctgaacatcctccagggtggtgatcggggattcgttcggtgcggcgaaacggaaggtcgaggcaccaaagccgagcggcatgtgctcgagcgcggcggtaccggagttcttgagtagatcctggccggtgatgccgacgtcgatggcgccgcggcccacgtatacggcgatatcgagcggacgcaggtagaacaactcgatgccattgtcgggatcttgcacgaccagctggcgagggttggtgcgcagacggtagccggcctcggccagcatgttccacgcgggttcggatagcatgcccttgttgggcactgcgattctcagcatttgcgttcctctcacaggtgcttgtagacgtcttcgagcgtcaggccgtgcttgatcatcatgacctggacgtggtagagcagctggctcatctcctcggcggtgcggtccgcaccctcgtattcggcggccatccaggtctcgccggcctcttcgatgatcttcttgccgatgaagtgggtgcccttgtcgagctcgtcgacggtcagggagccttcggggcgggtctgggccttttcggacagttcggcgaacagggattcaaacgtcttcatgtgattcagattcttttcttgcggttatggatgaaaggtggattgcggttcaggcttggagctcaggccttgaacgcggcctcggccttggtgcggatgtcgtcgatggcttgggcgggattctcggcgccgtacacggcggaaccggcaacgagcacgtcggcgccggcttcggccacgatgtgcgcggtcttggggctcacgccgccatcgacctggatgcgggtcttcaagccacggcgggtgatctcatcgcgcaggcggcggaccttggccatctggttgtcgaggaacttctggccgccgaagccgggctcaacggtcatgatgaggaccatgtcgaactcgtcgaggatatcgaagatcggctcgaccggttcggccggacgcacggcgaagcaggccttgcagcccatctcgcgcagctgtcgggccagacgcacgggggcgtgggtggcacccatgtggaaggagatggaggcggcgccgagcttggcgtattcgggagcccaacagtccgggtcctcgatcatgaggtgcacgtcgaccggcagatcggtgacctgacagatgcggccgacgatcggctcgcccagggtcaggttcggcacgaaatgatggtccatgacatcgacgtggaccaggtcggcgttggcgatggccttgagatcacgttcgaggttgcagaagtcagcggacaggatgctgggtgcgattgcgatattgctcatggtttcctaccttatctgtgcaatgggacttggggtcccgtgtttcgcgctgtttcggcgctgtttattgtggtgtcacttagtgcgattggtttgctttttctggcgaagctgttcctcttcgatgctctggcgttcgagctcgtcggcggtgaccgccgcaagcccgcgcgcctgcgccttggggtccggaccgtactggtagagcacgacgaacaggatgcagccgagcacgaagacgatgatcgcggtccacacgttggtcctcaggcccaggatcaccgtggagtagttgatgcgcacgttctcgatccaggtgcggcccaggccgtaccacatcaggtacatggcgaactgctggccggccttgagccggtcggcgagcttgtggccgaggtagatgatgagcgcggcgccgatgaggttccagatcatctcgtagaggaacgtcgggtggaacagcgtggttctgtagtccgggcattgcgcgccggaatagcagatttcggatttgccgatggcgtccgcgtcgttgagcttcaggccccacggcaacgtggtgggccagccgtagagttcctggttgaaccagttgccgagtcggccgatggcctgggccacgggcagcgcgggggcgatggcatcggcgaagatcgcgaacggatagtgcttgtggcggcaccacaggaacgccaccaaggtgccgacggagatgccgccgaagatggccatgccgccttcccacaccttgaggatgttgaccaagttgccggtgggcgggaagtagtcggccggcgtggtgatgcagtggtagaggcgcgcgcccaccagcgcgcagggcacggtgacgagcgtggtgtcgagaatctggtcgaaggtgccgccgtaccgcttccaacgtgtggtgaggatccatacggccacgcagatgccgatcaagatgcagatcgcgtacatgtggatagtgaacgggccgatctcgaacttggagaaggtcggcgagggaatataagccagattcatcgtgcctctacttgctggtgctcatggtgtgtccacgcgcgggttgtgcttgatgctctgtgactaccctaccgtgtcacggcacaacccgcgtgaggcgcaccgggcgttcaccgggcgttgtggatgccttcggccagttcctcgctcttggcggcgagcagcttcaagccttccttcgggtcgcgtgcggtcttgttgtcatccgcgagcagggtgtgcacgagcgcggagccgacgatgacgccgtccgcgtaggagccgaccttggcgccctgttcggcggtggacacgccgatgcccacgcacacgttctcggcaccggcctgacgggtgcgctccacgagcagttcgggcgaggcgtcgatggtggcgcgttcgccggtgacgcccatgcgggcggccgcatacacgaagccgcgcgcgttgcgggccacggtttcgaggcgctcggtggacgagtccggggagaccaggaagatgcggtcgagtccgtgacggtcggaggcttcgatccactcccccgcctcgtccgggataaggtccggggtgatgagaccggcgccgccggcgttctcgaagtcgcgggcgaagcgctcgacgccgtagtggtacacgaggttccagtagctcatgatgagcggcacgccgccggcgttggccacggtttcgacggcctcgaacacgcgcttgatggtctcgccgttgttcagggcgatggaggcggcagcctggatgaccgggccgtccatgaccgggtcggagtacggcaggccgatttccacggcgtcgacgccgtactcgaccatcgtcttgaaggcgtcaagcgagacgtccgggttagggaagccgtagggcaggtagccgatgaaggcgggcttgttctcggccttgaacttggtgaacatagcacccgaattgctgggcttgtggctgatgcccagcggctggccggacggcgtggttgcttcgttggtcataatcaaaaatctcctcttctggttcaggcgacagtattgccgtgggcgccggtcacatcgagcgcggcggcctggtcgtcggtcaggtagccgaaccacttgccggcggtggccatgtccttgtcgcctcggccggagatgttcacgatcatcacggccttgtcatagcccttggccttcagatcggcggcggctttgtacgcgccggccacggcgtgcgagctttcgatggcggggatgatgccctcggtctggctcaggtcacggaaggcgttcatggcctcctcgtcggtggcccagctgtagttcacgcggccgatgtccttgagccatgcgtgctcggggcccacggaagcgtagtcgaggcctgcggagatcgagtaggtgtcgagcgtctggccttcgtcggtttccagcaggtagctcttggcaccctggaacatgccgagctggccggtgccgggggcgaagcggatggcgtgcttgccggattcggggccgttgccgccggcttcgtagccgtagaggttcacgcgctcgtcgtccaggaaggcgttcatcacgccgatggcgttggagccgccgcccacgcaggcgcagatcgcgtccggatggtcgatgccgtaccagtcctggagctgctgcttggcctcctcgccgatgatcttctggaagtcgcgcaccatggccgggaacgggtgcgggcccgcgacggtgccgagcaagtagtgcgtgtccttgacgttggtgacccagtcgcgcagggcttcgttgatggcgtccttcaggatcttgtcgccaagggtcacctcgaccacttcggcgccgagcatacgcatgcgggccacgttgagggcctgacggcgggcgtcgatctggcccatgtagatgcggcacttgaggccgagcatggcgcacacggtggcggtggccacgccgtgctggccggcgccggtctcggcgatcacgcgggtcttgcccatgcgcttgacgagcagggcctggccgagcgcgttgttgatcttgtgcgcgccggtgtggttcaagtcctcacgcttgaggaagatacgggcgtcgagaccggtcttctctttgacaagtgcggagaagcgcggggcttcggtcagcgggctcgggcggcccacgtaacgctgctggagcgtcatgaattccttgtggaatttggggtcggccttggcttgcgtgtacacgcgctcaagctcgtcgagggcggtgatgagggcctcgggcacatagcggccaccgaactggccccaatacggtccctgatgttcgctgagcggggtcgtttcggatgctttcacttgtgctcctgcctttactagtcgttccactgcaagttcatgattgtcggcggtggccacgccctcgccgaccagtaccgcgtccgctcccgcgcgggcgtagtcttcgacctcgaccgcgccgaatacgccggattccgctaccttgatgacgtcatcgggcagatcggccgcgagttcgttgtatttgttcacgtccaccttgaggttcttcaggttgcgcgcgttgatgccgatcaccttggcaccggccttgcgggcgcgttcgatctcttcgcgggtgtgcgtctccaccagcacagtcatgccgagctcgtgcgccagatcgagcaggtgcttgagctgggcgtcgtccaatgcggcgacgatgagcagcactaggtcggcgccgtgggcgcgggcctcgaagatctggtagtcggtgacgatgaagtccttgcgcagcactggaatgtgcacggcggcgcggaccttgtcgaaatcgtcaaggctgccgaggaatttgcggccttcggtgagcacggagatggcgcttgcgccgcccttctcgtactcgcgggccagcgcggccgggtccgggatgtcggacaggtggcccttggacggagacgcgcgcttgatctcggcgatcacggggatgccgtcggcgcgcttaagccatcgtgtcgcgtcaatcggagccggggccgccagcgcggccttcttcacatcctcaagcgatacggtgagctcacgggtgcgctgatcctccagcgctcccgccaccagttcgtccaaaaccgacatggtcctccctttgttggtgttcggtcatgcgccactctaggtcacgtcctgtcccgattgccgaacccgtcctacattttgggctttcgcaggcgattccggcttaggcagaacattggcataaactggcacgcatgtgcagacgttttgcgctcgacttggaatgggacgccgtggctggaccgcaccatcgacggcgcatccttgctcgccggcgtgcggaactcaggcactgcgttatcccgccgcttgcaatttcatgaggtcgccccgctgcagggcgacggcaaacgcctgattcagccgttggattcgaccgagcccatgcgcctgttttgacggaacatctttgacgagagatcgtcactgaatcaatgtttgctatatatgtatcacagtgtcataactatgaaatcatattgttgaattgtggtatatgaagttcgcatgacaacgatgtcaccgttggtaggtggacagtaggtgccgttgctgccggtggtggtgctgaactgccgatgtggttcagtccaccagcccgcgcagcagcgcgatttcgtcgcggtgcgtggtcgacgtctgctccttggtttcgagaatcatcgggagcttggccatggtcggatcgttgaccagtcgcgtgaagaacgggatgccgagctgcccttcgccgatattggcgtgacggtccttatgcgagccgaggccgaactgcgaatcgttcacatgaatcgccttgacccttgccaagccgatcacctcatttaactggcgcatcacgccgtcgtagtcattctccaaatcgtaaccggcatccaacgcatggcaggtgtcgaacgtgacgccgacgttcgccttattctccacgccatccatgatcgtggcgagctcatcgaaattgcggccacattccgtgcctttgccggccatggtctccagaagcaccatgacgccatccgcacgctcgaacacctgattcagtccctcgctgatcagccggcagcctgtctcggagccttggcccacatgcgcgccgggatgaatgttgatatacacctcctggccggcctcgcggatggcggtcagcagctcgatgtcctcggccaacgcctcgatcgcgaatgcgcgcttggcctcatccttgccggccagattgtagacgtacggcgcgtggacgaccaacggcccatagccctcagccttcagacgcgcaccgaacgccgccgcgtcggccgggtcgagtgccttcgaacgcttgccgtacggggaacgcgggaagaacgcgaacgcggtgccgccctcctcatgggagcgttccagcagcgcattccatccgccggccgtcgacagatgcgatccgatatacagttccgtcattccaaactcctcgtgttccactcgctgttcgtgttaccgctatcatatggtaggcagcatcgagcgccgcccgcacaaccgacacgagacacaactgttcacccgaccaaaggagacccgagcatggcggtagccggcacacccaaggacgataccggccttgaacggaagatggagtcgcgccatctgacgatgatctccctgggcggtgtgattggcaccggtctgttcgtcagctccggctatacgattcatcaggccggcccactgggcgcaatcctcgcttatgcggccggttccctgctcgtctattgcgtgatggtccgctgggcgagctgtccgtggccataccgtatgccggcagcttccacatgtatgcgaagcggttcatcggccccggcaccgcgttcaccatcgccatcctgtattggctgaactgggcggtggcgctcgcatcggagttcacggcggccgggctgctgatgcagcgatggttcccgcattcgccgtcctgggtgtggtcggccgtgttcattgtggtggtgttcgcgcatggtatggtcgctggccaaggagcggctgattcccgcgcgattcgccaagacgaatttccgtggtgtgccggtgtgggccgtgctgttcagcatggcgggttcgctgctggcgctgctgtcttccgtgctcgccgcctcgaccgtgtaatttggtgttggtcgcagtatccggtttggcgacgctggtggtgtggttctccgtgtgcgtgtgccatatccgtttccggcgtgaatgggcgagggacgggcacagcgccgatgagctcgactaccgtgcgcccggtttcccggtgctgccgtggctggccatcgtgatgtgcatcggcgcgctggtgctcgtggtgctcgatgagacgcaacgttcgaccctgattgcatgattccgttcgtcgcctgctgttatgcggtctattacgccctcgaacggcagctcaaacgcgaaagaatgcctaactcggtttcgaggggctgattcggcgttcgccggaggtctacttgcgtttcaaggggctgatgcccaagtagacaaggctctgaaatggcgttatgtcgttgccacaaagccgtttatacttgcggtttggcgtttgagcagcccctcgaaagccaagtagatgtccccaccggacgaaatcagccccttgaaagccaagagccccactttttcggcgaattacgtcttatatcaggtcgtacggcatctgatgcttgaccatccagaagatgccgaggccgatgaacaccagcagattgaatccgccgctatgccaccacaccacggcgatcagcgtcgccatgcgcgccacatagaacgccgcacgccgccagccttctcgcggccgggtttccactgtcatatgcgtgaagctgccgccgagcgtacagccgccgcgcaaccatggcaccacgccctcgaagaggatgagcgccgccaggaagaggatcgagccggtccagtcgaacggttccatcgactgccatgagccgttggagcccgagggcaggttcgattggacgatcatgacgaacagatgcgtcggcatcacggcgaacccgatcagcgtcatgtcgatgatgaacgtgatcagccgcctcatgaagccgggtgtggtggtcggcgtcgtatcggcgacccgcgccggaatcaggcgcagcgagaacatggccagcgcgaacccgatcagcgcgccggtcgtgttccacaggagatcgtccacgtcgaacagacggtaggcgcacgggaacacgcccatgaggccggtcagctgcatcgtctccagaaacagcgacgtggcgaacgacagtactgcggtaaccggcagcggccaacgccagatacggcccatgatgaagcccaacggcaggaagaacacgatattaaacgcgatttgcagtacggcggtgagaccatcggtacggatgtcaccgatgaactgcagtgggttgatctgcggtgtcagatggtgcgcggcgcaataggccgccgcatcggccggcatcggatacagtgtgaagcacagcaggccgagcagatacagcaccgtgccatacgccactatggccgacgacagtcggatgcgattgtcgcggtgatacagcagcgccagcaccggcaccgtcagcagcatggacacaaacggccacaatgccagcgcgaacgcaaacggttcggaaaagttcttaagaaatcccatcttcaatgctccctgcttcggcccgctccgttcggtttcggaccatgactctcgacttctgattccaaggtacggaacatgacggcatgcgggtatcggccatgagagcgaaatcattggaatgaaaggcgattcgtatcattcgcatggatgaggaagatgcaccagttgtgactgacaattgcggcctgcgaaccggcaggatgaatgggactgacccaactggcccgtctcatcttgtagggtgtttcgtgctcttgtaggcagatgattccaatggcgatgaacggaataccgccattgcaatgacctctcgccaaggccagctacctacaagatgctgaatctgcctacaagatgaattcgccggtgaaccatgccggcatcaccgcttcgaggtaagggcgcatcacgttcacgagccgaaattcgcgagcgtagttcatgagtttgaccaagtcagtgtgcgcggatctcatgtaattctggaaggcggattgcaaatcttgcggatccactgtgctgcgggagcggaacaaatcgcaaatggttcgttccaaatcataaacgcgaaccgtatgcccgaacatagtgatagccgacgccaggccaattgtaaagcgattgtcggccacctttctcactgttacgtcttcattcttgagacgagccgtacctgatgattgcggtaaggtaatcgtcggtgtcaggggggggggctcgccccctctccaagcaagaacaacgcagtttcatgcgaaaaaatggctttcggatatcgatactgcaattcgaacagcggatcggactccgcattcggtgaaacatataagccctttgccgctttctcaagcttggcttcacgcacgaatcgcgaaatctccgtgcgggaaactcctcgacgctccatttccgataccggaagatatcccatatgctccttcaatacgctttccgcttctgtcgctctagtggacatgggcattccttcagatgttgcggagctcggagagttgcctgaagaaaagttttgctatcgcctaacctaatgcgttattcgactccaaccgttgctcgacttcgaaatgctcgaatactatgagcgagttgtcgttcaacggaaagattgggttggcgaattcatcgcggtattccgccgaattccagaaagattcgtgtgcgctccgccattgggccgccgtgacgtcgccttcaccctcatcgatggcgtaccggtcagtgacttttccgagcggaatcacgtcaaccgcagtggtgacgagtacggctacgggtcgttcatcggaatccaccaacaccgaatgcgcgccaacgcacggcagcggttcgacctcttcctcatattcaatcatcagcgcagcggtggcggtttttacgccgtccagaatgagcttcaccaagcgatcgcgttcaggcccaggaaacataaactccgctttgggcaaatcactggtttcaaatgccgtattgacgctcatgcaatgctccagatcgtctttatgttcaattgtgctgtgcttttcttactcccatcataatagcccgaattccatgagtttccggcgctgatccagtggcctccattacggtcaatacaacctgatgccaagcaatcacatgacaacaagtgacactgtactcacgaaccggcctactatgggcggcatgacgattcgtattgttccgattgagccgccatggtttgaggaaaaggcccaagttcagtcgtgcacgtggcgcgaactcaatcaggggcatattccgcagggaatcgtggatgcgatcactcccgaattcgcgctcaaactgacgcgcagtcacgccaaagaccccaatcaggtcgtattggtcgctttggagaacaaccacgtgattggttttgctgagcttctgcaaacgccacgttcgccaatcaaacggtccgaggctgcggaactggcttcgctatatgtgctggaatcttgccatcgtcatggtgttggccgtgctttggttgaggcaggccaacgcgccatcggcaacgatcggctcgccttgtgggtcgccggattcaacaccaacgcccaaggtttctaccgtcacatcggcttccatgagaccggcctgactcaaaccgaagacatgggcccggaactcgaaatgatcaactactctgacggcgtattccagtgagcagcccgacctcccacacgcgtccggcgctaccatgaagccatgtctttgaacagtgagcaacgcgcggcgactatccgcgaatttcaggagaacatgagccggctgggtctgaccgccgaacggcggcaaggattttggcgtcagcggcagcagagtggagcaaatcatcaccctcaagtcgggcgtgctggagtatccgtggattatccgcgcctatctgctgagcagagctgagacacagggcgtggaactcacgccgttcatggcgttacgcggaaatccgcacgattattggttcctcgacggcgactctatcgaccgaggcgaaatcgattaaaaccgattgataatcggccatttacacgcaagaggcgccgtcaatcgcctcgcgcatagaggccatcgctctccatgcaggtggcgatgcgtgtgtagtattccgtcttgtcctcatggtcgatacgtgcgccgcaatgctgctgcaccgcaagacttgccggattggttttgtggacactcaggtaagcctcctcgatgccgagctcgcgggccttggcgagcgtgagcttgagcccggcggtcgcgtagccgtggccgcggtattcgcgggcgataccgtagccgatgtggcccggaccgttgcgcaggaagtcggtgagccggtgacgcaggttgaagatgcccacatagtcgccctcatcgttgacgagaatgtatttggtggctggcacccagccgtccggcaggccgacgccaagcgactcatcacgcaaccctcgcacgtatgcggcgaattgttcacggtccatgccagccgccgggttctcgaatcccgtctcttccgccgggaatttcgcgaacaagtcaaatgcacgttctggatccgccagccatgtctcgatcagccgcatcggtcgcactcctcctgttgatacagcagaccatactactactgctcggccaacgggcgcgaactttatctggttagccattcgtctgcggtgatgcggcgtacgagttcgtcgcgatatacgtcgccgagcagtttgagatgcacatggcgggcggtgcgcacgggtgctagtccgagtttgtccatcacgcgggaggatttgtggttgttgacgtcatgcacgccccagattgcggtcagttgcaggtcctcgaacccgtgatgcagtatttcccgcccagcttcgggaatcagtccttggccccaatacggttcgccgatccaatagccgatctcgcgcgtcgactccggctcgcgacgctcggggtcgactgcatccgacaacggcgccaatccgatactgccgattggctcccccgtctccttcaggacgaccgcatatgtttcgggagtgctcagcacattacggattacccgcgcactgtcctcgacactggcatgcaccggccatgcagcggccggcccgatgtgcggattgcttgcatacttgaacagcgccttcgcgtcggcaacatcatcgattttccacgggcgtaacagaagtcgttccgtctgcagttctgttttcaaattcaattgagcttctccccttgttcacggatatgattcgcttcttctagtcaatcagcttgtgcccgaaattcctacggcatgcatgtactcaaatatatcttcacatttgcgggatgacacacagatctggccattttttgcgtgacgtcccgcagtactgcgggatgccatcgagatcaatcgtttgacgcacgtagcatcccacatcattaattattaaaatcgcgggattacgccattttccatgttgagccataatcactcgtaagaaatgctgcgggatgatagacgaaaaacgctgaaattcacgttgcatcccgcactcatcccgcaatctacaacgtccgcgactctcaccattcaaggattcgcacgactattgataaatatcccgcgagcaggaaaaccagcaaccacacgagcgacactaatgaattctgcaaaggcaacgcaccatcagccagcgagcgaatcgccgacgaatagaacaagtcactgacagccggcaccaaatagacgatgaacggcttaagcagtatgggcaccaggaagtagatggatagtccgagcagcacattcccggcaagcaaagaaagcgacagtaccgcaacgccgttcatcactaccagcatcatgtaccggatcatcagacggccgctgacgccgtgtccgtaggcgatgaagtttccaatggcgttcaccatggtcagcatcaacccgacaacgacgatactcacgactttcgctgtcatcagggaaaacgccattcgccgccgggaaccgacgaggagagccgctatcgccgtttcgcccgaattgatttcgataatggccagagcagcggcgatgatcacgagcgcttgcgaggcaagtgtcgtgctgctttcgacggtcagcgggttggttccggaatcgtccaaactaatcggcatcagagcgaccgtgtacacgagagacacccagcacatagccagcagacaaacgacccgcaggattcgtgttgtcgcgtccttgtatatcagggctttaaccatgctcgtcacatcacgcccctctcatactttcgatttcaggaaaagccggctacgcaccatcaccgccgcagtaaacaccgccaccagccaacacgtcatgacgattgcggatgcggccaccggaaattctcctgcctcatcgtcccgtccgaacgcaaagcttttcccgccgatcgtcggcagcaccatatcagcgtgaaccactttcagcacgccggatagcgaaacgacaagtagcagcagaatcacggccagtgatggcacgtcacgcttcgtggacaaggccgcgatatagccgatcagtcccatgaccacggcgaacgccatcaccctcagaggtgtggtaataaccgtagccgtgaggaacatcggtcgcagcgcgggattcaacatcaccacgagtatcgccgcattcagcagtgatgacagcagtgagacggctatgcagtagagcacggtcgcgagcacgtcactgaccgcgaacggatagggccggttatacagcagccgcagctggcgttcatcgcccgaccggaatcccgccgccacaatcaacgccacgataatagggatgagaatgattgaggtctggtagggcgaggcgagcatggcgtcggacacgatatgcgccaggttcgggtccaatgcgtcgtgcgattgtacggtaccgtttgctgtgatggacaccgtcgaggaaatcgtctgcacgtcgagcaccgcgaacagcgcggtgagtgccagaacggcgcatacggaccagtagaattgccagtttgcgcagtatcgcaccagctggcaggacagatggcggggcaaagatgtcatcttcatcagcctcacttcttcaccacgttgaaatacgcctgttcaaggctgccgtactggtcgagcaacgcagcgatgtcaccatcgagaaccttccggccattcgacaggcccacgacgtgatcggtcaccagttcgagctcggccatgtaatggctggagacgatgacggtacggtgatccgaaacgtaatccttgatgaagtcgcgcacccattggatgccttccgggtcgaggccgttcaagggttcgtccaagatgagatacggggcgtcggtcaggatcgcggccgcgatgcccagacgttgtttcatgccaagcgaataggtcttgaacgtccgtctgcgcgcctcgtgcaatcccacgagccgcaggcattcgtcgcatcgggagaacggaacgccggcgaccagtgcaatccaacggagatggctgagtcccgtccgggacggatgcggcgtcaacccgtcgatgaacgagccgacgatattgcacggagatggccccagttcgttgtatcggctgccatcgaacgtggccgcgccgctactggcaggctccaacccgagcaggatgtgcagcaacgtcgactttccggcaccgttcggaccgattagcgcggtgaccttgccctgctcggctcgaaacgacacatcatccaacgcctgtttgccgccgtacgttttcgacaaaccggaaatctctatcatcacagctcccctcttctactcggaatcaacaacacccaatatggtccggctgcgacgtgcccgcgacatcgtgtcaagcaatcgcatgacaacaggttttcatccggctgtgggcatggctacgatgagcggcatgaggcatgatgatatggttggggtttcggcgcgggcaatccgtatcggcgtattggataatgatccgttcgccttggacgcgatgtgcgcgatgatctcggccgtttccatggacttccgcgtcatgtggagcacgggctctcccgcggtggcgattgagcattgccacaacccgcataccaggccggaggtgttggtgctggatatggcattgggcgggatcacgggcgcggacgtgtgccggcgcatccggcgcaggaccggtgggacaggcatcgtgtgcgtcacctcgtattccgtggacgtctaccagcgggaggcgatcgcgtccggcgctcagggactgttcgcgaaggaacgactgaggaccgatatcgccgtggcgatacgctgggcggctcaaggccttcccgccgacgaacaggccgctgtgggttttcgtgacgcgcagaccgcctatgggctactgtccggcacggtgccggcgaagatgtctgttgacatgagggatcccctgtcattgcgcgagaaggagatcctgcgcctgtacgcgcggcggctgaccaccgacgagatcgcgggccggcgtcatccgccaccatgatcctgctcgcctccaccatggacggccttgatctcagcaggagccgggtgatggtggccgcggtgcagagtctggcgttctactgctttccgctcctgaccggcctgctgttacatgtgatgcgccaacgcgaccatgactcgtacctgctgcgccgacaacacgaacgcggggagacggcccgcagcctgcatgacaccatcggcaacgacctggcctacctgatcctgcgcatcgaccacgccgaaaccgaaggcatgcccgccgacgaacacgaataccagcaacagctcgacgaattgcgcgacgccgccagccgggccatgggccacacgcacgaggtcatcgactcgctcgaaaaccacccgcaacgtccatccgacccatcgcatgaaggctcgcacggcagcaagcaaccccgcacagccgattccacggaagtcgatgccgccgcgcagcgtgccgggctgcaatcgctgatcgacgaggaggaggccaggctcgaagccccgggattcaccggcgacaacctgctcgccgaaccacaccggccgctcacgccggagaccatgcgactgctggcgggcctgctgtcgaacctgctggcggaactgtacgcgaacatcgccaaacacgccatccgggcgaatggtacgccatctgcgtcaccttcgacacggacgccatccacgtctccgccagcgacaccatcacacccgatgacacgagactcggcctcgaccgctaccaaaccatcatcgaaacacacgtcggcaccttccaaacccacaccgaacaagcccactggcagctggaggctggcattccaatcgatggcggccggtaaaacatgcattcgcagaccagccatgtcaagcaatcgtatgacaagaatcatccgtttacggcatcgccgccggatgactacaccagcagggcacccgcgagggagacgacgatgacgccgatcacggccaccgcggtgatggtctgtcgcaatatcagcgcggcgataatcacgctcatggcggggtcgatggagaacagcgtgccgaccacgcgcgccgacgtgatacgcccggacaacgtgtccatcgtgtagggaatcgcgactcccagcaccgccgaggcggcgatgatgccccactgggcggccgacatgtgcggggcgtgactgatggataccggcgaagtggccagcgccgcgaccgtgaccgacaaggcgagcccgtcgagcccggtgcccgtcttgccgacccggtcggcgaagagcgtgtacaggccgaagcacacggacgagcgcgagcatgacgatcgcggcgaccagcatgcgcatcgaactgaccggaatcggccccaacgcactaaacaacgacgccgacagggacgacgacgtctggatgcccaacgatcccaccataaccatgccggccgccgccatcacacggccacgcgccgaacgcggcgcccgaagcttgcccaatacccctcccctgtcacggccattcccacacgacctctgcgtcaccaatgacagtgttcggcgaagactcgcgacgtgcggagtcgactttgtatggcgggatcagcggaaagcggcaggctcactcccgcaacggaatacggtgagaaagctggctgccggacgattacgatccgaaacagtgcacccgtatacggcttcggtcagacacgtttcaccgccttgaacagcagacatgcgcttatcgcggcgatgacgacgccgaccggaatcacgtaaccggcgaatttcaccccgttcaacacccatgtggttggtatgacggcgtacagcatcggcgcgtcctcgaacatgccggaactcaccgtaagtccggcgacgatgaagaaggcgacgacgttccaggcgacgagaggactgacccagagtcgcagaacgaagcatgccagggaaaggacgacggcggtgaacgcaagcatcagaatggtacgcgacgaaagcgtctcgttgacgacgaatccgacggcaagcccgtacagcaaagtcaggcagacgttgatcacgacgccgagcgacagcgacttcacgctgaagcgaagcaggagccggtcgtggatgctgaaggaacggtacgaggagggcacccttgcattggagaagacgagaccggccgcggttacgggaagcgccatcaccatcgccgactgcaccaccgcacccgtgttcccgtaacgcaaaaagaacaacggaaacagcagcacggccacgaaggcgagcgtcgaccagcggatcaccgccacacgctcaatacgcaatagggacttcatttcctctccactccttcgcgacggaaccggctcaacagcatataggcaaccaaaagcaccacgatcgggacgacgaccatcacggggccgacggacgctcgactcgccgcttccgccggcgacatcacggtgccgttcaggttaagtccgacggtccgtagggcgttcgcgacgtagggcgtcgcatagtcgggaaggtcgcccggcaggagaatccatgcatagcaaaggatggccgagacgattccggcggttctgggatcggcggcgatctcgacgatcgagtagatcagggaggtcgcaaggctctgcagcacgacgaagcacaggacagctgccagatgcgggtgaattccggtacccgtcaggaccatgatggcgtcgaagcacagtacgccaatcaggttcacggaggtcaggatcagggcccggaacacggccctgagcgagcatggcgtccacgcggaatacacgtggcgcggcaggccaccgtagtgcgccttcgcgaccctggcatcgcatgcgaagagcagcgaaaggcagatcaacggctgggtggcggtgaaatagacgcaataccctccggttatcggggttccgttcgccgcgcttgagatccacgcacccagcagaagggacgagacggccccaaacaccgcggcgaggaaataccacgtgttccagtagtaggcgaccaacgcgcgaacaggggaaacggcgttcaagaccctacctcccctgatacagatccgcgaggttcaccccggtcagatccgtgacctgcacggcccggccgtgacgaatcatgatgcactcgtccgggacgccctggatctcatgaagcagatgcgtggagatgactacgcagttccccttgtcccggtaggcgcgaagcgtttcggacaaggaggctatgccatcggggtccagaccgttctgcggctcgtcgaggaacaggaacctcggatgcggcacaagggcgaggcacagctccagacgctctttcatgcccgtcgagtagtccttcgccttccgcccatacgccgcgcgattgatgcccacaccgtccaacgccgcctccgggtccacatccagaccccagaacgcggagaccacctcgacgttctctctaccactcaggtaaggaaagaaactgggatggtctatcgccgcggacatctcattgatattcgtccctgtgtacgtgacctctccgctcacgggctttatccgtccgagtagcgtcttcatcaacgtggttttgcccgcgccgtttgccccaagcagacagatgatcctacccgtgctcaaccgcaggttaatgttgctgacgattggggaacccttgtacccgatcgagagattcgcagccgatataactggcataatcacccttcacgaaaggcgggcctgaaggcaaaggcaggatgccttgcccagacccgcgcgttgcaatgtcgccgccatttcacccttcagcggccgcaaacgcaacatcatgtcaggcaatcgcatgacggttgctccatgctccctcgatttgccgaaactatccatcggccaaaggaatgaacctgcgcatcatccgcaaggacgatgcatccgactcccatcgcacacttgccgccaccggtctctccccccaaaaaaatggcgaagggcgggttccagtgatcgtcgcaacgcctggctgactgatgggagggccaggtggacaggtgggtgttcgagggcgtggagtacgcgacgcgtggcgagatgtgcgcggcgcggcgacgccggtacgtcgagcatctcgaggcgggcatgaacttcacgcaggccgcgcgggcggtgggcgtgtccaaacgcaccggcaaggtgtggcgcaacggaaggacacgatcgaacggcaggaacgagaaaccgtcggtggactggtatcgttccaccgtggacattccccaaaagatcagttcgaggtatctgagccaggacgagcgcatcagcatcgccgactggcggaaggccggcatgagcgtgcgcgggatcgcgcgcacgctcaatcgtcccgcgtcgaccgccagccgcgagctggtgcgcaacacgaatcccgcgaccggcatgtacgagccgtaccggccccagcagatgagcgcggacggcccagacgacccaagcccgcgaagatccatacggtgcccggcctgctcgcatacattcgcgcaggattgcgggcgcattggagtcccgagcagatcgcggggcgcctgcgcgccgatttcccggataatgatgctatgcatgtgtgcgcggagacgatctaccaggccatctacgtccaggccaaaggcgaactgaaaaaggacgtcatcaaggccctgaggagcgggcgcgcccaacgccggccgcacgggcagacggactcgcgcaagccccgtttccgcgaacccatgatcatgatcagcgagcggcccgccgaagtcgaggaccgggcgatacccggtcattgggaaggcgacctgatctgcagcgcggccaacaaaagcgcgatcggcacgctcgtggaacgctcgacacggttcacgatcctcctgcacctgcccgacgggcacgacgccaaacacgtccagcaggccgtcatccggaaaatgcaatacctgcccaagctcctgaggaactcgctgacctgggaccagggaagcgagctcgccctgcacaaacgcatctcgaccacgttggatatgcaggtgtatttccgcgacccgcattcaccctggcagcgcggcaccaacgagaacaccaacgggctcctgcgccaatacttccccaagggcaccgacctgagcgcataccccgaggaccacctcgacgcggtcgccgaggaactcaacgaccggccccgcaaaacactcggctacaggaaaccatccgagaaaatactcgaactcatcaacacagcatgatacgatcgcaccaatccaagaccgccatcaagagcggcaaaacacacaggtgttgcaaccatcactaaaatccgccaagcccaccttgccgaatggggtgtcgaacatggaatccgtcttgggagggcgtgcggtagtcgcattcgtaacaacaatccgcttgaatgagctgctgagcaaatagcaggtctacatgcctgctttgaaccagccgatggcgatttgagtgcgattgcgcaggcccaaagttgcgaggatacgggtcacggcacgtttgacggaggcaggttcgacggtgagttgattggcgatttcctcgttgatgagcccttcggagatgagtgcgcagatttcacgctggcgaggggtgagtgcgtcgaaagctttgcgcatttcttgctggcgctggctgctggtgggatgcggaacgcctcgttcaagcacttgtctggtgattcgtggggtgagtattgcgtcaccgttggcgatggcgtgaaccgcgtcgatgaggttgtgcttggtgacgtccttgagcaggaagccgctggctccggcgtcgagaccgccaaaggcgtaatcgtcctcgtcgtacgtggtaaggatgagaatgctgatggtgggccagcgtctggtgatgcggcgagtggcttcgatgccgtccataccgggcatccgcacatccatgaggattacattcggcaatggacgatgctgaacggcgagctgttcgagcgtctcgatggcggatcggccgtcagcggactgggcagtgacgacgatgtcggaagcatcgtcaagcatgagttggaagccaagtcgcgcgaaacgctggtcgtctacgagcattatacgaatcatgcggtgtggtccttttcgttcactccgttggacgggatggtcgcctcgacgacccattcgccgtcttcgtttggaccgtattcgaagatgccgcttgccgattcgacgcggtggaatagacggacgagcccagtaccgtcatccttgcgcgcgtccttgcgcgcgggactgccgtcattgcggataatcacggcgacggtgccgttctcgctgtggttccaggcgatgctgatatgcaccacgttctgtccgtgacgtatggcgttggtgatggcttcgcgagtcacatcgaaacacaaatcagcctgagcttcgtcatcggcgcgcgtaccagtctcggtgaacaccgtgacgatgcccagccggcgtgcgtgcgcgagaatcggccgaatgtcatcccatgaatgctggtcggattcttgggtgtgcgtatcgtcaccgttcgccgctccatcgaactcggtcagtgcgcggacggctttgcgcgtgtcgcccagactctctcgtgcgatttcgttgatgccgtgcagcgcatcctccacgcgtgggtcatcggttttgccggccagaccctcagacagtgcgatgattacggtcagaccctggcccacactgtcgtgcagttgaccggctatgcgcgaacggcgtattgcggcatcgcgttggaaggccagctcggctgcccgccggcattcctcggcagctttgtgttcggcttccttggcctgttgcctgccacgtactgcaagcgcgccgcctcccacggctgccagcgttaccactcgactcacccattcggtcgcgagaacgtccggatgcaccatgatggccgacgcggtcatcgacagcatcatgccgatgcctccaacgcacagcccgcgccccctcgctgtccgggcgaacgcatagcaggcgacgagcgtctgaatcatcacgattgagtccaaccgccagtacgaggcaactattaacaataccgcttcaagcgccaaggcaacggctggcagccagtaacggacaagcagtatcgcactgctggctatggtcatcgccagcagcagagccaatcccagcggatctttggcaaacgtatacatggtgtcggccggcgctccgatcgcatgctcccacagcatcgctgcacattcgaccacggcgatgaccagtggcacggccaggaccgtgaccttattggcctgcgcggattgcggtttcatggctcccattgtggctctttttgtatgatgttgcgtgcatgtcagcatgtgcgtatcgtgtcggccacgctgcggtgtagcgcggggcgaatctgcgtgaactggatgaggaacaatgccagccagcaggccgtgcccatgccgattacgcccggccatgggatttcggccacggggatgccgacgagcgccgcggatcttgcggcgaaaacgcttgcgctgacggcgaccgggatgagcgagagaatgaccgcgccggcggccagctgcaggctctgccagagatacatgcggatcacacgacgtggggacaggccgatgctgcgcagcaatgcctggtcggcgaccatgctgcggttcgacagggcaatgaccgccatgctggtggccagggacacgatgcacagcatcgttatgagcagcagcgagtccgcgtagttcaggctcttcggatggccgctaaggcgagtatccggccataggatcgcgcgcaggtcagcagggtgaccgacagtcccatggcaagggcgagcggggcaatcgtgttcgtgttgctggcggccttcgccttggcggaacgggcggcgagcacgccggtcgcggacccgcacaggcgacacacgacacgtccgatgcccaatagaatcggaatcagcatgctgacaaggatgtacatgccgaacgaggcgatgatgccggcccacagcgcgctgttgaatgtctgccccgcctcctggccgaacgcgagcgtccgtggcgtgcccatgccggagaacgccaatgccagcgccgccgccatgacaatcaaaccaagtgcccagtgcgcccaagaccgccaaccgtgccgtatcccgatggctcccgtgccgcgaatcacctcgatgggacggatcttcgctgcgcgcagcgaggggatggacgcgcccaacatgcacgtggccacacccaacagcagggatccgagccacgcggccatcgacggcgtgaacgcaggaggtgcgaacgagccgaatccatcggcgaagctttccgcagccatggcgttgaactcgggaaccgccagcaggctggccggcactgcagccagagagccgatcagggaaccgaacaggctcgccacacccacgagcatccacatgctggcaagcacctgactcgggctggcgcccataagccgccattgcgcgaacgtgccgtgaatacggttgaccgtggccgagccgaccaccgtcaacgagaagaacgcgagtaatgacaccaccacatagatcgtgaccgacaccatgccgaactcggccggatcaagacccgcctgccgcgcggccaatgtgaacgacggagacgaggtccacacgaattggttcatgcatatgcccaccagcgtggtcaccaccgcgaccaccagaatcgtgggtacccatcccgtgacattgtcacggaacacacgcagcacatacctagccacgatgagcctccttccgctgctgcggatacgccacgcgctggaccggtcggcccggttggacggattggataggctgggcgttcaccatcatcgggccgacagaccgcgccggcgcaaccagcggcggcgacccggccggtacgaaagtgcggcgtatgccatcggcaatctgctcggcggtgagtctgccagcgatgtgggtgacctgaccgtcgcgcaggaagatcacgtggtcggccaaagcggcggcatccgtgtcatgcgtgaccatgaccacgctggagcccgcatccgccagctcgcgcagcacctgcagcacaagctcgctgttcgcggtgtcgagcgcgccggtcggctcgtcggcgaacaccaccgccggacgcatgagcagcgcacggcacagggcgacgcgctgctgttcgccaccggacagggcgcttaccgtcgtcttcgccctctggcgaagaccgaaccgggacagcagctgcgtgacctgcacgtagtcggccttgcgatgggcgagcgagagcggcaacatcacgttctcctcgaccgtcagatacggcacgagattgtattgctggaacacgaaaccgatatgcccgcgaatgaaccgcgaacgccgttcctcattcagtgcgtagacgtcggtaccgccgatggtcacccgcccggaatcgggcctgtccaatccggacagcacatacagcagcgaggtcttgcctgcgccggacggaccgacgatcgccgtcaagcccgctccatcgatatccaacgaaacattattgagaacagtctgcgtgtttgcgggtcgggaggcggttcgagcatcgaaccctgtccgtttcaccagtccgagcgcctgaatcggtgtgccggcattttgccaaggcatgaggtagccccctgtcgtgaaagttgacgccgtttttctcaaccttcgcgccaggggcatggcaggtcgaggtaaacacggaaagtgacaccctagggtgacagattccagtagcgttccatgaccggcacccaatatgccctcaaccagaccagcgacaacgaggacctgcccggcatcgtccaactgcccgcctatgccaagtatgatggacggctgctcgtcatacttggttcctccgggaagcgaatatccttctgtcgtttgcggaaacaagccctgccgatgcccaagaccgccagataaagcaggaacatcacgggcacgacccatgtcacgtaccgccacgggtcaatctggaacgtatcgaagacgatgaacatgacgccccacacgttgatggcgacgatcgccagaatctgggcggccgccgaatcgaacctggattcggccgggctggtatcgttcgcgtcggccggaacgtcaggcgtccgcccggcgcgacgcatgaagccgagcgccgcccacacgatggccgccaccaacgccacggccgccggcaccaccagcttccagaactccccgtcattccagccgtaccggatgacggcgcacgtgatggccgtgacggcggccacgcccaatgtggcggaagcgccgaaaaaccacagcagaccttgattccgacgcccaccatgggaggcccgcacctcatcgtccgcaaccatatcgtccccgcattccataaagtccgacgcgtacgcatgccatctcaattatggcactcaaagagtcaatcagacaacatgctgtcaagcgatcgcatgacaggaatcggctatccgtcaatgcctcagggtgctgtcgatgcatatccgattgaccgatgcttctacatgcgtgccgacatgtgccggtccttcgcgtccgcgtacgcattcttacatcacgacctcaaactaatctacgaaaaactttaaacagatatctatttgattttaatattatttatggtatacttaattttattaaacccgccgtggattgaaggaggcaggtatggatatgacgatgatcccgccgtggatgtcgaacctcgatgacgaggatatgacgttcatcaaacggtttctgctcgcatcaggctccatgaaggaggtcgccgcgcagtacggcgtctcctaccccaccgttcggcttcggctcgaccggctcatccagaaaatccagttgggcgagcagatcgagaacgagccgtatatcgcgctcatcaaacggctcgcggtcgatgacaagctcgacttcgacaccgccaaaatcctcatcagcgaatatcgcaagcagctcaagcaaggagagtaatcatgattggcgccacaatatttgccgtagtgtttttcgtgtttctcatcgccatctgcatcggcttcatcatattgcagatcaggctttcgaagatggacagcaagtggcccggtctggtattgcccgccatcacattgctgctgtcgcttgtggcggcgattaccgtcttcgccagggcggacatcggtgcgtatggcaacatgtggaacgtcgtgctttccgcattcatcgcgttcctgtccaacaacgtatccaccatcgtgctggccggcatctacttgtatcagcgtgacaagatcaatcgtcgcgccgagctggcccgtatgaacgttcaggacctgtaagccgcgaatccccacagccgcgcccaagcgacatcgccctcccccgaagagatcacgatgttgatggtgcgattgtggggttcgttacgtgtgaaaacaaaaacaggacgacgagaagacgagaactggaccgcgccatcatcgctcttacaggattcgatgttcctttcccaggaacttattgaccgacttttccattcgcgtcatcgccgccggaggcccacaccagcagggtacccgcgagggagacgacgatgacgccaagcacggccaccgcggtaatggtctggcgcagtatcggcgcggcgatgatcacgctcatggcggggtcgatggagaacaacgtgccgaccacgcgcgccgacgtgatgcgcccggacagcacagcctatgcaccaccaacgataatgttcagtgcaaacgcatagcggtcaagcacttgcatgatgcggcagagcgttactcaacaaaagccaagcaaagacaccgatagatgttaaggaatcagttatatctgttttttcgccagctacaggagagaatcgactataactgatttccatgcgcttcttcagagaagacaagtctgttggacactttgatggactaaaggccagaacacaatggcgctagatgggacaaaaggtacattggtcctatggctaagcgcaaacatatcggcaccgtaattctcacgatactggtcgcggctctgctggcgtcgggcatttccggctggctgttctggcagtcggcgcaacgggtaatcggcgaggcgcagtaatccgtcgagcagggcgacttcaagcaagcgcttgagcagatgggcagcgctggcagtcacatcgtcacggcgcgtgatgaaacccaaggcatgccatgtcaggccgccgaatacgtgccatattacggttcggacgtgaaggcggtgcgcggcatgctgggcgcggccgccgacgccgcgaccaacgccctgcccaaaatcgacagtgccgcgcagggcacgttggtggacttcaatatcgaagagctgctgtccggcatgaacttctccgacggcacgctgtccattcccaaaatcgcctccatcaagcaggatctgtccgacgccggcgtggtcttgaagcgcgtcaagacgtcgatttatgcgctgccgcaaccccacacagaacagatcaccgaaatggtcaaccagggcaagcaggtagtggaccaaatcgatgaggctttcgacaccttgaacaccatcgtcgagaagattccgggctgacgtcggtttgttcttgtcagacgtaccattcaggccggcgcagtcctaggaatggccgctgtttgcgcgctgctgcggtctgtgtgagatcgatgtcggcgataatcaactgttcttggtcgtcggcctcgctggcagcgttgacgtacgggtccaccaccactgattggccggcgaacgccacatcaccctccgtgccgacccggttgcccatggcgatggccacctggttctgcatgacctggacgcgaatctcccacaggaacatctccaacggttcggcgctgatatggccttgttcgttgatccatagcgaagcgtcgcagttgtggccgtcctgagctttgaggtacaggttcggtgaaaacgtacatgccatgttgccgagtcttgctctgcaatgcggcgacgtgacggtcggtcaggtccatgagatatcacgacgcatcgcggttctcatactgggggaagaacggggagaactgtatctcagggaagaacaacagatcggcaccggcctcaccggcctgatcgtagtaggccaaggccctatcggcgttttcgtcgatattgtcggtcatcgccatctgcgccatcgccagtctcatatcgtttccccatctttgagctgcgaaatttatccgtataggtcaattgtgttgtactccaatgtaatcagtcaatacacgccaagtgaaaaccattgaaaaacaatgtgacaacatcatgcggccttagcaaaactcccctcagtcgtctacggcgccagttcagccgtaatgaagacggtctggcgaccgcgctacatagctcgactgtcgcctcgccctcgcttacaaacagcttcgctgtttgcttaacggctcagcctccagaggggagccagtagacgagtagtgcgttaccgtttcacgattgagcgcttggcgaggtgtggggttttgtgttgtttgcggttgcggctggcggccgacttttcgcgctcgcgtcgggctttcgcctcctcgcgggcggccatcgcacgctcctcctctagggatggcagaccggctgcggcacggcgacggttgtcctgctcgtagtcgcgcctggccttgtgctcgcctgccgccgaaccgggcgtggggaaccatcgcaattgacagagcgtctggccgagattccacagattgttggtcaaccaatagagcagcacgccgaacggcaacgtggcacccgacaccacgtaaatggcgggaaagacgaacacggtcatcttctgcacacggaattgcggcgagaccatagcatctttcgacgtattgcggtgaatgagcatccactggatcgcgaacaacgtcaggcacatcaacgccacggccacgccgatgatgatgcgtgactgcggcgaggcaaccgtgccgaacgagtcggcgatgcgtacgccgaatatggacgatgattcgatgtcgcccgccatggtgtggtcgatgccgcccaacggttccgcattcccatcggcgattgcaggcagggattgcagcgtgtagaacagcgagcacaaaataggcgcctggatcagtgaaggcaggcaggagccaagcggattggcgttatatcgctgctgcaaggccatgatttcacgttgcatggcttctttggaacgcgggtccttgcgcgcggcgtacttgtgctggatgcgttgaatctgcggttggagcacctgtatccgctgcatcgcacgcatttgggaaaggaagagcggcagcagacagatgcggatgacgagcacgaggcacatgatcgcgatgccccacgcggggctggggccagcagtcatgccaaacgtgaccagggcgtggtgaaacagggtgagcagttgggcgacaacccattctaggggtcgcaggatgtggttgaggatattgatgaagttcattgggattcctgatgaattgacgaatctgggatgtgtttccgagttcaagcaactgcaatctggtacggcaacagctgggaactcccctcagtccgcttcgcggacagctcccctcagagaggggaaccaaattagggggaaacaagaacatcgcataaatgcgtatccacatgtcgcctaaacaacacaattgcgttagaccgtggggcgcaacgatgagagctgaaaagagaagctaaatcagattcgggaatcggggagcgtgtaacggggccagcgtggcatccattgcgggcgggcccatgagcggacggcgttcatcaccgtcgcatcgaagcggaagctggcgggcaacggtcggcggccggccgaacctacgaacgacaacagcacgaccgcgcagcacgcacatacagccgtcaccgtggcgacgaagaccatggcggccagggcagtctgcgaatcaccgccggcaatccagcagccagtggcactcaacgacaacaacaacgtcatcaacacgatgatgtccgccatcggcatcgaacgcgacagtacccgcccacgcgaggcagccatcgtccacgcaccggccaaacgctgccgcaacgactccgcacaggccacgggcagaagaactggcatcatcagcagcacgcatacggcaaaccccagccgggtgccaagtgcaatgccgttcatgatgttctacccattccttctgaaccatacttccgcctggaagacggtcccagtatatacccgattcgacgccaattcggtattgtccaaaagcactgaccaattcgacgaaaatcacatctcatccaccatgacttgtagcgctccgccactggcgtatcactgcatatcaaagtcgctcatcctcgaattactgtcctgcaacaccgaacgtgccgcgggctggaatgtattttgagtcctgagtagattaaccgttcacaagaccgatatcgcaacggcgcaacaaaggcaacagcacgcccaaaaagcccggaattccaccaatatgagatggtcgacaaaataaccaaaacgtcaacgaaaaccataggaggccatcgaacatgtccgagaacatggaaaaaaaaacaaacaacattcgatttgccgtcgggtttctggcctttggcctcctgtggagcaccggcctgtacgtggtggccaccgtgctgcgcatccagaaggtgaagtagccgctgcgagtgcctatctccgtttcagggggctgattttgactcagcatcatgcagcgcagctatatcctcggtgcgggtatactattccgggccgtcacgacgacgcctatggaacgcacgcacggcaaagagagaaacatgagtcagcccgacaccgacacggcggcacagtcgccgtcctcgcaacaggaaccgcagattcagacggatggccgtcgaagccattcggaacaggtgaaccaaccagcgcaaaccagccagtccgagtcgtcacatgatggcaaagacgagcacgccctacataccaacctgaagcgcggcatggagtcgcgccacctgcagatgatctcgttgggcggcgtgatcggcaccggcctgttcctgagctccggatacaccattcagcaggcgggccccatcggcacgatcctggcatacagcatcggcgcgctcatcgtctatctggtcatgctcacactcggcgaactgtccgtggccatgccggtgaccggctccttccacgtgtatgccgaaaagttcatcggccccggcaccggcttcgtgatcgcgatccagtattggctcacctggacggtggcgctcggctccgaattcaccgccgccggcctgctcatgcaacgttggttcccgaacattcccacatgggtgtggagcgcggcgtgcatcattctcatcttcactttgaacgccttgtcggtgcggttcttcgccgaagcggaattctggttcgcctcaatcaaggtgtccgccatctgcgcgttcatcatcatcggcctgctcgccatcttcggcgttattccgattgccggctaccagcatgctccgatgttcggcaacctcgtcaaggacggcatcttccccaacggcttcatgccggtgttcgccacgatcctgaccgtcaacttcgcgttctccggcaccgagctcatcggcgtgaccgccggcgagacgcgcgacccggaaaccgccgtgccgaaggccatccacaccacgctgtggcgtctggtgctgttcttcatcggctcgatcaccgtgatgtgcgcgctgatcccgtggcgccaggccggcgtgggcgaaagcccgttcgtgctcgtgttcaacagcatcggcatcccctatgcgggcgacatcatgaatttcgtggtgctcacggccgtgctttccgcctcgaattccggcttgtacgcctccacgcgcatggtgtggtcaatgggcaacgagggcatgattccgcgctggttcgccaaaacgaaccgccgcggtgtgccgatgctcgccctgtgcgccgcgatggccggtggccttctggcgctcctgtcttccgtgatcgccgcctcgaccgtgtacctggtgttggtggcgctttccggcctgtccgccgtggtggtgtggatcgccatcgcctactgccagatcgtgttccgtcgccgttggctggctgccggccattccgccagcgaactcaaataccgcacgcccggctatccgtacgtgtcttgggcggcgttcatcctgtgcaccgcatcgttcgtattggtgattttcgacgtggagcaacggttcgcgctcgtggccgagctcgtgttcatcgtggcctgctatggggcgtatttcctgcaacagtgggtacgcaagcgcaaaaaggcgaccgaggccgacgacctcgatacgctttgggtcgcgcgcgactgaacacatgaccatagtgtgatacacgtcacttcctgaagtacgtagtcgttatggaatcacccgcacgtttcccgtatcggagctgtacgatagctgtgagacaggggggtcgtcagatttcggggggagggttccggtaacggtccggctgcaggatgcaccggaccgtgcggcacgtatcaactcgtggattcacgccaaactcagttcagtatgccgattctcgtaaatggccagaagcggaacaacgccacaccttggatatcgtcgtatggcactagcccattgttgccgtcgtcaagatggtatcgagaatctctggaattggagcgattatcaccaagcacgaacacgttgccgtcagtaacggttacggaaaaagggctgtcgcttggattcacgccggacttaagataagcgctttcatcaatgggtttgccgttgaccgtgatgggctccccggatcccttgcaggcgacggtatcgccgggcagaccgatgacacgtttgattaggtaacgattgctgtcgattatcgacatcagattggtgggaagctgctccccctccatccagtctgcgggatctttgaacacgatgatgtcgccacggtgcagtgtaaagagtctcggagtcaatcgcgaggcaaatacgcggtcgccgatttgcaacgtgtcttccatgctgcgggatggaatcacatatacgttgaacacgaaggtacgtcccagcaacacgaccagcatcaccgcgatcactgtcagcagatagccgcgaatttcgctccaaacggagggctttcgcgcatatctcctcgactggccacgcgcttttttgctatgacgccccaccatcacatcctttccgaccgataacgcaacaccatagtcctcaaaccatgccgttacctacgcatgtttgagctcagctgtcacaccagcggttcgcgcacgtccagttcacaggcgatgccggtttccttgcgggcccattcggccgcctgcagtgcggcgatgttccataatgcgcacggcactccgccaaggtccggatgcgatgcccagaatgtgaggtcatcagcgtatgcggtgatgaccgattcttccgtgactggcataatcgtgtggtacaggcggtccgcaagtgtggccacgaattcgttggccgcggcgaacgtgtcgatgagatgctgttcggcggtcaccggcgggccgaccagctcccaggattcgacatccgtggcgctccaatgcgcggcttcgccgtccacttcacgctgcaaagagacgaacagcctggcgaactcatccgaagtcagtcccgtaacccggcgtcgggttgacaattcaatcggagtcatcagataccgttcctttcgcttcgttcattccgttgtttcgctgcttggatttgctgccagccggcacaaagcccatctcgcacacctcacgatagcccaaactaccggcatggccatgattgccagccctacgaccagtagccatgaggagccggcgtaatggcctcatcgagcattgtcggatgattcgcgtggcccacaatcgagacagtatcggtttccgttcggttcgtgcggccagactatcgcccgttcttgccgattgcctgtaagcaggttcggatagactggcgcgagaacaatgcgagaaagaggcaaggatgacccggaaacagtcgcaacagcacgacgcacaacgcaaaccgtcctggcgcgtacgctggaaaaccatgagccgagccgtgggcatggaaatccgcgagcacaaaagctcattcgcggtctatgtggtgctgcgcatgctggtgctcgccatggcaatactccagttctttaacggcgactacgaaaatgtgttcctgtgcatcctgacgttgctgctgctgttggcgccggcgttcatccaggtgcagttccgcatcgagctgccttcggtgctggaagtcatcgtgctggtgttcgtgttctcggctgagattcttggcgagatcagttcgttctatgagatcttcccgttctgggacacggtgttgcatacgatgaacggcttcctcgctgcggcgatcggcttctcgctggtcgacctgctcaaccggtccgaccgggtgaagttcgagctttcgcccctgtatctggcgatcgtgtccttctgcttctccatgaccatcggcgtgatctgggagttcttcgaattcggcatggaccagttgttcgggttcgacatgcagaaggacgccatcgtgcattccatcagctcggtgatgctcgaccccacgcacaccaaccatgcgattcgcatcaacgacattacccaggtcacggtcaatggccaagacctgggcctcggcggctacctcgacatcggtctgatcgacacgatggaggatctggtcgtcaacttcatcggcgcggtcgtgttctccgtgttcggtttcctgtacgtgaagaaccgcggcaagaaggactccatcatcagtcgtttcgtgccacgccgcaagtccgccgaccgcgattacctgcgactggtgattgatggcgggagccgggaaagtcatacaaatatgagagatacagtaatcgaacaaacgttcgactgccctgataaactggatgcataatttagcgacgacaacgacatgatttacagacgcccgaaaaaagaaaggcgatctcatgactggcgaggaactgaagcggcagattgctttgtatgagagcgcggaccacaccgtgcacctcgatgtgaaggtagacgaggacacggtgtggcttaacagacagcaattggccttgctgtttggccgcgatatcaaaacaatcggcaagcatgtcggcaatgcattaagggaagagctcaatggattttcagttgtcgcaaaatttgcgacaactgcatctgacggtaagacataccaagtcgagcattacaacctggatatgatcctgtcggtcggataccgcgtcaaatccaaggaaggcatctatttccggcgatgagccaactcagttctgaagcagcatctcgttgatggttataccatcaatcgcaagcggcttgacgcacttcacgccgtcgtcaaggtgctatcgaggtccaccgaaccggaaattgctggcaccgccgagatcttggaacgatatttgccgagtcttgtgctgcttaacgactatgacacaggcaatgtccctatacccaagggcgacgagtcccagtgggtcttgacctatgaggacgcgatgctgttcatccggtcgatgccgtatatgccaatcactgttgtgtttgcgaactccttcgctcatggtgccgaaaatgcatacatttggttattcgctgtttgcggtggggcgtgcatgggttagtgtttcgggttcgattccctgtcagaaaaaataatcgagtgcgggattacggccggtaaggctcctgtcgtggatgcggatgcgcgccggtcttacggtggtgctttcccgaaacgtggattgcacgaggtgtgggacggcacgcggattcggccgttttccgcccgccgtcccacagcgctcgctatgaacggttgtggataatcatggagctgtagcggaaatcggcgttattccgcggtttcgacagttaatagaacaaatagaacaaatagaacagccagcttaggcacggcgcggcaaatggcgcaaaccggccgcgatagtagtagcgtggtgcataccagtacaaccatgcgaggagaacagccatgatcaatgaggaatacaaggccatgcttggcggcaagtccgtgattcgcgagctgagcgagtacgccacgagccgcggtgccgaaatcggctaccagaacgtgttcgattacagccttggcaatccctcggtgccggctccgaaatccttcaccgacgccatggtcgacctctacgaaaacggcgatccggtggccatccacggctactccccctcgctcggtatcccatccgtcaaggacgcgatcgccgaaaacctcaacgaacgtttcggcatggcatacaccggcaaccacatcttcccgaccacgggcgcggcgggcgcgctgtcccacgcgatgcgtgcggtgaccaagccgggcgatgagatcatcaccttcgccccctacttccccgaataccagccgtacgtcaagggcgccggcgccaagctgaccatcgtgccggccgacaccgagaacttccaaatcaacttcgacgcattcgaggctgcacttaacccgaacgtgcaggtcgtgcttatcaacaccccgaacaacccgtccggcgcggtgtattcagcggacacgctcaagcgtctggccgcgatcctgaccgccaagcaggtcgaatacggccacgatatcttcctgatcagcgacgaaccgtaccgcgaaatcgtgttcgacggcgccacccagccctacccggccagcttctacgcgaactcgctgacctgctactcgtggtcgaagtcgctgagcctgcctggcgaacgcatcggctatgtcgcggtgaatcccacagccaccgacgccgacctgctcgtgcccatgatgggccagatctcgcgcggcaccggccacaactgcccgccgagctcgattcagctgggcgtggccaaggtcatcgaccagaccgccgatctcaacgtctacgagacgaacatgaacctgctctacgatgcgctgaccggcatcggcttcgacgtggtacgccccggcggcacgttctacatcttccccaaggcgctggaggacgacgccgtggcgttctgcatgaaggccaaggaatacgacctgattcttgtgccgtccgacagcttcggcgtgcccggatacttccgcatggcctactgcatcgacacggagaaggtcaagcgctcgatccccgtgttcgaaaagttcgcccacgaggtgtacggcctgtaaacacggaccgcaagtaacaaacacaagaaaggggttgccatggaatacaccgaagacgccgatcgtcgcgaactgctgctgcacagcgcctatgactccgatacggtccgggccatggagcgacccctgctggacaaaggcgtgccgctgatgcgcatggccgcccaggccgcggcccacatggcggccggtatgctggacgacgaggatctggcgctggaggacacgtcgatcgtgctgctggccggggccggagacaatggtggcgatggtctgttcgcggccgccgcgctggcccaggagggcgcgaacgtcaccgccatcgccgtgggccggtcgttgcatgaggccggattcgcctcattcgtgcgcgccggaggcaaggtgctggtgcttgatcccgcggctgatattcccggttgcgcgtccgggttttccgccggtgaggccggcgagcgattgcagaccgccatcgccgtggccaggaaatcgcatctgatcatcgacgcgatgaccggcatcggcatccaaggctcgctacgcggcatccccgccgcactcgcctccgcccttggtctcgacggcgaggctcccgatgagcccgccctgccaaaccgtgagtcgtcaggcgattttccgctggtacttgccgtggatacgccatccggcgtcggtgtgaacgatggttctctgcccggcccgtacattccggccacggtcacggtcacgttcggcgcgatgaagccgtgcgcggtgctgccgcccgccacgttcgcctgcggccgtatcgagttgctcgatttcggattcgatatcgacgacaaggatccggacgtcgaggtggtggataattcgttcgcgtccgacgcggtccgtctccccaggttcgaggattccaaatactcccggggcgtggttggtctggtgaccggctcgcagcgctaccccggtgccgccgtgctcaccgccagcgccgccgcccgcgcgaacaccggcatggtccggtatctgggcccggagcgcgcgcagaacatggtgctcgccgcactgccggaagccgtgatcggcaagggacatgtgcagtcctgggtcgtggggtccggcgtgcccgaggctagcgtcgagggcaccgacggcgatatgcagcgggacaccatcgccgcattgctcaagcattacgcgctcggcagcgaggatgagaacaaggacgcctacgacatgccgccaatcgtggtggatgccggcgcactcgacctgctgccggagcgtgtgcccggccaggtggtgatcacgccacatgccggcgagatggcgaaactgctcaaccggttcgaaaccgccgccagcaccgcggagcatgccgattcgcacgagccgtacaccgccgacgacgtgcggttgaacccgttggccagcgcgaagcgtgcccacgagctcaccggcgccaccgtattgttgaagggcgcggtgaccatcgtggtggatgaggaccacgtctatgcgtcgggtagcgcaccggcctggctgggcaccgccggcgcgggcgacgtgctggccggtctgaccggcgccctgctcgcccagcaggatgacgtggccaccacgggcgagaccgtggcctcggccgcctacctgcatggcctggcggcggcgatcgcctccgaatccgagcaacaaggctggcaggagccggaactgatcggccgcgagcatcgccagcgcttcatgacgctcggccacccgattgtggccggcgacgtggcccacgccatccccgaagccatcgccgacgtcatcgcatgattccgtacgttggctcccctcagagaggggagccgacgtatgaaaccccctatactaaatcgcagaccccactcaacggccccaacaacacaaggagcatcatggccaactcccccatcaccgacgtgattttcgacttctgcggcgtgctgctggactggaacacccgcgcatgcctggaaggccgattccccgatgagatcgtggaacgcatctgcgccgacgacgacccctgcggcttcttccgctacgaggaccgcatggacaccggcgaggatttcgcggacatctacccggatgtggtacgcgaacaaggccaggaactcgccgacatcttcaagttctacatcggccactacgcggacgcgctgccccgcacgcttccgggcatggtcgagctgctggcggatttgaaggcccacggctacggcgtatggggtctgaccaactggtcgcatgagaccttccacctggccttcgagaagtacccgcgccttgaacagctgttgcagggcaccgtggtctccggcgtggagaagatgcataagccgaacgccgacatctacgagctggccctgacccgtttcggcctcacggccgagcgctgcgtgttcttcgacgacaccgccaagaacatcgtcggcgccaacgaggtcggcatccacggcatcctcttcgagaacgcgttgcaggcacgcgaatcgctcgcagaactcggcgtacgtctgtaagtcgccaaacgttgcatcgcggcagttgaagtctatggacccgtccttgacgacggtgaccggccgtgtggcgactatccctagcgatataaatagactttatgacactgctgcagctgaaatacatcgtcaaaatcgtcgagtgcggctcgatgaacgaggcctcccatgccctgtacgtctcccagccggccctgagctcgtcggtcaaggaattggagaacgagctgggcatcgagatcttcacccgctcctcgcagggcatcgccctgaccgtggacggcgcggaattcctgacctacgcccgccaagtgctcgaccaggccgacctgctcgaagagcgctataagcatgccaaaccgcgcaagcagctgtgccaggtctccacccagcactacatgttcgccgtcgaggcgttcgtggagatgatcaactccatcaagtccgacgaatacgagttcaccatccgcgagacccgcacgcgcgacatcatcaaccaggtcgccaacatgcagtccgaaatcggcatcatctacctgtccgattttaacaaggacgtgatcggcaagctcctgcgcgagaagcacctcgaattccacccgctcttccgcgcgccgctgcacgtgttcatctcgcgcaacaacccgctggccgccaagaaggtcatcaccatggaggacctgaaaccttatccgttcatccagtacgagcagggcgaggaaggctcgttctacttctatgaggaagcggtctggccggagtactcccccaagcagatcaacgtgaccgaccgcgccacgatcctgaacttcatcatcggcctcaacggctacacggtgtgcaccggcatcgacaacggcgacctcaacaacgagaagatcgtcaccgtgccgctcgacaccgacgaaacgatgttggtcggctggatcacgaacgagcgttccaagctctccaaggccgccgaaacctatctcgacaagctcaagtccgtagtctccgaccacggctacaagctcattgattaggagtaagtaaaacaggcatggtcagcagtgagatatactgcgattaagccaaccccgctggggaaatggaagtaagggccggctcctgagtatctcaggggccggcttttgcgctattgagactgactggcaaaaccagtttgatggcctccgactacttggccaagattaccgacgcggcggctgtcgcggcgaagcctttgagcacttcaatcatcacgtcgcgatcttcgacatcaatgttgcgggccgcggcgagcataatcggcagtgactgtgtcaaatgcgaagtgaggtcgccgaatgtgtcgtatccgccagcctcgaagatggcaaacaggttttcgatgaacttgcggcgatgctcgtcgtcgtattttgccatccatccgttgatcgtgcgtgccaggtattgcgcgctacttgtcagtccatcagcctgtacgaattggccatgatcgacttgccagtgcaatgcgaaatgctgcatgatgctggcaccgtcgctgctgaccaccgtatagccgtcttccacatgctcacgagtctcaaacagcatgccgatgatcgacgagcccggtaccgatttatggatcttcgacgcaatgcgtacgtacccgtcctcatcgaagaacacctcatcgaatccaggcccatcgtgcgaatatacgaccgtgatacgttcctgaatctcgctaggcacattggccgccgcatacaccgccagattgccgcctttggaatggccgccgaccataatcggcccggcccaatggccagccagctcggtcagataacgcgcggcggcctcctgcgaggcgaccgggcggcggaacgccatcatgaagtcctctttccacccgacgattgagctgtcggtaccgcgaaaagccacatagagcgtgccgttacccagttcgaacacgcaggccgagaactgcttggtggttgcagcatcgaattcgtccacgtatgcgcccacgcgtaggttcctccaacgtgggctctcgctcatcgcacgtaacagatcgacattcatcgaaggcgaccacaccttgccgaacatgtcgtcatagcattcggcacgcagcaaatcgtgaatcggaaccgtggcgatcatgccgtcggcggtctctgcattctcgtgatagcgcggcacgttatccggcatgcgagcataggccaactgggacaaagcgaggctatccgcctcggtgaacggcagttcggcgaaagtgtcgaaatgttgccgaatatcgtcggtgatgttccccatagcggccttccttgttcgaatgcaacgaacctacggtaattctacgccgagcgggttttcatcacaggcgagtcggtcccagagtttagaaccctatctcgctttcaagggagctgatttggccttctggagacatttatctccgtttcaagaggctgttcatccgtcatatcccgagtatgagcggcgtcaccccaacgtcattccgccattttcatgctgcttctacttgggcatcagcatctcggcggtcttcttcattaccttgcgacaacttgttcgctttgctgtccagatgatgctcgatgccgaagtaactgcatatccccacgagcgcaaacagccctatatcaactaaccagttcatagcacgctccttgccaaagcttttgccttaatatggtgctgctgttcatggaacgtaataaaaaaagcgggctcgcaagcccgcttttggtttttagattgaagacgatcaggcgccgtattcctcaaggtaggcggcggcgcgctgctggatgtcgtggctgagcagcggggtgccgtcggggttcttcatcttggcggcggcgtcgaagatctcgcgcacgttggcgatggagagcaccgggaagccgaattcggcttccacggccttcacggcggacatgtcggagtccttggtcttctccatgcggtccacggagagcacgagacccacgacctcgacgttcgcctcggccttgagtttggggatgacttcgcgcacggcggtgccggcggtcatcacgtcgtccacgagcagcaccttcatgccgtcggtcagcggggtgccaaccatccagccgccgtcgccgtggtccttcttctccttgcggtcgaaggtgtatccgacggtcatgttgtggccggcggtcagcgcgatcgcggtggacacggccagcggaatgcccttgtaggcggggccgaacacggtgtcgatgttgcggggaatcgtgttgtgcacgatggcctggctaatcttttcggcgtagaacgcgccgagcgcggcgatcttcttgccgtcgtcgaaggcgccggcgttgatgaagtacgggctcttgcggccggacttcagcgtgaagtcgccgaacttcagcgcgttggattccaacaggaattcagtgaagcgatgtgcgagtgtttctgccatgatgttccttacctccaagtctgtcctgcggccagtttagcagcgagttcgggacggctgtccaacaggtcgtcgagttcgcgggcgacgcgcagcggggccaccgggtcgaagagcgcggccgcacccacttcgacggcgttcgcgccggcgtacaggtattcgagcgccttctcgccgctgtcgatgccgccgaggccgatgatcggaatctccggcagtgcggtgcgcacccgatagacggctgccaggccgaccggcagcacggccgggccggatacgccgccggtgacgttggcgatgatcggcttgccggtgcgaatgttaatgcgcatgcctttgagcgtgttgatcatgctcaacgcgtcggcgccatgttccacggccgcgcgcgccggcacggtgatgtcggtgacgttcggcgtgagtttgacgatcatcggcttgtcggtcatcgggcgcagccggtccataagattggcgagggccaccgggtcggtgcccacgctcatgccgccggcggaaacgttcgggcagctgacgttgatttccagcatgtccgcgtcggagtcggcgagcttttccacgaccgccgcgtaatcgtcatcgcaatgtccggcgacattggagatgacgaacgcgcccgcggccttgagcttgggcaggtcctcggccaagtaatggtcgatgccgggattctgcaggcccacggcgttgatgttcgcggccggcgattcggcggtgcgcggcgagggattgccttcccacggtacgggcgaggcgcccttggtgcatacggcgccgagctggctgacgtcgtagaaccagcggacggcggcgtactggaaggtgccggaggcggtgccgaccggattcttccattccagaccggccaccttggtgtggtgcttccacacgtggggctcgtacaggttgatgtggttgtcgccgccctgcgcggactggttgtttgcgctcatcgtcacttcccccatccgagctgttcgcgggtgaacacgggtccgtcggagcagaccttgaggcggccgtccacggtgtcgatggtgcacagcacgcaggtgccatagccgcagcccatgcgctgttccatgctcagctgcgcggggatgccgcgttcggcggcccagtcggccacggccttcatcataggcagcggtccgcaggacagaatgatcggcttgcgatcgtaggccttcaggtcgtcgccttgttccagtttgttgagcaggtcgaccacgttgccttcggcgtcgtcgatgctccacgaccagtccgcgtaccgggagacgtattcctcggcgaagtggtcgttgcggtaaccgaatacggcggtggcaaaggaggcgtcgtgttcggcgagcttttgcgcggcgtagattagcgggggcacgccgagtccgccgccgacaagaatgtagttggcgtcttccttgaggttgaagccgcggccgagcgggccgagcacgtcgacggtgtcgccggcctgcagtcctgccaactgttcggtgccgtgtcccacgacggcgaagatcacgctgacttcgtcgccgtcgacttcgctgacgccgaacggacgcggcatgagcatgaagtcgtcgtgcgtgaacaggttgacgaactgggcgggcttggcatgggaggcgatgaacgggtcgcggaacgtcagtcgcatcacgcggtcggtcagttccgtaacctgcgtgatttcgacgttgtggcgcggcgggaagaatccggccgcagtcgcttccgtaaccacatcatgggtgggggtgaaagttgtcatttcattcctattcagcacatcaagctccccctatcaggggagcggtcaaccgcaggttgactgagaggtagttaaacacactcggctccggtttccagcccacactcacgtatagcccacagccggacaatctacctacctatatacggcaacccgcagattatcgcgcatgtcgagcgccgcctggcgcgcgctgctcgccacaaggtccagcgcctcgtcggcggtcatggattcggagtacttgccgctcttcttccatgcgccgataatgccgcgcgacgagttgacgatggcgccgctgccctgcttgtcgaacatgcctgccacgtccgcggccgtgccgccctgcgcaccgtagcccggcacgaggaagaacgtgtgcggcatacgttcacgcaacgccttgccttcctcggggtgggtggcgccgaccaccgcgcccacgcgggagtagccgtggctgccgatggtctcggcgccccatccttccacaagatcggccacgtgctcgtagaccttcgtgccgtcggccaggtcgagcatctgcagttcgctggaggacgggttggaggtgcgcacgagcacgaagatgtccttgtcggcttcggcggcggcctcgacgaacggggtgatgccgtcggtgccgagatacgggttgacggtcaccgcatcctcatgccacgggtcgaagtcgcccacgccgttcaggtggtgggcgtaggcggctgcggtggagccgatgtcgccacgcttgatgtcgccgagcacgtagaggccctgctgggccgcgtattcgcaggtcatcgtgtagatgtccacgccggcggggccgagcgcctcgtacatggcgatctgcggcttgacggcgggcacgatgtcggcgatggcgtcaatgatcgtgcggttgtattcgaagtaggcgacggccagctgcgcggattcgacttcctccggggattcgaccgagtcacgcacctcgtcggcaaagctcgccacgacctgcggcggcaccagcgcctcagtggggtcaaggcccacgacgctggggttctgagtgttgtcaatcgcttcgatcaggcgatccatgctgctccttgtgttatctacagacggctgaacatcagctgggagccgatgattgtggcgagggggcgtccggtgacctgccagccgccgaacggggtgttacgagccttggagtggaactgttcggggtccacggtccattcctcggcggcgttgagcaccacgaggtcgacattgtcggcgtcatccacgcggctcaagtcgagcagtcggttgacgccttcacgctgcggctgagcgtcgctctcccccgcaatcacgccatccggatcatccccggtgggcgcgggttcggcgtagtcctcgaccagcgcggctacgtcggttggcacatgccccatgagttcggcaggtccaacggacatgagctcgatcagacgctcatcggaaatgaagccgccgtcgacgagcaccttgtggcacacgccgtacgcgcattccagtccgatgatgccgttgggcgcctcaaggaagccgagttccttctctgccaacgtgtgcggcgcatggtcggtggccagcagatccacggtgccgtcggcgatggccgcgatggtggctttgcggtccgcttcggagcgcagtggcggattcatcttggcgagcgtgccgtacttgagcagcgcctcgtcgctcaacgccagatagtgcggcgcggtctcgcaggtaatcggcagtccttcggccttggccctgcgaatcgcctcgaacgagatggcagtgctcacatgctggaagtgcacgtggacaccggtgcggcgggccgcttcgatatcgcgggccacgatcttgagctcggtgtcttccggaatgccgggcacgccaagctcgcgggaaacggggccttcgttcacggcacctgtatcgtgatgctcgcaatgctcgatcaggtacaggtcggaggccttgacgttctccagcacctggtccaggatctccggcgtcacagcggaaccgtcgtcgctgattgcggtgatggggtgcgtgagcatggccggcgtcttggcgtcgtcctcgaatccgggcacgtacttgagccaatcggcaacgtcgcttgcctcatgaccggcgcgatccttggacgcgcacacgcacagatcgtaacgaaccggcaattgaacgtcatgcgcagtatcgtactgctgcaggaagtcgatgacgttgtcgaagccggcatccagaacctcttttgcaccggtcgcttccgggccagacacggtctgcccatccagtgccggcaacgtgttcggcatgatgagcacgttcgtgtatccgccggatgcggacgcacggcagccggagaccatcgattccttgtaggtctggccgggatcgcggaagtggacgtgtgggtcttcgaaaccgggggccacggtcaggccggtggcgtcgatgtcggcgccgtcagccacggcggaggtgtcggcgaagtaggcggcagcggtcccgggcaccacgaggtcgatgacctcgccggtgttccagaccttgatgttgcgtagggtgatgctcacagtttggcttcctcgtcgcagtagtcgcagcggtattcgagccgctcggagtgcacgaggtggaacatctgcttgatgccgggctcggcggtggtcacgcagcgcgggttcacgcaggaaatcacgccgacgatgtgctcgggcaggttcggctgcttcttttcgacgatcttgccgccgcgcaccacgtccacggtggcttggcgggccacgaagccgagcacgtcgaggtcgatgtccttgtcatcttcgattttgatgatgtccttggagccgtaacgcttggagtcggcgttcatgatgagcgcaagcttggttttggccgggtcgattttcaggtattcgagaaccttcagcgaggttccggccggcacatggtcgataatgatgccgttctgaatgctggtgacttccatcaggcctgaacctccttggggttgagcggttcgtatccgggcagttcgtcgcccaccacggtgctttcgagggccatgcgcacgagcatgccgttcttgacctgttcgaagtaggcggcacgcgggtcgtcgtccacgtccacggcgatttcgttgacgcgcggcagcgggtgaagcacggccatggacggcttggcgagctgcagcttctcttcgtcgagaatgtaggtgtcgcgcaggcgcaggtagtcgtcttcgttgaagaagcgttccttctgtacgcgggtcatgtacagcacgtcgaggtcgccgatcacggaggccaggtcgcgcacttccacgtaggagcagctgtcggtggcgttgatgcggtcgatcacgtactgcggggtcttgagctcgtccgggctgatgagcacgaagcgcacgttgccgaagcggcacagggtctcgatcagggagtgcacggtgcggccgaaggtcaaatcgccgcacagtcccacggtcaggtcggtgatgcggccgaagcgcgactgcagcgtggccaggtcggccagcgtctgcgtggggtgcatgtggccgccgtcgccggcgttgattaccggcacggatgcggcgcgggaggccaccagcgcggcaccctccttcgggtgacggatggcgaccacgtccacgtagttggacacggtcttcaacgtgtcggcgatggattcgcccttggtcacggaggccagctgcgcgccggcgaatccgatgaccttgccgccgagacgtagcattgcggtctcaaagctcaggcgcgtacgggtggagggctcgtagaacagcgtggccagcactcgcccatcgcaggtatgggcaatctctttgcggtgggaatcgatgtattcggccttatgcagcaggtcgagaatctggtttgtagacaggccgtccagcgttacgacgcttttgccgaccattggcgtttcttcagacaaggctcaccttttcgctcgtggttttcaggtggccacccttgcgtgacctaatctaacttacgccatttttcggacagccgcattcaccgagtgtccacctgaaaatccaacgaatatgctgccttatcgctgcgcgcggcgtcgatttcgttccagtcgcggtgcgatcacgtgcatacgcgggcgaggggcggtttgcggctgctgcgttgcggcggaggccgtggcggtggttgccgcagccgcctcgccttcggtcttcccatagaacaagcgctggcatacgtcacggcatttgcgcatcacggccagcaggtcgttctcgaaatgctggccgcggtgggcgccgtagccgaggtagacggcgatgccgcccagcgaatagatgtcatcaggcagaatatcggcctggttggcgcgcccgctccacagatagctgccgttgcgggccgcggtgcacaacgtccatgccttgcgcagctgaatcgcgtcgatagcgctgatgagcttcttggcttccagcacgtccaatgcctccagcgtgccgttgacgcgcagatctttgatatcgccggcgtgctggagctgcatgagttgcacggtccattccacgtcagacaagccgcccttgccgagcttcagatgccgttcacggcgcacgccgcgcggcagacgctcggcttccatgcgggccttgagcttgcggatgttctgcaattctgcttcagtcagttccgtggtcgggtagcgcagcgggtcggcgatgttgatcaggaagtcccgcgccagttcagcgtcgccggccgcgtaccgggcgcgcagcagcgcctggcgctcccaggtcgaagcccaggattcgtagtattcctcgcaggaggcataggagcgcacgagcgggccgttcttgccttccgggcgcaggtccaggtcgagttcgatcttgggttccagcgtcgtcggtccttgcaggatgttgcgcaggtcttccacgaccttcttggcgaaggcgttggcttggccgtcgtcggcatcgtcggccggacggtagatgagaatggcatccgcatcggagctgaagttcacttcgcgcccgccgtaacggcccatggcgatgacggtgatgccggccggcgcggtttcgacgccgaactcggcgatctggtggcgcacggcccaggtcagggaggcatcgatgatcgcgtcatacacgtcggtcatggccttgagactgtcggagtcgctgatcacaccgctcatccaagacaggccgatgcgttcgatttcgtggcggcgcatggcgcgcatggaggtggcgaactcgttgatgttcgagccgaaacgttccagcgccgagccggtctgcacgtccaaggcctcgcgcgtgcgggcctgcagattgtcgtcgtcgccaagccagctgatcgattcgaccgacttgttgagcgcgtcgcccaggaatcgtgagttggacaggatgtggcacaggcgctgggcggcggaggtggagtcgcgcaggaagccgaggtagccggattcggtgccgaagttctcctccagtttgcgccagttgagcaggcccatgtccgggttctggccctcgcccagccactgcaagacggcgggcagaatgatgcggttgattttggccgcgcgccccacgccggcggtgagcgcctgcacgtggcggatggcggcgtccgggtcgccgaaaccgatggattcgaatcgttcctgtgctgcctcgacgctcaggacgatctggtcgttctccatctgggcgttgaccggcagcatcgggcgatagtagatgtcgaggtgcaggtggcgtacttcgcggcgggtgtcgtcgtacttgtcgacgagttcttccgggtgcaggccgaatgcgcgggcgagtcggcgcagctcctggttctggttgagctcgtccacgtcgatgtcgcgcttcttttcgaggcctccgaccgaggcccggccgaggtccgggaacaggtgcgtgcgcttcagggaccagatctgctggcgatgttccatcacgcgctcgaagcggtagtcctgggacatgcgcacggcctgcttgcgcgagacatagccgccttcggacaggcgctgcagcgagtcgagcgtgttgctggtgcgcagcgattcgtcggtgcggccgtgtacgagctggagcatctgcacggtgaattccacatcgcgcagaccgccgcggccgagcttaatctcgcggtccttcaggggcgcgggaatcaaatcctccacgcgcttgcgcattttctggcagtcgtagacgaagttcttgcgcttggatgcgctccacacgaacggccgggtcatgtccatgtaggcctgaccgaggtcggggtcgccggccaccgggcgggccttgagcagcgcttggaactcccaattctcggcccactgctcgtaatagttcttgtgcgaggagagcacgcgcaccagcgcgccgtccttgccttccgggcgcaggccgccgtcgatctgccacagcggctgctcggccacgcccatgatggcggactggcagacgcgctgtaacatggtgcccatcttggtgcccacgcgaatcagcgtctgatggtccacatccttgtcggccggttcgaccacgtagatgaggtccacgtcggagacgtagttcagttcctgtgcgccgagtttgcccatgccgatgatggtgaagcgcacgtgctcgctgccctcggtttcgtggcgggcgatggccagcgcgccttcgagcgccgcgtccgcgaggtcggacagttcgcggctgatggtcggttggatggaggtcgggtcgtccgccacggcatcctgggcgatgatggcggccagttggttccggtagctggaacgcagggccgtggccgcttcggccagatccttggaggcgacgggcatggccggttcgtccgggtccgcgccgaccgccttgagcagacgtgcacggcgttgcgcgtgattgaacagatggctgttacagttgtcgactgctgccgcctccacaagctgcggcttgaagcgcatgaacttgcccatcgcgtcggagacgccgagcaccgtgaccagacgcttcagggcgtcgttgtcggggatgacgtgttccagatcgcgctggctggattgcatcgcgttgacgatatccacgaaattgctcaatgccatatcggggtcgcaggcgtgggccagcgcgctcagcagttcggcgcatcgctcatcgggaatgtcgtccgccttgagctggtcgaacaaggcgcgggccttgtcgaggtcttgcagacctgccctgatgaggtccatggagctgggtttgaagatcgacgattccataagattccactatatacgctcatgccctccgaatggggcatgagccgggaaggagtcatcgggcgacgctgatgagctccgaggaatccatatcgtaatcggccatggcgtaggaacggatggcggggtcatcataggtgttcatgtaataggtgttggtcttggacgaatatccgctggtgaacagcgtgcgttcgaactggccgtcgcccatcttcgccatgccgtccaccatctgcacggagccgagggtgtggaacaggcgcgacacattggcggcttcatcgttctgctgcgggtaatgcgcgttggtgtaggccacacgaacgaagcgcgacggggaactcacgtcgcccgggatgccatgcatgcccacacccgcaccccaggcggtcaaggaggccttgccccatgaagtcggttcggccatctcgttgctgacgcacatgtagttgcgcaggttttccatatggaagtcgaacgtcggctgattggtcagcacatcgacgtcatcatgatgcacgtgcatgccatcggccatctgctcgacgacgatgctgcgcttgccgtcgccgatgaaccagtgcagcagagactcctgctgtcccggcacgatctgggagacgagcgtcacgttcctgagcgcctcctcgacctcgtcgacggagtcgaaattacgcgccacccacagcggaaattcgaacgtggcgacgttttccgtgccttcgaccggttcgtggacgaacgaggcgtagccggggaaattcaagccggcgatggccagaccatgttcattggcgcagtcgaaatacatcggcctatcggccatgaccacacccacgccgatcaccgcgttcggcttcgccttgccgcccgcaccaaacaccgtgtcatagtggtagccgcgcggagtaaccaggatggtctccccatatgagaaactccagtcgagattacggccgaaataggtgttgccctcatcatcggagaaacggacaccagtgcacataacggactcccttccatcgctttggttggcttgcacgttcatgatacccatcggccgctgggagaactctgggtttcgccagcagatcaacgtgcggcgcgacgcattgagatgcgccgcgccgcgatacgcgtcaaccttgcgtaccgcggaacaacggttccgcattgcgccagatacggcgcgtggtggcggggtggttcatcgaatacaggtggacgccgtccacgtcgtgggccacgaggtcggcgatctgctcggaagcgtagaggatgccggcggcacgcagggactggatgtcgtccccccacttgttcagcagggtgttgagcctgtccgggatgcgcgaggcgttgcgctcggccatgcgacgcacggacttggctccacgcaccggcatgatgcccgcctcgatcggcacggtgatgccggcggcgcgcgccttgtcgaggaagcggtagaagtcctcattgtcgtagaagagctgggaaatcaggtgagtgacgccggcatcaaccttgattttgaggttttcgatgtcctggtccagcgagtcagcctgatagtggccttccgggtagcaagcaccaaacaccttgaagtccggcttcacggagcggatgtatgacacgaggtcgctggcgtggttgaactcgccgaccagctgctcgccgtcgatgtagtcgccgcgcagcgcgagcacggcgctcacgccggcttcctcgaacatgtcgagagcctcatcgatcttggccttgtcggagtagagcgcggtcaggtgggcgactgcagggatgccgtattccttgctgatcgtgtgggcgatgcgcgcggtggcggtgcggtcggaatgggtgccgtgaccgtaggtcacggagatgaagtcggggttcagcccttcgagtccgtcgagggtgtcgtagatggtgccgacaggcgcgttgcgcttcgggggaaagacctcaagggtgaacatcggggaatgcatgctgatttccttacataaacccgagctccctcatccagagggagctcggtgatttccgctacttgtcgagcttggcgcgcacggccttggcggcggcgaccaggttctccaggctcggccaggtctcggcgttaccacgggtcttcagaccgcagtcagggttgatccacaccttcttgacgtccatcttgtcaaggatctcgtagatacgatcctcgatctccttctcggaaggaatacgcggggagtgaatgtcgtagacgcccgggccggcctcggtctcgaagtgcgcgtcatgaatggcgtcgagcaccaccagatcgccacgggaggcttcgaaggagatcacgtcggcatccatcgcgtcgatgtcgcggatgatgtcgttgaactcggagtagcacatgtgggtgtggatctgggtggtcggcttgacggcggagtgcaccagacggaaggccggaacggcccagtcgaggtacttgacgtgccagtcggacttgcgcagcggcagcttctcacgcagggcggcctcatcgatctggatgaccttgataccggcggcctcgagatcgagcacttcgtcgcggatggcgagggcgagctgcttggtctgctcctcgtgggtgatgtcctcgcgcggccaggaccagttgaggatggtcaccgggccggtgagcatgcccttcatcacatggtcggtcttggactgggcgtacgcggaccattccacggtaatcgggttggcgcgggaaacgtcgccccagacgatcgggggcttgacgcaacgggtgccgtaggactggacccaagcgttcttggtgaacaggaagccgttgaggttctggccgaaatattcgaccatgtcgttacgctcgaactcgccgtggaccagcacgtcgaggccgatctcctcctgcttcttgatgacggcgtcgatctgggctttgatgaactcgtcgtaggcttccttggtgacctcgcccttgcgcagcttggcacgctcggcgcgaatctccttggtctgggggaaggagccgatggtggtggtcggcagcagcggcaggccgagggcctcgcgctgcagggcctgacgctcctcgcgggcaggctgacgcacgtagtcggcgtcggacagcttgccgatgcgctcggcgacggccgggtcggcggccacgcgggtgccgtcgaacagagcctggttggcggcgagggcggcggatgccttcttctcgtcctcggtggcgtcggccagggcggcgacttccttgagctcgtcgagcttctggacggcgaacgcgaagtgcttgaggtcttcggccgggatgccggtctcgccttcggtgctgaacggcacgtgcagcagggaggatgcggtggagacggccacgttggcggtgacctgcttcagggcgtcgaccaggccgagggaggtggcgtagttgttgcgccagatgttgcggccgttgatcacgccggcgaagatggtggtgttggaggccacgccatacttggcgacggcttcgaggttctcctcgcgaccttcgttgaggtccaggccgatgccgtcgaagccgagcaggttgacggtctcgtacacgtcggcgatgtggccgaagtaggtgttgagcagcaccttgacattgcccttggcggacaggatcttggtgtacagggtcttgaagagttcaacgtcgcccggctccttgtcgagcacgaggtacggctcgtcgagctggacccatgcggcgccgagctcgttgaacttggcgagcacttcggcgtagacggcggccacggcgttgaccaggcccttgtcgagctcgagttcggtggcttccggggtacgggcgagcttcaggaacgtgtacgggccgatgaacacgggcttggtgtcgatgcccagcgccttggcctcgttgaactcgtcgaacggcttggtggagttgagcttgatctccgcggccgactcgacttcgggcaccagatagtggtagttggtggtgaaccacttcttcatcggcagggcggtcacgtcgcccttgtcgccctggtagccgcgggccatggcgaagagcgtgtcctcctggttgtcgaaggagagacgtgcgtaacgctgcggaatcacgttgagaaggatggcggtgtccagcatctgatcgtagtagctgaagtcgttgctgggaatgaggtcgatgccggcggcctgctgcagcttccagtgcttggcgcgcagttcggcggcggtggccttgacggcggcgaggtcgttgacacccttccagtagccttcgatgatcttcttcagttcgcggttctgcccgatgcgggggaagccggagacggaagtcagagtggacatgaatcctccaatgtatgcgttcgtaacccgacttagggtagcaaaacatccggattccggcccttataaatggccgcagagtgtcgttatagatggaatttatatccgctttagtcgaagtctttcacattgatgaccgcgagcagttcgccgctgtgcacctgccattcgtcgaacggtttgttcgatcccatgatcacgatggatgcgggcgaaagtcccaaattcagcaggtcgagtcgttcgccgtcggagtcggcggaggcgagccattgggcgctgatcgacacagtcggctcgtggcccacgatcatgaacacgcggttcttggccttgacgtgggcgagctcgtcgaacaccgcctgcactcccccgtcatacaggctgatgcggtagtcgacgattggcttgtcgccaaaggtcttgagcatgcggtccaacgtctggcgcgtgcgggtggcggacgagcaggagatttggtcgggcaccagtcccagcgactcgatgcccttgcccacggccttcgcctgtttcagacctttgtcggtgagctcgcgctccgagtcacccttgtcgccgaacggctcggccttggcatgcctcatgatgatgagaatatggtcgtatttcttcgccgctttggcgactttgctcagcttgatgcccatccgtggctcccttcacgaaccgtctgcccggtgtggcggtgtggtgttgcttccagtatagaggtgtgtgagcgttcacaaactcatcgtttggcggttattcgtgcgtgttgccaagttctcccacctgacggtcgaggtcgcgcaacaccttacgtagtttgtggtcggagatgtcgcgcagttccagttcttcgatctgcgcctcacgctgttcgtcggtgagcgagtcgatgtcggtctgtgtgtccttggtcacgcgatcacgctttctgagcgcctcgaacccggaggccatggcgcgcgagataacaaggaaaccagtatggccgatcatctggtggtcggggcgtacggcgaggccctgggccttccatgtgcgttcgaacgattcctggatctgcggctcggtccagcagccggccgcgcgcagggcttcggccatgcggctcatctgcgtggtggtagttacgtaactgaccaacacgccgccgggggcaatcacgcggtatgcctgctcgagcctgttccacgggtcgagcatgtcgagcatgatgcggtcgaaccagtgttcgggcagttcggcggcaacggaatcgaagtcgccggttttgagatcccaccagctgggggcctcgccatagtacagcgtggcattggcttgggcgaccttggcgaattcggggcgcagctcgatcgtggtcaggtggccgcgctcgcccacggcgtccagcaggttcacgctcatcgcgcccgagccggcaccggactcaagcacgcgcatgccggagcggatgtcgccgagctgaataacttgggcgatgtccttcggatacatgatctgcgcgccgcgcggcatcgaaagcacataatcggccagtcgcgggcgcatcaccgcatactcccagccgccgatggcgcgcgacgatttccacggcttgttcttgtctttctcggggtagacctgattgacctgtgcctcgcgcttggcatgcacggtgaggattacggtgccttcggtcttgccaatcacatcgtcatgcagaatcaggccatgctcggtctgcgtggagccgccggccacaagctgatcggtgatcttcttgcccttgcggtcggtgaactgcactttctcgcctgcggtgagaggcccgcgcctcggctccataacttgctccttgcgtgctcggtgggtcaatcgctacaagtctaatgcatgtaagctcgctggtgaggtgatgacgatgcgaatgcagatgacaagccagatcgatgccggcggcaatgaccccattttcctgatgttccacggttacggcaacgacgaaagcgagatgatgcggattctcgacgccgtatatgcgccgacgcgagccgatgcggccccggccgcaattgccgccgtacccagctatatctcgttccgcgccacctacgcgaggccctatatgggcggcaattactggtatcccgacggctgcggcgtggacgagcgccaacgcgaatgcgcggcggtcggggatgcggtggcttcactgctggatgcctcggcattcgcccatcgcaggaagatattgatcggtttctcccaaggcggttatctgtcgtatcgtctggtcaaggtgcatccgacgttgttcgatgccgcgatcctgctcagtccttcgttcatgggcgaggaacaggcggcgcttgactcccctacccgattcttcctggcgtatggcgcgcaggaccgcacgattccgctgcccgaccagcaaacggcccatcaggtccttgaacgggccggacatctgacctatcgcgagtattccggcatggcccatgccatctgtgatgaggaaatcgccgatatccgggatttcctacgtaccatatgatgccggtgagtgaaacacgggttgtcgagtggttccgcaatcacaccaacggattgccggctgcctgatacagcgaccaccagtcacggcgttcgagttcgatatcggcaccggccgccatctggcggatgcgctccggtgtcattgagccgagcaacggctggataccggcgggatgacgcagaatccaagcgacggcaatgccgttgggcgtggaaccgtatttgccggcaagacgggtcaattcggcgttcagctcggggaaatgctcgttgccgacgaacggaccgtattccgtgccggattggaatgggcaccatgcctgaatggtcatatgcttcagccgtgaataaggcaggatgccgccggtgcgatcggctgcgggatcgctcgccatattgaattggatttcagcgtcgagcatctgtgtatgcatcaggccgaactgcagttggttgatttccaatttctgacgaaggccgctttgcaatagttcgatctgccacgggcccatattgctgactccgaaatgacgcactttaccgcttgattccaacgcgtcgaatgcttcggcgacctcgttcaactcaaacagcgtgtcaatacggtgcagcagcacggcgtcgacgtaatccgtctgcaaagcctcaagctcgtgatcgagtgcgtcaatcagatgcttggcgctgaagtcatatccgttggcgccgccatcgttttcgccgaaactgtagtcgatgccgaacttggtttggatgaagatggtgctgcggtcgagtcctgcgtccttccacgcttggccgaaacgcttcgaactggcgtgcgcggcatgatcatggaatccatagatgtccgccgtgtcgaaatagtcgatgccagaatcatgggccacggccacggtacgtgccgcatcggcggcatccagcgcgtccatgcgcatcacacccagcgccactcgtgacgcaatcatgccggattgtccgatttcctgagtcttcatagtgtctcatttctgttatcgtgaatcggcgaacgggcactgtccgcctcgttgccgggcagcaatctccattgccgcggcttatgtcaccttatcgcttgaagtgcacttgaaggcaactcgcaggcaggcagcgcgcgctgccgggcgcgtcttcgcgtcttcatgtcttcgctgtgatcgagacatcgttgtgccgtgatcatgcctatttcttgtatgatgacctctatagcaacagagctagggggattccatgaacactaccgattcatccaaagtcagtgatgccaacgccggcgcaaacaatgtcatccatatcccgcacaatcccacgcttgccggattggccacgctgacccgcaacgtggcgtacaagaccggggccgataacctggtgatggatatcatctcaccacaatccaccggcgatgacgatgaccgccgctaccccaccgtggtattcgtgcaaggcagcgcctggaccacgccgcatcgcgactacgagatcccgcagctctcggctttggcccgcgaaggctttgtggtggctacggtgaatcatcgcgatgcctcgagcgacccccacgacatgttccccgcatatctcgaggacgtcaaagcagccatccgctatctcagggcaaacgcacgtcaatggcacgtggaccccgaccgtctcggtatctggggcacgtcgtccggcggcaacacgtcgctgctggtggggttgaccgccgacgatccgaggtatgaggatggtaccaatgccgatgaaagcgatgcggtgaagtacgtggtcagctgcttcccgcccactgacatgcttgaagctgtcgacgcattcgacgatgagaccaatccattccggctgtattatttcggcccgttcgcggccgtggtgggtgcgacccatgagaccggcatcaatgccgaggtccgtcagcgtgcggctgatatgagtccctacctgcaggtgcgggatgaccagcagtatccgccgatgctcctgttgcacgggaccgccgacaccgtggtcccctatcatcaatccgtcaagatgcgcgaccaactggtcgagcacggcgtggacgcgcagctggtgctagtcgacggcgccgaacatgagtacgatttctggagccagcaggtcttcgacgtgatcttcgatttcattcgtgagcggagctgaacacatcatgcttttgggcagatagtgcgacccaaacatcccgttgtctatttagaagtgcaacctcctttttaaaggatgttgcacttctaaatagacaacgggccgcgtgggtcgttcgcccggctgccctacgatagagggtgtcgccgtattcccaacggcgcagtccgtgcccgggacgaggggctcggccgaatggcgcgacgatgcgccttgaagttaaggagtcatgatgaagtcatggagattcaccggcaccaatgaaccgttgcagctcgccgagctgcccgagccgaccgccggaccggggcaggtcgtcgtcgacgtgaaggcggccggcatctgccacaccgatgtgggcattctcaccgatccgggctggatgacgatgctggcgcaggtgccggtcacgctcggccacgaggatgccggcgtgatcagccaagtcggcgagggcgtggacgattttcaggtgggcgaccgcgtggcgatatgcccgaccacgccggccggctgccccgggtcctccttcgacggcggattcggcccgaagatcgtggtgggcacgcaggcgctggtgcgcattcccgacgaggtggatttcgtcaacggcgccgcggccaccgatgcgggcatgacctcgtacgcggccgtggtgcgccgtggcggcgtgaaggccggcgacagggtcggcatcatcggattgggcgggttgggccagatcggcgcccgcgtggcccatctgctgggcgccgaggtgcatgtggcggagatcaaggaggatatctggccgctggccaaggaactgggtgcggtggacgcgcgccggtccatcacggactatccgaagggattcttcgatgtgatcgtcgacttcgccggattcggcgacaccaccgccgacgcggtggacgtgatcaggctgggcggcgtggtggtgctcgtcggcatgggccggctggaaaccaccatcgatgccaagtcgctcatcgtcaaccagtgcgatctgcgcggatccaacggcggcacgcccgatgacatccgaggcgtctacgagctgatgcgcaccggcaagctcacgccggtcaccacgaccgtctcgttcgacgaggtgccggaggcgatcgaacggctggagcgcggcgacgtggtcggccgtctggtcatcagctacgagtgagggatggagtcagctgggacagcgtacttcggctatgctgtcccgaccattcgcctagaggaatggttcgtcggttcacgccctcgctggcgggagcatgagccgactcacgatccggctcggtcagcctccggcaacggggcgtgggccgggggtcatactgcgtaggctgaccagcggccgtgggtgtgctgcacttcgatcggcatgccgaacaggtcggagagtcgctcgtcggtcaggccatcctccagcgggccggcgtagacgatggtgccggcggagggattgcccatcgcgtcgatgccgtcgtcggtggcgtcctcggcacaatcctccatatccgcgtacttcgcgaccgtcccgcgatccacatgaagacgccgcgctatctgcgcacgcgacagcccctgccggtcgagtctcctgatatcttgcacaatgggcatcggtatcgccatgatcctttccttcccgagcaccggccggcggcaaccggccgaatccaattcgaatcgcaactcgggaatatacaggccgcggcaccgatgcctctcacatcaccgggaaacgatgacggcaccggggaaaaccatcagcccacactgcggaaaaacactgccgaacccgcccaacaaacattgaagcaatacatccatgcctccaaccccatccgactggcaacacctcacaccacagccacccatcacaaacagcgaaaggcccaattgttgtcatgtccgacactcacctttctcattcaactcacatcggcaaatgtcatgcacctatacgcatcttcgcaaaaagttatcgactttttcatgtatatctgagaaccacaaaattcaaacctcgaagtaatgcaataaaaaaactgtaacatgtagatatgtacaattgaatatgccggcgtaagataacagaaccacactcatgtatagagtcaacataatgaacgacaccatgtataagttcaagcattatgaggacaatccatctcttctccaccagtatcgacaagtacgaacaggacacacagatcagtctgttcgataccgccatccctgcgcaagagctcaaggagatgtaagcttgttttgaactccagaggaaaggcctcagttgacgtattcgcagatcatagtgtttgtgttcaattagttgttgcgggtttagtcacgatgatttttcgggtttaggcagagcatgccgaccacggaatggtcttaactggatggtgcttgtatctccgccagaaaggaccggaaaggattatgatcagcatgccccaagtacagtctatccgtcgtttgcggcggaacggggaatccgtcgcgtcgatcgcgcggaaaacacatgtcagcgagccgacggtgcgtaagtacctcgcgaaggaggatctgtcggccgtgccgtcggtgagaaagccgcgcgcgtcggtgatcgacccgtatctgcccgtgatcgagcagtggctcgcggaggatcgcgcgaactggcgcaagcagcggcataccgcgaccaggatctgggagcggttgagggacgagcatggcgcggaggtctccctgtccacggtgacgcgggcggtggcgcggctcaggcgtgagttcgcggcggagcgtgatgaggcgttcatggatctggtatggcatccaggcgaggcgcaggccgatttcggcgaggtcgacgtgctgttgcgcggcgtggtgcagcggatgcatcatttcgtgcttgatttcccgtattcgaacgtcggtctggtgcagttgatgccgggcgagaacgctgagtgcacgtgcctggcgttgcgcaacctgttcgagtggctgggcggtgtgccggagcggatcgtgttcgataacgccgccggcgtgggccataaggggtacggggagcgcgagccgcgcctgacgcacctgttccaggccttccaggcgcattacgggttcgattgttcgttctgcaacccgtattccggtcatgaggagggcgcggtggagtccaaggtcggcatggtgcggcgcaagctgttcgtgccccggccgagcgtatggagcctggagaacttcagcgccgggctgccggaccggtgcctggagctggccacgaaaccgcattgccgcaaggacacggaggaacgtggcctgttctccgaggaccgtgcggcgctgctgccgttgcccgggaagcgtttcgacgtggtcacgtggcggcatatgaaggccgaccggtacggcgtggccgcgcccggggacggcatcgctgttccgcggaccgggcgaacgcgggcagaggggtgatcgtgggcctccgcgcgctcgaggtcgaggtcctcgactcgtcgggcaagcatctggcgacccatcctcgggcgtacggccaggccagcacgaacagcgaggacccgtccatgcagttggcgctgctgtgcaacaagcccgcgtcctggcccaacagccgggtacgtgacgcgttgccggacccgttgcgggaatggctggatcggcaggacggacagacacgcaacgaggcgctgcagaccctcaaacgcgttgacagggaatccgggtgggcgaacgcggtcgaggcgatgctttccatcctcgaatcgaccggcggggcggaccgcgccggtgtcacactgctcgcggccaggctcgccgagggcgtggcgggtatcgaatacgacgatgacaggccggatccgggtgaatacgacatcgcgttcaccgcggacgtcggcgtgcaggaaggcgggcgatgaacacgaagacggacgaagggctctacgagaaggcccgcaagctgttcatctccaaggcgagcatcgacgaattcgccggctgggccacgccccgccaggtcgacgccgtccaccgcctgctcgacacggaactggcgaacagggaacgcgcgaagcacgacaggctcctgcgccgcgcccggttccccgtcgtcaagggtctcgacggctacgacttcacgaacgtcaggctccccgacggctacatgctcgatgagctcctagggctcggtttcatcccgcgcgcgcaggacctggtgttctacggcaagaccgggcgcggaaagacacatctcgcgatcgggctgggcatgaaggcgatcgacatggggctgggcgtgcggttccatcagaccgccgagctcgtcctccagctgggcaaggccaaacgcgacggcacgctcgagacgatgctccgggacatcggccgtgccgacctgatcatactggacgagttcggctacgcacccttcgacatcgacggggcgcgcctgctctaccggatcatcgcgggcagctacgaaagacggagcatcatattcaccacgaacatcgagttcagtaaatggggcacggtcttcgcggacgacaaactcgccgcagcgatcatcgaccgcatcgtgcaccacgggcggctcctcgagttcaccggccagagccgccgcgtcagtgaggccctcatgttcggcaggaacacctccgcgcaaccggaaaaataaggaaaatgcatgcaactgcctaaacccgaaaaaaatacatgactaaacacgaaacaccgacttgacgaaatacagatcatagttttgggtaacgggtttgatttggcacagcatatcccgtcgtcttattctgctttcttccgagataggtacacgaagtatcgggaaagcttcaagaaggcgattatgccaagagtcacctatcaagtgaatgtcgaggacccctgcgtgtgggactaccttttcattgcttggcatgatacatcgaaaaaactcgatgattggaaagacgtggaaagcgcaatcaaagagtgggtcatcgggaaaggcagcatcagccttaacgatgctctaaattactggaccatcctctcagtgaagccatcacgtcctgatgcggtggtcaacgcatatctaaaaattcagaagtatgttaatgagcattcgagtaacatcgatttttctgtacttaattacttcaacacttcagcggatttggatgacgaaggttcagaagatccagtggaaattctccgggtgaaactgcttgactttttcgcgaaagaacttcacgttattgaagacgccttcactcgatacctgatacgagtccagggtaatccctcatatgattctagcagcagaaacatctataaagcaatggcggaaaccggaactgacattccacttgatgagcaatcgaacgtcattctatccttcaactacacgactccgctgcttcagagcccgcgagaagagtccatttactatcaccgcaacgtgcatggtgacgttgatcgcttctcagatgaaagccacggaggctatgattatcacgtcatatttggcattgatggccaggctcatatggatgagcctggcgtctatcaatttacaaaaaccgccagggtgttgaaattacggagacagtatttgacaggggaaatggcaggtcgctcaatattcgacgcacaaagcaatggcagcgacatagctgaagtcaagtttttcggccattccttgggagaagctgattactcttacttccagtcgctatttgaccaaatagacttatacggcggagaaactaaactgaccttcttcggtacgttgtcgtatcctgccaactacgatgcaatcattcgattgatgacagaatacggaaagaccatcgtacccgaagcgcacggaaggaatcttctccataagctgctgctcgaagatcgattgaagatagctacatttgacacgaaaattgtagcataatcccgttccggaagagggaaaagcgatggggaaacgaatgtaagccatatggacctgttccacaatgagtttgctgccttaggataaaccgcaggtctgaaggttctcgaagaggtttaagttacctcccattttgtctagaagcctctcacctccatcagaacagcaaacatggtcatgtactgttgcaactttacatttgttgaagattgggactaaattctaatatgaggtagctgtttgcagtcaaggaggacgctatggtttcagatactaaagcagtaaagtcggtcggagaattttggacgtgctgtaagttggcgatgaatggttgggctccagcactaacgagagacggtctggaacgaacggacatacttgcggagagaagccacgctccttttgatgtcacgcaaattagcgtgcaggtcaaaacttcccgcaatgaaagatgggcgttaaaccctgccaagatcggctctcaacgtagcttgtatgaatggttcgtcttggtcggatggaatgaaaacgagcagaccctgtccagctatattgttcctcggaatcatgtatctgctggagcatggttgggacatatgagatggctgaccgatcccactgctaagcgaaatcgaaattgcgggcctgaacaagcccgtatggatgtttcggttttcggcgattacaaagaccgatgggatttactgctgaagccaactagccagactccgatattgcttcctcatgaacttcatgaatttgctctaattgccgatgcttccaacagcaagttgcctgaatggcacccttggtcgggagacagcttacctgaatggtgattaaaacgcatagccatcacgtttttccgtgatggcttttcttaagctcggattcgggtatgagaagccctcatggtcgaaagtcgcaaggtctgaatgtcgacaaagacggaatagccacatcttcagacaccatttcatgcatcatcagatgcccaatttcatgagcaatatcgaaacggacacgttctgcagtcttactggtatctaccgccacatacggcacaccatcgaacataaaactgaaagcatccacgtctcgtccgacagtcggcagactaaatagtcgaatgccatgagcttccgcaagactcgtcatctcgggcaacggattctcaccatatcccaaaatcaacggaagaagccacagaaccatcagtccagctccggaatcctcatcccatcacatgccactgttcttcatcagcttctccgactccaaagtaagtgacccatcctcggccagcagaggagtatctagcacggccttgattgatgctgcagtggacgcagctgcggcaatagtcttcttactttcctgacggaattgcgaataatccgttccctcggtctttatgatattttccatttcaagaattgaaggcaggaatttagcatcaagacgggcaagcaaagcgtggaacatatagctgcgtctacgaatggcaacgcactggtccgcaccggccatcatctgctcacaatatttgcttgcctcagcagactgggtcttcgcttcctcaaggtttttaccacccttagcaccgatgataacgcccatgaccagcaatgcaggacctgcgactaaacctccaagtacagcggcaccaccggccatgcccaagccacctgcggccaaggaccctcccccgaagaacgccaacgtggcgttggaagcagccacaccacttaatgcactgatcgcagttcctgtggaagccgtggcgagtgccgacgcggcactatatgcaccaaacgcagccaatgcaccgctggccgccccggtcacaccgccttccagcaaagacgaagctatgtttcccatggttttgagctcagcaaaagccgctttgtctatgcgcagtttattgagctcatcaagcccttcggacgcggtgaaatcaacatttttcagctgttgaaaagcatcaaggaagcgctgaacgctcccatccaaaataatgactttctctttgcccaaggcattcagggaatctgaacattgcctacgaagcttttcgaggttattagctgcccatcgaatgcgtgctccggaattgtcgttaagctgattcgccgtgtgctgatcaagactacctttggcagccatacccacgcctgcggtaccggcagcagcggccattccgatgaatagtggaacaacaaaaaatggcatagtgaattccttcctgggtttctcttatttgcgtccaaagaggccaccgaagaagccttgtacagcattggccgcatcgcccgcacgttttgcagcctcattggctgcgtcacccgcacgtttcgcaacctcattggctgcgttgcctaccggtttcagcactgcatcattcaccggcttcagcgcatcgccaacttggttgagaacaggagcaacattattgtcaaacgtatgcttcaccgcatccgcggctccctgagcaccctgctgaacctgatccacaaccggagcgaccaccgagtcaacggcatccttggtctgatcaaacacgtccttctctggaaccatgacttccggggctggcgctgccgtctcgtcttcaatcagcaacacggcagcgttttggagaacattcacgcgctcttccagctgatccaccatggggcgaacttcactatatggcagttcggaattgctgatccagtcgagctcgcctcgcacgtcatacgccgcgcgcataagatgttccatttcggggtatatggaacgatcggcaatcatcgtccgggcaatatgtctgatgagtctgctttctactgcatcatattccccatcggcgaaggcaactgacaacatattccacagaagcagccttggtgcaattcctgcagctcttttatccgttcgatgcgacaagactgcatcaacaccctcaacaattacgtcgtagcgatcatcggaatcgtggcactggtttatacgctcatcgcacgaatcgataatctctttgcgataatcatggaagtgctttgcatccaaattgtcacctatatgatcgaatagtgcgcgttcgtcgtcacggactgatccatcgacagcaatcagataataaaatgcttgtaatgcatcacgtgttttgatgtacttcattaactggctcctccttataaaacgaaattgtcgtctgacgccatcaaatcatcaaactcctgctgagtccgaaaccttggcaagtatcccaaggattcttgaatttcggcgtttccggtcaaatatccatcaatatcattggaaatcaacgcttgatccattgcatcgaatgctctattaaacaattcatcatgagtcgccagataattctcgacatccctagacatatcacgcctatattggcggatgagctccaccgcttccgcacattcgcgttccacacgaatacgctcctctttcgccagctcatagtcatgcagagcagtggataattcctcatatacggcaacagctgcagcatatcccaaggtgcttccagccataccaaccatcgcagccataaaagcaccatctgcaggtactgcggccatcgccacggcaacgcccatcactcctccgagctgccccattccctgctggccgaggcgctctatacaaacagctccagtaatctcgccgcggcaatacagtgcaaccaccttggaaacatccgttacagtggagaccatcgtagctgcaacgttcgttctcgatagactacgcagatactcgctcgacgcgttttgcatggcacccttaatggcagcgccggaaaaagcggtgacatagccgaacgccgcagccaagcctgcatcgacgccgacgtttctcgctgcctccgctggctcaatagagccattaatgcaggcaaccatatttcgaatcagagaaacaccaccaccaatcagcgcaccattccttgcctgctgcagaccggctttattggcaactctggctacatctttcgccaccatgcgtctgggatgttctcgcgcatacaacgcttctcgcttggtgagtccacttttccgcaggcttttcttaatctgtttcagatcatcgatttgctgctgaatagcctcagaattcttgccggcaagccgacctccatccagctcgccctgaagttttcgtatctgttcgttgatgccgtcaggcccatcacccatcagtacatcgtaataatcatccggaataaccatgctgacgtctgcatcacgatattttgcatatttcttgcttttcaacttatcaagaagctttttcgggctactgccgacgaacttcatttgagcctcagagccgatgattggtttgcccaagtcatccacttcgacaatgtccacgatggggtcgttcgacacttgccgtccatctggatgcttcacgtcatcatatcgtttgaatcgcgtatcgttgccagcaatgatgttatcggcgttcttcctggctaccgcctcaacctcggcactaaaacccgcttgctgagctagattctgctttttgaattcattgctagtctccatcttagcaatggacttcaaggtcttaggaggtctggaattctcatcagcaggtttctctctatcacccgcataggccgctaaatgttccttgatggcagaaccaaagcgttgcacggtttccgccgcaacaccttccagcgcctttcccataatgcgacggttttcgtcttccttgcgttcctcgttatttcgaccgatatgagtttcatcatccgccataggatgccccctcgcatatgccacatctacgccaaccacatatatcagaaaaaaatgttctaatactgtaatcagttcttcagccgtgacctgttaataatcctacattatagcggcagaaaaactcaccatatcgtcatcctcgattaacgattagatagacatacttttgcgaacaacacaggcaccaccgtatggaatgtgtccaacaaccgttggcaaagccaaatccctcacactattcgaacccgaatgcgtctcaatctctgtcccccactagcggcgcatccccgtccaaagcagtctgggcgtcgagcaagtgggattcgatgatgcgcatccagaagaagggagttctcggcaatgttcagcggaacgagacatgggagcgtccagtgcttgggcgtgatcgtggagaacagtaggcagggagtcctcactgttgatggtggcgtactggccatcttcatcgcatacggaaacagtaggttgctactcaccgcgagcgccttaatgccacgccgactccgtccgtccaagcacatcctcaataagctcacgcccgcgcaataccgccagccactgagcgggaatggcatcgaatccatatttgatgccggccaggtatccggcgacggcggcggtcgtgtctgtatcgtcacccaagttgacagcggcgagcacacaactcgcataatcatcggtattcgcgaggcaccagagcgccgcctcatacgtgtctttgacgaagccgctcgaaccaacttcatcacgcggcataccgcgtagcggttcatcatccagctcttgcggccatatgcctttgatgagtccgtcgcgcaacacatccaccatgctcgaacaggcctccatcgagattgcatgagcgtgcgtgattgcagatgcggcacgtacgtcatccgcggaagcatccgcgaacgccaacggcatgatccgcatcagtgagccgttgccattgtctcgttcaccgcttaagcccacacgctgctgcaacgcgatggagaccgttcgcccgcaatcgaagactcgtccgtcaatcgcgtattcgccattactcagccatgccagatatcgctctcgcatatcttcagtattgacttgccattcattggcgatcagcgagtccaatgtggcgagcatcatgctggtatcgtccgaccatgtgccaatcggctggttatgcgtaccgtatcccgtcataccttcgcatcggaaggtatctctcggcatgaattcataaggcacgcccaaggcatcaccgactgcttggccacacacggctgctcttaactgctcgaatgttccgttcatcattgacgcctttcgatttatgcccctcactctacatatgtttcaacgataggtataatcgggcccactgagcataagcgaggtaggtaatgagtctaagggaattaaggttaaagcgagggctgacacaaaagcaactagccgataagctcggctatacacgtgagcgtatagccgctatcgagacaggcgcgcggcctatcggcggcgtgagtcttgataaggccattgagatatgtgacgtgttgcgcgtgagtaatcctcgcaaactgttagaggctgagaagccgaaagaaaacactagtgaaagctagttgtgtgccctaactcaatctttgagcgtaggccggttagcggcttaatcaggtgcaatccctgactacgcacgacggcggcactgccgctacataaatgccccgcaagcactagcaatacttgcggggctgacctttatcaatgcactcaatagaggcagtacccaagtgtaccgcctcacacggaagtaaggaaccatgactgacttatcctggattaccaagcaactgaccggcgaaactacaaagacgctgacagcacaccgtacacatctgtgtgagtatcgatccgccgctcagaactactttgcagagcgaaaacacggataggtcaagggaataccccgctgaatcgtcgtcagcgaagcaactcagagagttagtagaggaaaagcctcgctaagtggccttttagtagagcaatgcctcggtccgcccgaggatttgcctcactgagactgctcagcgaagcaaaagctcgacttaaccgcagaatcgcttcactaaccgcctatcagtgagtcaagatctcaattcactagaggatttgcctcgctaatatgcaggtatgctcaatataccgacgtactgaaatctccacgaagatgagaggaactcaaatggcacttaggtttctcagcaccaaagaagttagcgagcgcctcggcgtcaagaacgcatcagaatataagctgccggaacctgacgtatatatggcactactaaaggttagctacctgaacaatagatgattggaatgcaagccgtcctggtcgcggtgttggcggtggaaggtccctcaagaagaaagactagacgcatcagaattcttcagcatcgtgttactcacctgattctaatcatcttcagccccagcttctggcaacgaaaatccatcttgactgaagtattcaaccctcttaatgactgtttggtgggcatcctcatcattgccccaccagcgccaaccccattcagacggatctggcactgattgcctgcaatccttagccatacgccgcagtacacgtggatcgaatactcgtccaactcgaaagttcgtcagtcgattacgtggaatgaacatacctaccattcgccattgcttacgcgctttcccaatcacaaacaatgttccaccgtcatcctttaggctcgtcctccattcagtcgacacatacacttttgttccaggactgaatatcttcgttccatgcccaatatgatggtcaacaccaacctcatgctcatctacgacatttgctattacgcaccaagtccatggctcttgctcatcgttctgaggaatacacatgacaaccccacagtcatcttcatcgccgatcgcactgtttgcgtataccaaaccgctacttctctaccagttagccagtggagtcgttcacaagcaaactgtagagccttcttgccatacatgattcggacaagcacttctacgtcctgtgcgatattttcgagctcttaacaaataatgccatcgcattgctcgacatgctgcaggtatgccctgtgttcttggtgtcggttcagttctcacgttgctgcgtgcagcgtcaataattcgctctcggcgttccacgatgattctcatacattccggactagtgtgaatggcagatacagttaattcgcccagtccgaaggaggacattatgggattgtttgattcgctgaagaacatgttcgcgcatcatgagcaccatcatggagccagcatcggtcagccgctcactctcgccgacgccaaagcagtgcttgcctttattgtggtgcatcagcagcttgcggacatgcgcaaagtggcggatgcggtcaagcaattgcaggacgagatgccgcagtacatcacattcggcatgtcgcattattacagcgagcctaagcgcgtgcgcttccagtccgagggtggcaagttcatcgatgcggacgccatcgccaccgcatttgccgagaccaccgtattgcaggacgagtgcaaaatccagcatctgatgggagatatcgaagacaaccgcgagcatcgcgatccggcaaagacgccagcagtaccgattgatgaactcgtgcgcgtcaccaatgaaaggcttgcggctggcaacgatgaggggcaacgccgtgcatggctgttcgccttattcgatcagctcgatgacattgtcgaagcgacaaagaacaatcccgagccgcttgccgcagcgttgaatacgattctacgaaacagctccacaattattggcaaatccgccactgccgacgccggcaacagcagcaacaatgccaatgccggcgatgcacgttcccgtatcatctccctaatcgccgacgctctgttcccggccgcagaatcctcgaagacaagcgagtcctcagcatccgccgccatccgcgaactgatgctcaatcccaccgcaacatcgctcgattacatgccagccatagacgtactgcgcgcccacggtctcactatttgccggtgagtccgagaagtcaaccggtggttcatacggcagtggttcatacggcgcataccgcacgaaccactgtgtccgaacaacgagaacgcactacttctccagcttctccaacttttccagtgcctttaatagcgaatcgacatggcctttggcacgtacgttgtaacgagcgataaccacggagccgtcgggattgatgacgagcgtcgaacggatcacgcctacgtgtatcttgccgtagagcttcttttcgccatatgcgccgtacagcttgtgcacggtcaggtcgggatcagacagcagcgggaatgtgagatggtcgtgctcggcgaacttgcgcagtttctcgagtgaatccttggagacaccgagcaccgcaacattctgcgactccaagcgtgcgagattatctcggaaatcgcaagcctcagtggtgcatccgggcgtcattgccgccggatagaagtacagtacaaccctacgtccgtcctcgagcacgtcagacagattgattaagccgttctccgcagtgccgggcacaatcgccggcagagtgaaatcaggagcatcactcccctcttgcagacgagcgtatacaggagcttgggcggaatcatgaacagtagcagtcatgcgtcccatgataggcgtccgagcccgcgacatctatcacagactttcgatgaccactgattgcgtcaataattcggcacgttatattcgacagtaatatgccatcaaagcgtcggcagcgggctctgaaagactcgactaatcgggcaactgcgggtcggcaaaacggcgattctgcagaaccggcattatctggcgtgcggaagcaaggcattcgcgactaagcccagtagcaataagctcggctccctcatcgcccgcttcggcaactacctctcccatcgggtcgatgatgcgacagcatccgatgttccgcgaactcacctcactgcaagccaacacatagcaagtgttttccaatgcgcgagccgcagtcagcagcttccaatgctgctctttcaacgggccgcgcacccaagcggcgcttacaacaatcgcatctgccccgcgcacggccagtgagcgagcggtttccgggaaacgaacgtcataacaggtcatgacgccgattttccaaccgtcaatatcgacgataggcggcaacgcatctcctgggagaaccacgtcggattcgcgggccgcgaacgcatcgtaaagatgcagcttgcgatattcagcgataatttcaccatcgcgaatcacaaggaacgtgttggaaactcgggaatctgcatcccgttctgttacttgctccggcgcaacatgcacggtacccatcagcacaatatgccgctgcgcgctgatacgccgcaagccgtctacaaacggcccgtccagtggttgcgcgtgcgcggcagcatatgaatcgtcatcgccgcgccgcgcaatcaaaccttccggcaatgccagcaacttcgcgccgcccgccgccgcatcacgcgcgaatccgtcgatgatctccagattccgttccggctcctccgccaccgtaaattgcgcaatcgcaactggtaaggacttcgcactcgtcacgccagccccaatgtcttgaaggcgttggctagaccgttgtcgcggatgtcggtggtaatgatgttgcagaaggcctggatgccgtggatggcgttgcccatggccacggatgtgccggcggctttgagcatggcggtgtcgttatcggagtcgccgatggcgatggtgtcggcgatggcatagccaagcaaggaagccacgtcgcgcacggcggtgcctttgtcgatgccgttgatgagcagttcgccgttattcggcgagatcttgtcgtatgagccgtgcacgagttcgaaccagggggcaagatcatgctgagtgttctcgaaggaaacatccggctcgggcccggtgaaatacgatcccttgctcacatgaatcgtgtgacccagcgtagatccagccggaacctctacctcgtccagcaaatgccagaaccgcgcaaactcaccacgattccacgtcttgcccttggactccagatggcggcgataaccttcggaaatgtacatgccgtccgcaccctgccactggtagctctcgatatggtgttcggcaaaataggccatcgccgcatcgatggcttcgggcgatacgaggtgctgaaacagcagcttatcgccgatattcgcctgtgcgccggctacggaaactacaccgtcgaatccaagatccagaatgttgcgttcgattttcggcacggaacgaccggtacagatgaagagcttgtgaccgttggcttgggcccgcgcacacgccgtttttgccgactccggcacaatatgattctcatcagccagcgtgccgtcgatatcaatgaatacgagtttgctaccagtcatgtcgctttccgtcatatgtcgaacctccccaagtcagcttatgctgacagccccctccagagggggcgaagagaaaaataaaacctgccgaaaaaggaaaagtactgctgacacctcccccagtcggcttggccgacggcttccgctggcggagaccaaaacggcatcacacggcgtaggcggcccagcggccgtgagtgtgctggacttcgatgggcatgccgaacaggtcggagagacgctcgtcggttagaccgtcttccagcgaaccggtatagacgatggtgccagcaccgggattgcccattgagtcgacgcccgcttcggtggcatcttcggcgggaatcggcttgcggcccataatggcgatgtgatcgaagcctgccggaatctcttccagacggtgggtgaccagcaccacggcacgttcagagctttcctcgccgattcggctcaacgtgcgcatcacctgctcgcggccgcccaggtcaaggccggtggtcggctcgtccataatcaaaagctcaggatcgcccatcagcgcacgggcgatcagcacacgggtgcgttcgccttcggacagtcgccacatctccttgccttccagataggagacgcggaaatcacgcagcagctggcgtgcgcgggcgtattcttcgtccgtgtaagtatcgcgccaacgtccggtcacggcggacaggccggtgaccacggcatccagcgggtcctcgaactcggggaactggcgacccaggtcggccgatgcgagaccgatgcgggtgcgcagcttgaacacgtcgtatttgccgagctggtggccgagaatgaacacgcggccttccgaggggaaggtgcgggtggccagcatgccgactgcggtggatttgccgatgccgttcggtccgaacagcacccaacgctcccccgcatggatggtgaggttcacgtcggtgatgatgacgcggcggttgcggcggaattcgacgttgtcaagttggaggacggtttgggacatgattctcctcagtggtacaaaacggagggagagcaccgcttattgcacggtctctccctccgtcacgctgcgcgagcctgcgctgtctcgcttttacttcttctgctcgtcgagcaccgactggtagacctccacggtcttgtcgccgatggactcccaactgaacacgtcgcgggcgcgttcgtagccggcctggcccatcttcttggcgagctccgggtcagccatgatcttgtcgatggcggcggccatgtcgtgcacgaacttgtccggatcggtgggggtgccggtgccgtcgtgcagctggtcgatcggcaccagatagccggtctcgccgtcgaccacaacttccggaatgccaccggtggcggaggcgacgaccggcagaccgcaggccatggcctcaaggttcacgatgcccagcggctcgtagatgctcgggcagatgaaggcgtcgcagccgtgctccagagcgttcagctcaggcttcggcagcatttcctcgatccacacgatgttgccacgctcctcgtccagcttggcgaacgcgttcttgacttcctcggcaatctccggggtgtcgggcgcaccggcgcacagcaccacctgaatatccttggaaatcaggtgcagggccttgagcaggtacggcaaacccttctgacgggtgatgcggcccacgaacagcagggtcggcttggaacggtcgatgttgtaacgctcaaacaccttccagcccggatcgtccggcgccggagtagcaaagtcagacatggtgatgccgttgtaaaccacaaccaccttgtctggatcaagattcggataggcggtcagaatatccttgcgcatgccaccggaaacggcgatcacgcggtcggcgtgctcgtaggcgtccttctcggcccaggagctcaggttgtagccgccgccgagctgctcacgcttccatgggcggaacggctccagggagtgggcggtgatgaccagcggcgtaccgtgcagcatcttggccaggtagccggccaggcaggcgtaccaggtgtgcgcatgaataatgtcggcatccacatcgttggcaatctgcagatccacgccgaaggtcttcaatgccgggttggcatcagcgagctcggacggcgtatcgtatccgacgaccttcaggctgcccttggcattagcggcattgggaatcgcggggatatcagcctcagtacgcttgccatcaaacgcacgcacggtcacgtcaatgcgctcggccaaaaccttggacagctcctcggcgtgtacgccggcaccgccatacacatgcggcgggtattcgcgggttagaatatcaactttcatcggactgcctctccttcgtgcgtcagaaagaaactcaagcacttcttactttagggcaccgcatacaagaaaacgcacaacttccgtcgtgcgttttgcttttcaagccggatttaccaggcaaaagatcagacggccgtgccgttctgatccaaattcggattgtgcttggaatcgccagccgtaaagaacaggctcagcacacccacaatgaacaccgcggaaacggtgatgatcagccacatcggatggctcggcagccacataaccacgaagaacgcgataatcgcgatggcgatcagcgtccagctgcccacgcggaaccactgacgcagcgaatgcggtgccttgaacatcttcggattcgtgtagttcgggttagtggtcagcagggtttcggtgtccgcaatcgtaccgccgctgggcttccattcggtgccgtcggtgccgtcctgcagacgctgggacttctgctgcagctggtattcgtcaatcattcccgagcgaccgcgaccttgggtctggtcgtactgcgacggcactcccctacgattggccttggcctgtgcacgacgttctgcacgattcgccatctcactcactcctttatccgcaaaaaaagaatcctgcggtagatattaccgcaggattcatctaaacagcgcgttttcagcgaggcagcatcatcggacgctggctggccttgatcggagccggcagctcactggtctgctcgctggagaggtactcgtccacggctgcggcgcaggagcggccttcggcgatggcccagaccacgaggctctggccacggccggcatcgccgcacacgaacacgccgtcctgggaggtggcgaacttgtcattgcgggcgatgttgccgcgcttgtcgagttcgacgggcagctggtcgaggatggtctcggtgtccgggtgcaggaagcccacggagatgaggaccagatcggccggcagcacgcgctcggtaccgggctggcgggtgaaggggccgttctcgccgggagccacggagacgaccttcaggccggtgacgtgaccgcgttcatcggccacgaagccttcggcggtggtcgagttgtcgatggtgaccttggccttctcctcttcggtgccttcgaagttcaccgagtcggtcgagtaaatgtactcgccaccctcttccatggaggaagtcttctggtaggtgcgggcgaaggtcggccacgggctgttgtccgggcgtgaagacggctctttcggcatgatctgcagcacggtgacatccttcgcaccctgacggatggaggtaccaaggcagtcggaaccggtgtcgccaccgccgatgaccaccacgtgcttgtccttggcggtgatgtcgtgcaccggcttgacgccgaagatacggcgcgtggcgtcgggcaggaagtcgagggcgaagtggatgccgtcaagctcgcggcccggaatcttcatatcgcgcggcacgcgggagccgatggccaccacgacggcgtcgtaacggtcacgcaggtcatcccacgtgatgtccttgccgatttccacgttggtgcggaagcaggtgccttcggcctccatctgcttgacacggcggtcgatcagacccttttcaagcttgaagttcgggatgccgtaacgcatcagaccaccgatggcgtcgtccttctcgtagacgacgacggtgtggccggcgcgggtgagctgctgagcagcggcaaggcctgcagggccggagccgacgacggcgaccgtctggtcggtcagacgctgcggcggcaaaggcttgacgatgtcaagatcccaggcctgatcgataatcgtgcattcgtcgttgcgaatcatggtcggcggctggtggatgccgagcacgcaggcctgctcgcacagagccgggcagatacgaccggtgacttcagggaagttgttggtcatggacagacggttgtacgcgtcctcccacttgccctgacggaccagatcgttccactcaggaatcaggttgcccagcggacatccggtcatacagaacggggtgccgcaatccatgcagcgggccgcctgcgcttgggtccacggttgcaggccggtttcggcgtgaacgtcgaaccagtccttgatacgttcctcaacggggcgttcagccagctctcggcgggtacggaccttcagaaatcctctcgggtcgtccatgtcagcgcgctccttccataacctgctcgtacaccttttcccaggcgccgggcgcattgaaatctacattgttggccttggcctcttccatggccttcgtcatggccacgaactgcttcggcaccacgtgagtgaaccgcttgacggtctcgttccagtcctccagcaaagccgcagcgaactgcgaaccggtctcttcagcatgctgcttgaccagtgcgtacaccagcttggaggtttcggcatcaagcgacttgaagagcagtgcaccggacttgatggcacccgggttgaccttcttcatatcgaggtcaagcacataagtgttaccaccggagaagcctgcaccgaaattgcgtccggtggggccgagcaccacaacagtgccgccggtcatgtactcgcagccgtggtcgcccacgccttcgaccacaaacgtggcaccgccgttacgaacgccgaaacgttcgccggcgcgtccggccacgaacatctggccggaagtggcgccgaaaccggtgacgttgccggcgatgacgttgctgtgcttgtcgaaggtgacgctatcttccgggcgcacgatcatgcgaccgccggacaggcccttgccggcgtagtcgttgacttcgccgtagatgcgcatggtctcgccgcgcgggatgaacgcaccgatggactggcctccggaaccgtgcagggtcatgtcgatggtgccgtccggcagaccttcctcgccgtaacggcgggtgatctcgtagccgaccatggtgccgaccgtacggttgacgttgcgaatcggcatttcgatgcgcacgggttccttgtgttcgagggccggctgggcaagttcgatgagcttgttgtccagcgccttctccagctcgtggttctgctcgatggtctggtgcaggatcgtgccgggtaccgggccggcctgcttgagcacgttggacaggtcgatgccgccggacttccagcgcttgatggcctcgtcctgatccaagcactcaacgtggccgatggcctcctcaagagtcctgaagccgagctgggcgaggatctcgcgcacctcctcagcgatgaacatgaagaagttgaccacgtactcgggcttgcccttaaagcgggcgcgcagctcaggatcctgggtggcaatgccctgcgggcaggtgttcttctggcaggcgcgcatcatgacgcagccttccacgatcagggctgcggtagcgaagccgaattcctcggcaccaagcagagcggcgatgaccacgtcacgaccggtcttgagctcgccgtcgcactggacgacgatgcgggagcgcaggccgttcaggatcagcgtctgctgggtttcggacaggccgatctcccacggggtgccggcgtgcttgatggcgttgagcggggctgcacccgtaccgccgtcatagccggagataagcaccacgtcggcatggcacttggccacacctgcggcgatggtgccgacgccgaactcggaaacgagcttgacgtggatacgtgccttcgggttggccatcttcgcatcgttgatcagctgcttcagatcctcgatggagtagatgtcgtggtgcggcggcggggagataagctccacgcccggggtggcgtgacggaccttggcgatccacggcgggaccttggcaccgggcaaatggccaccctcaccaggcttggccccctgggcgagcttgatctgcaggtcggtggcgtgcacgaggtaatcggaggtcacgccgaagcgggcggacgcgatctgcttgatgcggctgtagcgctgcggatcgttgatacggtcgtcggattcgccgccctcaccggagttggagcgtgcgccaatcgagttcatggcgatggcgagcgtctcgtgtgcttcctgcgagatggagccgtagctcatggcaccggtggagaagcgcttgacgatctcggaggccggctcgacttcggcgatgtcgatgggcttgcggttggtgttgaacttcatcaggccacgcagggtcatgagtcggttcgacgtgtcgttgatgtggtgcgaatacttcttgaacatctggtagtcgccacgctgggtggactgctgaagcaggaagatggcctcgggatcgttgaggtggtcctcgccggtgcgacgccacttgtagtcgccgccggtgcgcaggttgcggtgcggggacgcgctccactggttcgggtaggccacgcggtggcggatggccacttcttcggcgatttcttcaaggcccacgccgcccacacgggaggtggtgccggtgaagtattcgtcgatgacttcttggctcaggcccacagcctcgaacagctgcgcgccacggtagctcatgatggtggagacgcccatcttggacatgatcttgagcacgccggtggagagggccttggtgaggttcttcacagcggtgtccgcgtcgaccttgaggtagccgttacgggccagatcttccacggattcgaatgccaagtacgggttcacgcaggcggcgccataggcgatgaggagcgcgacatggtgaatctcgcgcacgtcaccggcctcgacggccatggaaatctgtgtacgggtgtggcggcgcagcaggtggtgctgcacggcggaagtcagcagcagggacgggatcggaccccacgtatggttggactcacggtcggagagcacgatgaagttcttgccgttggcgatggcctcgtcgatttcggcgaagatctcgtcaagtcgctcttcgagggccttgccgccgccggcgacctggtagaggcccttgaccacgtacgggcggtagtagccgccgaggatgcgggccttgtcaaggcgcttgagctgggccatctcatcagagttgaccacgggcagcgggatgaggatcttcttggcgtgcagctcggaatcggccagcaggttcggctcggggccgatggcggattcgagcgaggtgacgatctcctcacgctcccagtccagcggcgggttggtgacctgcgcgaacttctgggtgaagtagtcgaacagcatgcggctgcggctggaaagcgcaggcataggcgcatcgttacccatggaaccgagcggttccttgccggtgttggccatcggcgtgagcaggagcttcagatcctcttcggtgtagccgaaggcgcgctgacggcgctggacggactggccggagtggctgacgtgctcgcggcggggcaggtcgctcatttcaacggagttgccttccacccacttgcggtacgggtgctgggcagcgaggttcctcttgacctcttcatcgggaatgatgcggccttcggcggtgtcgaccaggaacatctcgccgggctcaagacggcccttggacacgatgtgttcctgcgcgatctccggcagaacgccggcctcggaggccagaacgatgtagccgtcatcggtgagctgccagcggccgggacggaagccgttgcggtcgagcagggcgccgacctgggtgccgtcggtgaagacgatgtcggccgggccatcccacggctcgataagcgtgttgttgtactcgtagaaggcgcgcacgtccggatcgagatccgggttcttctcccaagccggcggcagcatcatgcagatggcgtgcggcagggagcggccggcgaggtgcagcagttcgaggcactcgtcgaaggtgccggaatcggagtagcccggggtggtgatcggcagcagcggctcgaattcaccgagcagttcgctgctcaggcggccttcacgggcggagagccagttgcggttgccctggatggtgttgatctcgccattgtgggccagcagacggaacggctgggccagcggccagctcgggaaggtgttggtggagaagcgggagtggacgatggcgatggtggccttcatgcgctcgtcgttcagatcctcgaagaagtgggtgagctgcatggtggtgagcatgcccttgtacgtgatggtacgggcggacagggatgcgaagtagacgcccacctcatgctcgacgcgcttgcggatgcggaaggtcttgcgatccaagtccacgccggccagagcaccgtccggagaggcgaccacgagagtcttgaatcctggcatggcggcaagggcctgcaggccaaggccgtccgggttggtgggcaccacgcgccatgcgaggacttcgagtccctcctcgcgcacgatcttggcaatggcctgttcctgctgaccggaggtttcgatgtcgcggtcaaggaaggcgatgcctgccgcatagtgaccggcttccggcagttcggcgggcacggtggcacgcatgaactcatccggcatgctcatcagaatgccggcgccgtcacctgtgttctcctcggcacccacggcaccacggtgatcaaggttgaccagcacctcaatggcgtcggtgacgatcttgcgctcaggacgcttgttcaaagtggtgaccatacccacaccacaggcgtcatgctcgttggcgggatcatacataccgtccggagcgtggaccgtgagatcgagcggggctttgaatgtcaccgaaatcacctcaattggttgtgggcacgtaagaaaatcatgcctcttcgttcattgctgttgacacagtaccgttgctccatgtcatttacgtttcatgtgtccatataccgagtcgccataaaagtcaatagtgattctcaagcaattttttttatggccagttatgggggtatttcgaactttttcgctcgaaatgtctatttgaccacacgaaaatacgatacggaaacgtccgtatcgtgaaatgctgcgttgggtgatgttacggattggcggctgtggaccaccctcagtcatgcttcgcatgacagctcccgccagcgggagcatgagaactgtgcatgtctgacaccatagcgatcggcgcgctccgcgaactcaccgaacatggcatccacgtgcccgacgacgtacggctcatgggattcgacggtatccccttctccgcctgcaccaacccacccatcagcactgtggcgatggacgtctccgcaatggctcgtacggttatcgatcgcatggtgacgctgaacgagtcgaacctacggcatgaacggcccgatgacatcacccatgaccatatccagttccaggtgatgccacgcacgtcgactctggccgcctgataccggccggcacccttatgagtgccggccttcatccttgaaaatatgaaggctatgccacgtacagcgcggcgggatacgtaagatacgaaatctcatcgagctgatcgaccgtcacatatccagctggcgcgttgagcacgtccggaatgcggttgacgattgtggcgcacgtatgttcgacggtcgccggcttgaccacgtggaactccacgtccggttcaccctcgatcttccaatcgcacatatcgccatcatccggcccgtacaccttgccgatacaggcagtttccaacgtgatgccctgattagtttcggtggttaccacggcggacatgccgatgcatttgccgaccggaatcatctcgcccatcgtttcggaatacacgtcgacatcgctgaaatacggcacactggcctgggtctgcgatgcgatggtaagcccaagcttctgggccagcgcttcattggaattccatacatacgagggcaccacggtttcgggatgcgcaagctcggcctcgaactcctcggcggtcagaccgcaaccgtgcgctttggccaaagccaggccgtattcctcgacgttgtagctcaccgcaccggtgatcttcttgatgctgtggcatccggcggcgacggtggagaccatgttcacccagtagatgtcctgcatgccggagccgaccatggtggcaccggcttccttggcgatgatgtcgagacggttcgtggtggccggatcggtggtccacgggtagatgcattcctcgcaggtggtgatcacgctgatgccgcgggccaagcactgctcgcacatggtggcgatttcgttctcgaagctgaatagcgtgactaccgcgatatccgcgtcgcactcgttgagtacagcctcggcatcggcgcgaatcggcacattgatggggccgatgcctgcaaacacaccggcatccatgcccacgacttccgggttcacgtcgatggcaccgacgatttgaatgcctttctcgtgcatatagcgaatcgtgtacttcgccattttgccgcagccgtattgaatggctttgattggttgcataccgcatgctcctttgcaacagtgcatattggccattggagaagtctcgccgtcgagaccaagccaatagcctttactctaccgacatcaggctgggcattcactgatatcggcggcactggagtgtcggggagagtcggtgtagcggtaccactaccgaacagaagggctggggccatcacgaggtctcccgccgaatcacggcatctcgctgattttctgcccgccgggcaggggcccatgcccatcggcgtatgcgccgctgatctggccgaatccaacgacccgagagaacgacgcgcaggggctcgaaacccttacagaactcatcacggcatacaacaaggaaatgagcaatgatttcccgcattgcaatccccagcggcgctcatccgtggaatatcgtatacatggtggccgagcgcattgccgaatcatgactgctcaccggcggtctcatggtgcagttgcacgccatcatgggcggtctcgacgtgcgtcccgctaccgacgcggatctgcttggcgcgttgattcttaagagcgccgcataccaagcagaccatgccggatatggagatagacatctgtacgatgccgcaatgctcgcatccctcatcaccgaccctgatgccgaaactcggcgactacatagccacacggatcgcagacgtatcaagctcccgtacgacatgctcaccgatgaatcaccttactggaacaaccttgacgaacaacatcgcagaacaggattcgatgccatagagacactggccgattggtagccgctctaccgaacccggctgtggcggataccagtcagaccaatcccgcctacaacctacttccggttacgtagggcgtggagcatggcgacgaacacgataacaatgaccacggccatgatcgtacagatgagtttgccggggatgcgttcgtcgcgggccgattgcatcacggcgtctgccgctgagatagtgcccgaggtctggggctgagtcttcagagttgccgattgttcaaaagtcatactctaacgataatgctgcggaaagcggttaccataaagcgtgctcacagtcgcccgtcatgcgaacttttcgaaaactgttgataaatagccattttccgcagaagcccttgcaaaacactatgatttagaatatctattagtatgacgtaaaccatattacaaactacttaaggtaagcgcttacagttcggcatgagagactcctcaccacgatatggatgcgctacagtcactatgattgatacgcacgccccatcgactacgcgatttcaccgtcgccgtacgcgcgttcggaggctcgcagacacggcttgccttgcaccacctcgacctgcgagggcggcgcgtcatcgccggcgcgcttggcctggatctgttcgaacagcattcggaaggaccgctcccccatgtccaggaagttctgggtgtaactggtcagcgccggattccacatggcaccgaagttgcggtcgtcaaagcctacgacgctcacgtcagcaggcacgcggcgaccaacctcccttagaccccggatcacagcgatggcagtctcgtcgttgccggcgaaaatcgcagtcacatcaccacgacggcccaaggtgcgtccagccttgaccgactcctccaaatcatcgtcgggcacgatgattgggtcaggtgccgtgacgccgcgctccttgagcgcgtcacgccacccattggtgcgggtgttatcggtcggaccttccggacgccccacatggaacacggtgcgatggccgagatccagcagatgcatggtcatccaacggccgccatccctttcggcgttgatgacctggtattcaccgtcgccgaagctgccacccaccacgaccatcggcatatctttgggaatgtattccagtgcggcgatgccggcccggtcgtactcgtagacgatcacgcccgccggcctgatcgacaaacccatgcgcacgcgagccttgacggagtccatgtcggactcgtccaaagaaacaatattgagcaggaaccgacgtttacgggcggcggcctccaccccatggttcgtttcggacgtggagaaggcggaaggattggccgcgaacaccaccacggagtccatctcccggttcgacagagcgcgcgccacaatgctcggctcgtagcccagctccttgatggccttggcgatgcgttcacgcttgtcttcggtgacgttgacggtgccgttgagataccgggagacggtcggtgccgagactccggccagtttggccacgtccttgatcaccggccgggtgcggcccgcacttctcgccatccttgtctcccctgttgttgtcagttgttgttattgcgtatgttagagaaccggcatcactatgacagccatccagtcacacccatatccgttcagccgcgctccgacttcggttctccgtttttcgccgcgattcattgtagttcatgacggggaacctatacccaaatcgataacttcgtgaaaaccgtacgctgagttgcggtgagtgtacggtttccgcgaaatcatccctaatttcgtgaagaacgtacactgaatcgtcgtcaacgtacggttttcacgaaatggggcctcatctcgtgaagaacgtacactgagtcattctgagcgtacggttttcacgaaatggcagctgatttcgtgaagaacgtacgctgaagatgcccccggtgtcactgatgactgttttcggtatggaaggcggcgcagcaaggtgtcctaggctaatatcgcctccgacaagaccgtcggcaaagccgtcgacgtcgattcaagttatccacagcaacaattcgcgtgacatagtatccacatttgccggttgagcttgtgcaacgatcaaaatcacccttagcgtcgagatatgaaagaacacaaggaagtttctgcactgctgcagcaggcgaagcaggagcgtcgctgctgctatggcaccagtgatgcgcaacggcgcgccctgaaacgtcgcctgcatgccggggagctggtgtcaccgtataagaacctgtacgccgaccgaacactttggaacaccatgaccagagagcaacagtcattgcaggtcatacgtgcgttgtccgcaatccaccctcagtgggtatttgcggggttgagtgcggcgtgcgtatacggactgcagcacaactattccctgcacgacggcacagtgcacatcgcctcgaagtccggcatcggcggcggagacgaggcgcgtctcaaccgcatctatatcaatcggattccgacgcggaagcataacggcattctcttgacgactccggcgcgaacgctgctcgactgcgcggcattcccattcccacaggcgctgcccatatacgattcggctctgagaaagtccctgacgaccatcgaagaggtgcagtcgctgatgattcaaagcgtctgcgacgaggtctccgtgaccaagctgctgaagtacgcggatcccctgagcgaaaacggcggcgaatcattgatgcgtggccagatcaccgaattgtctttcggcatccccctgctgcaggtgcagttcatgaatcccgacaatcccgcaatgtcatatcgcgtcgatttctgttggaagctcgcagacggccgcatcatcgtggcagaatacgacggcatggccaaatacgccgacatcagcaacaagaatcgcgcaagcctccaggcgaaaatggagtacgaccgcagacgtgatcggcatctccgggaacagggcgtcaccgaaatcgtccatgtgttctatgaggatctgctacgccccatcaatcttgagaccaagctgctcaaggccggtgtgcccaaaatccggtgaagataggccccatttcgtgaaaaccgtacgcttacgacgactcagcgtacgttcttcacgagatgagaccccatttcgtgaaaaccgtacgcttacgacgactcagcgtacgatttccgcgacatgaggccatacctcgtgaaaaccgtacgctcagaacaaggccgtcagaaggtcgactagacaacctcttaactaccgaatggtatctaaagaacggcgatattccgccagaaacgccgagagcggaatagtccccttgcgtttgtcatcggactgcgttattctgaaaccggtttcagaaagaagccgataaacaaaactcaaagccccaaggttttgaccaacgaaaggaaacatgatgtctctcaaggattccatgattcgcggtctggctgtgtacggcctgagctccatgagccagtgcggtcgcgccaacagcagcacgctcgtcgacctgatcaacgaagccaacaagaacgctcgctgagccatcggctccggtccggcaatccaatcagattagccacggaccccataacaacaaagcttaaacaacaatcgcaaagccgctcacggcgatgcgcaaacgaaaggtaatgattatgtctctcaaggattccatgattcgcggtctcgccctctccggtatggatgccatcgcccgcgccggctacgccgactccaagatgttcgccgacatcatcaacgccgccaacaaggacgctcgctgaatctagcgaacaatcccgttcatgagattgcacgacacatacgaaggcaatcccccgcaggccgcaatcggccggcacaccacaataattgaataacgcaataattcaacacagtaaaactgaacaataaccgggacaacggggtccatatattctttcttttcccatcgtgcgtacgccgcgccagcacaggttcacatacgatgcacacggccgccaatacacgatgcgtcatcatcaacgccctcaccgcatcatgagatactcccccgtccgttgtccacactgttgcctctacaatgcctgtgatgcacgccgaacggcatcctgcacagtgactgaagaacgaaacaccaagggacggaaatggataacgaactcttcgaaaaggcgccgattccgaaggcgtatttctcgctggcgatgcccgtggtgctcagcatgctggtcaccttggtgtacaacatggtcgacacctatttcatcgcgcatacgggaaacaccgatatggtggcgggcgtctccctcaccgcgccagtgttcaccgtgatgatcgccctcggcgacatcttcggcctcggcggcagttcggtcatctcgcgcttgttcggccaacaccggttcgccgacggcaagcgactcagcgcgttctgcttctatgccgccatcgccaccggcctgctgattctggtgctgggcctggcgttccgcgacccgatgctcgcgctgctcggcgccactgacgacacttggcagtatgcctccgacttctacacgctgatcatcgtcggctcgccgttcatcatcgtgtcgatgacgccgtccaacctgctgcgcaccgaaggccacgccgtgcagtccatgatcggttcggtggccggcacggcggtcaacatcgtgctcaatcccctgttcatccacggattcggctggggtgctgcgggttcggccggtgccaccgtgatcgccaacatctgcaccgacgcctatttcgtctggttcacgctgcgtcacagcagcaacctgtccatcgacccgcggaccgtcatcgaccgcgcgcgccggcgtctggcggtcacggcccgggaggtcgggggcatcctcgccatcggcatcccctcggcgatcacgaacctcacgcagagcgtcggcatcgtcatgatcaacctgttcctgctcccctacggtaccgacgcggtagccgcgatgggcatcgcgctgaaagtcatcatgatcgcggtgctggttttcgtgggattcgcgttcggcgcgcagccgctgatcggctacaactacggcgcccgcaatatgcctcgactgcgcggcattctgcgtttttcctacctgttcctgtccctgttcgccctggtgatgaccgtggtgctcagcctgtccgaccgtctactgatgggattcttcatcgaggacgccaccatcatcacgctgggcgccggcatgctgcgggttcagctgctgagcctggtgtgcgtagccgtcgtgatggtcacgacctgcaccttccagtccgcaggcaaggcggtcggcgcctttgtgctgtcgatcagcaggcagggtgtgatgctggcgattaccctgttcgtcggctcccggctggccggctatcagggtgtaatcgccgcgcaggccatcgccgatctgctgaccgcgattgtggcggtcatcctgttcgtcgtgatgttgcctgagctgcgcagtcggaaagctcgctgatagagcaacacgaggtttagcagacacgcattcggagagccaatacgctgcgtaatattgcgcgcgatattgcgcaatgggaggcggtgccgttttgttggactcatcgttgattccatcaccaccaatcatgtcacaagaccgagctcgcgtcgacgatccatgataccagttccacgatgccggtgtcgctatctttgcgatacacggcggtcagttcgccgcagctcacggtttccagtgtggcgcgcacgtcttcctttccggtactcgctcccgctgcgggagctgtctcgcatagcgagactgagggtggttctcagcgctgcccccccagtcgggcgaagcccgccagggcgggttctagtgatcgttgcaacacctgacctaccgcaaggagggtcaggtgaccagaagccaccgaaacgaagaccgtggcggggaacaccgttggacgttcaacggcgtcgaatatccgacgaggaagctgatgtgcgaggcgagacgcgccgagtacgtgcgcctgctggacgaggaaggcatgaacttcacccaggccgcgcacgcggtcggcgtctcgaaacgcaccggcaaggcgtggcgcaacggcaggacgcgcgccacgggaaggaacgagaaacccctggtggactggtatcgttccaccatggacaaacccaagaccctccatccgcgctacctgagccaggaggagcgcatccagatcgcggaccgtctgcgtctgggcgattcgatccgcgccatcgcccgcctgctgggccgcgaccccggcacggtcagccgcgaggtcgagcgcaacaggaatcccgagtccggcggttacgagccttaccgcgcccagcagaaggccgcggaccggctcaaacgccccaaaccgcgcaaggcggccgagggcacgcgactgtgggacgagatcgccgccgggttgcgcaggcattggagcccggagcagatagccaaccggctgaggctggacttcccggataatggggatatgcacgcgagcgtcgagacgatctaccaggccatctacctgcaggccaggggcgaactcaagcaggagctgaaacgcgccatgaggcaggggcgaaccgcccgcagaccccaaggcggccaaggccgcaaaccccgtttccgcgaacccatggccatgatctcggagcgacccccggagatcgaggaccgggcggtcccgggccactgggagggcgatctcatcaccggcagccgcaacaaaagcgccatcggcacgctcgtcgagcgcaccaccaggttcacgatcctgctgcacctgcccgacgggcacgacgccgaacacgtccagcaggccatcatcgacaagatgcagcacctgcccaaactcctgcgcaacagcctgacctgggaccagggagcggaactcgccctgcacaaacggatcggcgcctcgctggacatggccgtctacttctgcgacccgcactccccgtggcagcgcggcaccaacgagaacaccaacgggctcctgcgccagtacttccccaaaggcaccgacctatccgtctacccggaggactacctcgacgcggtcgccgaggaactcaacgaccggccacgcaaaaccctcgggttcatgaaaccaagcgagaagatcatcgaactgctcgacgccgcgtgataacctcaacaaccgacaacgtgaccatggaaggccgctcaaacctcaggtgttgcaaccaccactagaatctgcccagcccccgccagcgggagcctgctcacagttgtagggttcgtacgatttgttcggtggtgcgggtcacgttggcggccgcgtcggccagcagttcgctgaggctggcggctccgggcgcgatgccgaataccgcgtcgatgccgacctcatgcagctcatcgatgccggtgccaatatgcccggctactgcgatgaccggcttgccgtggcgcttggcggtttcggccacgccggccggcgtcttgccgaacttggtctggaagtcgatggagccttcgccggtgaacaccacgtcagcccattgcgcggccgcatcgagtccggattgttcgatgacgatggcgatgcccgggcggaattcggcgtttaggaagcccttcagcgctgcaccgatgccaccggccgcgccggcacccggcacgtcgttcacggcaacgccgagctggctgtcgattacctgcgcaaaatgcgcgagggcggcgtccaatgtggcgacatcatctttggacgcacctttctgcgggccgaacacggcgctggcgccggtggggccggtcagcgggttggtcacgtcgcaggcggcggtgatggcgacgttcttgagagccgggtccatcgtgctgatatcgatggtggtcagattggcgagggccgctcccccgtgtgccaagtcgttaccgttcttgtccagaagacgaacgccgagggcctgcagaagtccggcaccggcgtcgttggtggcgctgccgccgagcccgacgatgatgcgcttggctccggaacggacggcggcgagcatgagttcgccggtgccgtaggaggaggcgatcaacgggttgcgttctttggcttcaagcagtgccagtccgctggcttcggctgtctcgaccacggcggtcgtgccgtcggcgagcagaccgaagtggccttcgacaggccggccgagcgggtcgtggaccggcacggcgcgcatcgatccgccggtggcgtcgacaagcgcgcgtgcggtgccttcaccgccgtcggccatgggaaggcaacggacctcggcatcgtggtcggcattctcaatcccctgagccatcgcccgggccgcctccatggcggtcaggctctctttgaaggagtcaggggcgcataagtatcgcgtcatgcttcgagcataccgcacgacacgacgaaacggtaaacgttttccgtaattcgcgtgattatttttttgttcagaattcaggctttccaatccacaatgctactattgcaagcaaaaatgcgatatcgttgcggtaaacgtttagacacgttttccgtttcagggaagaaaaggatcgattcgatcgtggctgtacagaacgataaggcgcaatcgccagcgacattgatggatgtcgccaaagaagcccaagtctccatcgccaccgcatcccgcgtgctcaacggcagcacccgcaaggtacgcaaccaatcgtatgtcaaggtgatggaagcagccaccaagctcaactatcgtcccaacgcctatgctcaggcagtggccaaaggcaccgcaccgaacatcgtgctgctggtctccgatatctccgatccctacttcgcatccgtatcgcaaggcgtggtcaaggcggcggccgaacgcggcatttccgtgaccatcggcgtggcagccaccccgcacgaagagttggaggcggtgcgtaagtccgtatccaccaggccgcgcggcatcatcatctccgaaagtgaatacaccgacgcgccggaacgccaggcgttgcagacggaactcacccagtacgaagcatccggcggacgtgccgtgttcgtgctcaaccgcaacctgcccttcccggccgtggacatggcgaacgatgtcggcgcgcgcgccatcgcaaagctgatcgtcgattccgggtatacgcgccctgcgattctcaagggcgatgacgcacatcgctcctccaaagaacgactggccggcgtgatggaagtgttggacgaggcaggcatcaccgtggatccgaaagccgtggcgaatggtaagttcagccgtaccgacggctatgcggccgtcatgcaaatggcccgatccggactgctgaagccgggcgaaggcgcactgtacgacggcaaaggcatcgattcaatcatcgcgctcaacgacgtgatggccatcggtgcgatgaccgcgttgcgcgccaacggcatcgagccgggtcgggaaatcggcgtcaccggtttcggcgacatcccctactccgccgacgtgtttccgccactgaccaccgtgcatctgccgctggccgaaatgggccaggccgccgtggacagcatcctgtccaaccgcgatgacggggaggccaccggcggcactgccaaccgcctgatctacgtgcaaagcgccccggacgtagtcctacgcggttccctcccccgccggtaaaacaaaaatagctccctctgacggtgtaaccacaactagcgaacaggtaatggcgactgccgcgcaccataccaccgactcatacaccgacgaaatcgaagaactgttcgattaccgagtcattgagcaaccggccacgacgagtgggcaccactcgatgattatcggatacggtaatcaggccttcgctgaccattggggcgagttggtcaagggaaacattacggagagtctggggcgtgctgctcatacccgcatcgttgatggcgcggttgatgcggtcgaggtcaaggccctcgtgcaggcgcagcccgagcatgatgagctcttcgaggttttcctcgggagtgatcgtctcgctatcggcccacggcacacggttctcgttgatggccgtgccccacaaacgcgggtgcgcgatgtcccagctgcgcagaccgtgtgagacagaaaccacccccagtccggcatccgccggacaacccccgccagcgggggcatgaatttcttgggagttgttcccatgcgcgttgatcatacctagttcggcgttggcctgtccatcagctgaggcagaggcaatggcttcggacttgctcccgccagcgggggctgtcagcgaagccgactgggggtggtcagcctcggtcaccgcgttgtagtgggagtgggcacctggccctagaccggcccaatcaacgttgcgccagtagccgaggttgtgctggctttcgtatccggggcgagcccagttggagacctcataccattcgaggccggcggcggcgaacaggtcgtcagcgatctcgtatttagcggcctcgtcatcgtcattgggcttgggcagagtgccggccgcgatttgacggcccattttcgtggtgggttccacggtcaatgcgtaggcggagatgtggtttacgccaagatcgatggcggtcgtgaccgaggtgcgccaatcgtcaaggctctcccccggagcgccgtaaatcagatccacgctggagcgcagcccagccttgttcgccgcattgacgcctacggccacgttggccggcgtatgcgtgcggtcgagggttttgagcacgtgcggcacggcagattgcatgccgaaggaaacacgggtgaagccgccggcagcgagctcattgatgtaatactcgttgaccgtgtccggattggcttcggtagtgatttccgcgtcgggcgcgatgctccagatcttgcggacggcatcgagcatggcgaccagatcgcgggcggcgagaattgtgggggtgccgccgccgaagaacacggtggaaaccggcggctcctcgatgccgtggtcgagctgccactgcttggtcaatttcatttcccgaatgaccatattggcatagttgccgcgcgaggcccccgcaccaagatccgtagccgtgtaggtgttgaagtcgcagtaaccgcagcgccgcaagcagaacgggacgtggatgtagacctcgaacactagccctcggtcttctgagcggcgcggatcttgtctttggtgtcgcggtcgttggagtcctcgccggtggacagggctgcgatgaacgcctcctgcggcacctccacatggccgagcatcttcatgcgcttcttgccagccttctgcttttcgagcaacttgcgcttacgggtgatgtcgccgccgtagcacttggcgagcacgtccttgcgtaacgcacgaatgttctcacgtgcgatgatgcgcgaaccaatcgcagcctgaatcggaatctcgaactgctgacgcggaatcagactacgcagtttcttggtcatcatcacaccgtacgaatacgccttatcgcggtgaacgatggcactgaacgcatcgaccttctcgccctgaataaggatgtccaccttgaccaaatcggcggactgctcgccatcctcatggtaatcaagggaagcgtagcccttggtgcgggacttgagctggtcgaagaagtcgaacacgatttccgccagcggaatgcggtagtgcatctcgacacgatcggtggagatgtactccatcgtgcccataatgccacggtggtcctggcacagatccatcaccgcaccgatgaattccttgggcgtgatgatgtcggcggcaaccatcggctcgacaatcttcttgattttgccgtccgggaattcgctcgggttggtcacatgatgctggctgccgtcctcggcggtcacgtcgtaggtgacgttcggggcggtctggatcaggtcgaggccgaactcgcgggagagtcgctcgttgacgatttccatgtgcagcagacccaggaagccgcagcggaagccgaagcctagggccacggaggtttccggcgtgtagatcagggcggcgtcgttgagcttgagcttgtcgagtgcatcacgcagttcggggaactgggcgttgtcgatcgggaacaaaccggcgtagaccatcggcttcgggtcgcgatagccgggcaacggctcggcggccgggcggacggccgaagtcagggtgtcgcccaccttggactgactcacatctttcgcaccggtgatgatgtagccgacctcgccggcaccgagtgccttggtgcgggtcatatcggggctgatcacgccgatttcaatgggatcgtgggtcatgccaatgcccatcatgtggaccttttcgcggtcgtgcagttcgccgtcctccatacggatgtaggtgacgatgccgcggtaggagtcgtagacggaatcgaagatcagcgcgcgggcgggggcatcggggtcgccgtgcggggcgggcacgtccatgacgatctggtcgagcaggtcggccacgccttcgccggttttgccggagacgcgcagcacgtcgctcggctcgcagccgatcagacctgcgatctcctcggcatgcttgtccggttctgcggacggcaggtcgattttgttgagcacggggatgatggccagatcatggtcgatggccatatacagattggacagggtctgcgcctcgatgccctgggtggcgtcgacgagcagcaccgcgccttcgcaggcggccagtgcgcgggacacctcataggtgaagtccacgtggccgggggtgtcgatcataccgagcgtgtattcggtgccgtcaaaggtccacggcacgcgcacggcctgggatttgatggtgatgccacgctcctgctcgatatccatacggtcgaggaagcgatcgcgcatctctcgctcgggcacaatgccgctcaactgcaagatgcggtcggccacggtcgacttgccgtggtcgatgtgtgcgatgatacagaagttgcgaatcaccgactgatccgtggaacccggctgattgtgttggacgaccaacgcattcctcctcttggcatatactcaaacttcacctagtgtagccgagggactgtattcggcgtggcattgcgcgggtttttccggggctcatgctatcctctaacttttgtatgtccttataacacacatcgtttggagtaaacgtggcaaacattaagtcgcagaagaagcgcgtgctcaccaatgagaaggcgcaccttcgcaacgtggctgtgaagtccggcctgaagaccgccatccgcgccacccgcgaagccatcgccgccggtgacaaggctgccgccgaggccgcctacaaggttgccgcccagaagctcgacaaggctgctggcgctggcgtgatccacaagaaccaggccgccaaccgcaagtccggcctcgctgttgcgatcaacgctctgtgagcataagcctcttaaggttttagaaagtcccgcaagtcatctggcttgcgggactttttgtatctccgttcaaagaggtacattggcggtcttgcgaaatgacatctccgttcagagaggtaccgaatacgggaaaaaccaactataaacgccatcattgcaacacttatactcagcgtttcgtgcttcaggtacctctttgaaagcagttagcattctgcagaaggccagatgtacctctttgaagacagttagccctgaggcggccttgaaccatcctgaggcttgtcttcttcgtccttggtggtatcgccgggatcgacggtatcggcgtgcggatggatgaccgggcgcttgagatatcggctttcgctgggcaggtagacgcgatgacgttcgacggctccgggcagagtgacgttgaagcctaccgagagcagtcgcagcgccaccacgatgatgacgatcagcacgtcgagcagcatttccgagcgcatgtcgaaccagccgtagcttacgccgcgccataccagcacggtcaggatgcagccgatgaacgaaggcacagcatagaggtgtttgtctcgaataatcattggcacgtcgccaatgaagatgtcacgaatgaggccgccggccagtgctgtgaacatgccaaggaatacggctgtcatgcctgaggaaccgtaggccagagcttttgcggtgccgctgactgcgaatagtccgaggcccagagcatcgatgacagtcatcgtccatttgagtttggtgatctccgggtgggccaccaccacgataatgccggaaaacagcgtggtgagcacatagcctttgtcggtgatgccgaccggcggcagggcaccgagcatcacgtcgcgcacaagaccgccgccgagtgcggtaagccatccgcacagcatgatggtgaagatgtcgtagcccttgcgaatggcggcaagtccgcccgacaatccccaacacaggattgctaaatactcgatgaccacaaaaacgatgttgttctccaacgccacctgcatgagccactcccctctggtaccgcttcggttcgtctcagtccgtcttcgttctgttcccgttcatccttattcggcgctacagcccgtcgtacccgagcctacaacaggccttgcctgagtagtatggccggggaggaaggggccactaagacgtgaataggatggcaatgacgccagcttgccggtagtcgttggcaactcagcccctctaggttttacgatctgtaatcaaaaaacatgtatggacttaatcgttgttgatttctgattcaatcaaggcgactttttcttcgacatcacgcaagcgattgcgcagtgcggactcgatatcgatgccgtcaacgcgggccttgcgcacgacggcgaggatttcatcggcgtaggcatcggccttctcccgttcagcggaattgtcgccgcttgattcggattggttcgccgcttgaggatgtacatcatctcgctgagcatcagccgcagccggctcatcaaacgccgcgaacaatctatcagcattcggcgatttggagatgcgagaaacgactttggccgcgcgaggcaacgcaccttgagcgcgggaaatgccctcaagcacggatttacgatgcttttcctgctgtttcatcttttcccatagagccagcacagcttccggggattcgggttgggcagcttctcccccgtcgttactgtcagcatcaaaagcatcagaagaatcagaggaattgccggcatcatcagccgcaaacacatgcggatgccgagtgatgagcttgttcaccaaccgatcggcgacctcatcaataccgaacgggtcctcagtatccgattcgcagacccgcgcctgaaacacggattgcagcaacacatcacccagttcctcgcgcatgttgtcacggtcgtgagtctccaccgcgtcgacgtattcgtaggtttcctcgagcagattcttgagcagcgacttgttcgtctgcttgccgtcccacgggcagccgcccggcgaatacagcacatccaccacggccttgacccggtccagcgccgtcgctgcctcagccaccggcttcaatttcgagcagtgttcgaagcctgacggcaaacggtaggctgaagcatggtattccgtcatgtcactcatcttgctcataggtttgctcctgttctcatctggatgaaccataaccaccccccgcaacgtgcagaagacctagatcatattatttgttgcggaatgttgctaaatccatctgtatctctctagccaagaacatttccaatacgccaagaccccttggaattgttgctgttccaaggggtcttagtcagaaacaaaaggtgctagttcagcacaccttccacatccagttgtgcgggtcctcgacttcgccgagctggatgccgagcagctcgtcgcgcagttcgcaggtgagcttgccggagccgccgtcggcgacggtgacgtcgaacttctcggacttgaagcgaccgatcggggtgatgatggcggcggtaccgcaagcgaacacctcggtgacttcaccggacttgatgtcctcgagcagctggtcgagggcgatcatggtctcgaccacgtcgtggcccttgtcctgcagcagctgaatcagagagcgacgggtcacgcccggcagaatgttgccggtcagggacggggtctccacgtggccatccttgtgcacggccatcatgttcatgccaccgagctcttcgaggtaggtcttggtggcggcgtccacgaagcacacctgctcgcagccgttctcaacccccttgtactcgccgagcagggaggcggcgtagttgccgccgcacttggcgaaaccagtgccgccagggccggtgcggaaccacttgtcttcaacccagatgctcaccggcttgacgccgcccgggaagtacgggccggacggggaggcgatcacgcagtagtcgacttcctgcggggcgcgcacgccaaggaacggctcggaagcgaacatgaacggacgcatgtacagcgtgtactcgcggcgggacggcacccagttggcgtcgcgcttgaccagcgcggccacggaaccgaggaagtcgtcaatcggcagctcaggcaggtacagacgcttggcggagttctggaaacgctcggcgttcgcatccgggcggaacagccaggtggagccgtcggcatgacggtaagccttgaggccctcgaagcactcctgtgcgtagtgcagcacggaagcacccgggtccatcttgagcggtgcgtacggttcgacgcggcggtcggaccagccttcgcccttggtccaagtcatgtgggtcatgttgtcggagaacacctggccgaaagccggcttgtcgatgagggactggcgcttctcatcggatgcggggttgtcgttcggcagtacggtgaacggttcggtgagcttgtcgagtgctgccggatcgtggtgcgtgttttcagtcatcactagctacttcttcttgactttggcggcccgaaagccaccatatggggtgtgtgctgtgcgcttgtggcgcgaactctgttgcatacttttgcacacccatgtgttactcgtgtggcagagttcacatggtgaaaaacgaagaagcccacaccgttctcaacggctgcgggcttccacgtttcagttatgttctgaattgttcgctatcgaagcgaccgactcacttggcgtcggcagccggagcagcagcgtcggcagccggagcagcagcttccggagcggcggtggactcagaagcatcttccggcacctcaacggtgacgacggactcttccgggtcctcaacgtcgagctcaacgccttcaggcagaacaacgtccttagcgaacaccttggtgccgtcggttaggccctcgacgctcacaacgatcttctcaggcaggttggcgacgtcagcgcgaaccttgagctcctgaatgtcgacgaatgccacagcagcgcccttcggggtgccttcaacgaagaccggcacctcgacgtcgatcttctcgccggccttgacctcaaggaagtcaacgtgctcgatgatgcgcttgaccgggttcttctgcacgtccttgacgacggccatcttggtgttgccgtcgaaggcgatggtgaacagggcgttggtgtgacgcagggccagggtggtctcgcgcatcggcaaggtcacgaaggcgggctcttcgccgccggcgtagatggtggccggaatcttgttggcaacgcgcagacgacgagcaacgcccttgccgaactcggaacgggcctcgccctcaagcttaatggtggtagccataatggatactccttgtatcttcgtttcgtactgtctcgctcagacgccacgacgcgccgaaagacaccctacaaggagtgaaatacgccgagtcgataacggaatctgtgtcatgtgtcagcatgccacttccctcgccaaagcaacaattgtcaagtatacgccaaccccggaccttgcgtaatgatgcttcgatgacactgcatataggccgtcccagctacgtcaacgtacggtttccgcgaaataatccctaactttgtgaagaacgtacgcttacccgttctcatcatacggttttcacgaaatcgttcgccatttcgtgaaaaccgtacgctcagcgacactcagtgtacggtctttcacgaagttgtggatgatttcgataataacgtacgatggtgagtaccatatcgggaggttgatatgactcgttcggacgacgtcatcaatgaggatggccatgacgtcatcgccgcacacactcgcgttgtcaggggcatggctgcggcacttgccgcgatagccgccacaggagccggcgtcacagccgcggccgccaacgtcatgttcatgttcgcgctggacaccaaggccaaacgttcgatgttcaacatgccgcacgaggagacaccgaaaggcatcgaattcgacatgtccgagcagcttgaggccgcccggtggttcgaggaggccaagcaatcggtcacgctgcgcagccatgatggattgaaactccacggctggctgttggacccggattgttccgacccacagccgcatctatacgcgatctgctgccatggctatgccggagagcccgcggaaatggccaaatgggcgcatcgctatgcgcaactcggttttacggtcctgctacccgcgcagcgcgcccatgagttgagcgaagggcgttacgtgggtatgggattgctggaaagcgacgatctgttgggctgggtttcgctgatcaccgcagctgatccggatgcacgcattctgttgcatggcaattcgatgggcgccgccacggtgatgatggcggccggcgatgcgcgactcccccgcaatgtcatcgccgcgatttccgattgcggatacagttccgtggtttcgcagtttacggataatgccgaggagatgttccgtttgccgcactcgttggccgcgctgctggtcaaagtggccagtcatgtgtctaaacgcaaggccggataccggtttgaggacgcctcctgtgtgaaggcattacggcacgcgactattccgatgatgttcattcatggtggagcggatacttttgtcaatccgaagtatctggacatcaattacaacgcctgcgccagcatcgaccgcgagaagctgctgattcccggcgccgaccacacgatgagcgccagcaccgatccggaccgctattggcgtcgcgttaacagctttgttaagcgggtgtttgggctgtagtagatatagagctcggctcccctctgtgaggggagccgccagcgaagctgactgaggggagcacccgtgtatgggctactcccctcagtctcactccgttcgacagctcccctcacagaagggagccaagaatggttacgcgagcaattccttgacggcggcgatgacggactgcagactcttcttcgcgtcaccgaacagcatctgggtgttgtcttcgaagtagagctcgttctggatgccggcgtagcccataccgcggccgcgcttcatgaccacgacgttctgggacttgtcgacgtcgagaatcggcatgccggagaccggggtgccgggacggcgagcagccgggttggtcacatcgttggcgccgacgaccagagccacgttggcctgcgggaactgcgggttgatctcatcgagatccacgagctcctcgtagggcacgttggcctcggccagcagcacgttcatgtggccaggcatacggcctgcgaccgggtggatggcgtaggagacttccacgccgtggcccttgagcagttcgccgaggtcggcgagctcgcgctgggcctgagcctgagccagaccgaagccgggcacgaagatgaccttctgcgcgtagacgagctgaacggccagatcgtccggcgtggtctccttcatggtgccttccggaccgtcgccagcagcggcggcgtcagcaccaccgccgaagccaccggccaagacggagagcagcgggcggttcatggcctgagccatgaggatggacagggtcacacctgcggaaccgacgagtgcgccggccacgatcagggcgacgttgtcaatcgccagaccggacatagccacagccgtaccggtgcaggcgttgagcacggagatcaccaccggcatatcggcgccgccgatcggaatcacgaagaccaagccgtagcacagggcgaacacggtggtcagaatcgaccacagcagacgctgttcgggctggacgcacagcatgaccagcgaggcgacggacagcacggcgaacagaatgttccatacgcccttgcccggcaggttcagcttcttgacccacttgataccctgcagcttgccggcagcgatgagcgagccggtgaaggtcacagaaccgatgagaataccgagaccagcggtgatgagcaccacgatgtccggggtgccttccttggtcaggatgtcgttcagggccacgagtgcggcggcgccaccacccacggtattgaacacggagaccagctgcggcatatcggtcatcttcaccttcttggcggagacgacaccggccacggcaccgatcaggatgccgacgaccagcaccaccacggcgacaatgttcacgaagcccttggcgaagagcacgatgaacgccatgagcacggccacgaccatgccgaacgcggagatctggttacccttgcgggcggtcttcggcgaattcatgaaatgcagaccgaccacaaacaggacggcagagaacaggtagacgaaccaagcgacgatgtcgatggcgccaacggttgcggaggtcattacttcgactcccccttcttctcgttcttgctggacttgaacatctcaagcatgcggtcggtgaccacgtagccaccaacgacgttcatggtgcccagcacagcggccaggaagatgaacacgtaggccagcgggctattggcttcggctgccacgatcacaacgccgacgatgacgatgccgtggatggagttcgcgccggacataagcggcgtgtgcagggtggcgggcaccttgccgatgacctcgatgccgatgagcagcgcgaggacgaacagggtaatggaaacgacgagagtaggcatggtattccttcttccttacttctcggacttctcggcatcggcagcagctgccggggcggcggcgcggccggcaaccaccagcgcgtcgtcgagttcttcggtgagatcctggccgagcttgccgtcacgcacgaagtgcacgaggatgtcggccacattgcgcgaaagcaggttggatgcggtggtggcgacgccggaggccaggtagggagcgccgatcagcttgacaccgccctcggtgacctgctcaccaacggcggagccttcgacgttgccgccgaggtcggatgctgcgcagtccacgatcacggcaccacgcttgagacccttgacgccggctgcggtgagcagcaccgggggcttacggcccgggaccttggcggtggtgatgatgatgtcaaagccggcggccttttcgtcgacggcagcctgctgctgagcctgctcttcggcgctcagcgcgcgggcataaccgccctcgccctggcccttggagaagtcaagtcccagatcaaggaacttcgcgccgagggactcgacctcgccctgggaggcgggacgcacgtcgtacgcggtgacgaccgcgccaagacgcttcagcgtaccgatggcctgcaggccggcgatgccggcaccgagcaccagcgccttagccgggcgaatcgtgccggcggcggtggtcatcatcggcaggaaggaaccgtaagcatcggcggcggtgatggctgccttgtagcccatcacggagttctgagaggtcatctcatccatggactgggcgctggaaagcttacggggcagcttttcgatggcgatgcccaccagaccggccttctcgagcgcggccacgtaatcggcatcggtgaaggaaccgagcatgccaatgacccactggccggccttgagcttggccacggtctcggcggacggtcggtccacaaaaccgagcgcgtcggcttcggcgagcacctcgtcacggctggtcaccttcgcaccggccttttcgtaatcctcatcggtgtagtcggcagcaatgccggcacctgcttcaatcagtgaggagacaccgctcctcttcagccgggtgacgatatccggcgtcagcgcgacgcgggattccgtttcggacgtttcgttcaaaacgccgaacaccacggtggcttctgggttttgcgccatgagagccctttcttgttctacttcaaaatggacatggttatccgcatggtaagtgtagtcgaaaggtaaagaccatgacttgagattccgccaatcgaaacagaaacgaacccgaaattagtaagaaatacgaatgtgtccatgtgcattgcggatgaattgctcggaagccgtccaacaatcacccggcatcgatcagcaaccaaccgctcaataattatcgacaatcgccgtttcgcagctcacggttactcaacaatatcggaacctgtgcaatattttgccacgcactcccctaacccgccagaatcctacggttgcgtaaggtgacgagttcggtttgggcgattacaatttgaactttgagaagcgttcgcctcatggctggacgacactgaaaggtttacaggagcaagacttgtcggttatcaattccttcacgcagcacacgatcaatctcacccgtaaggcgctcaggttgggatccgacttcgtccacccggtccacgacgacaccccggacgagcccgattacctgtccaacgccgacgtgccggtcgaggccaatatcgctttgcctcacagcgacgattgggacgacggccacctgaccgtcaccgacatcgaccccgccaccggcctgctcaccacctccaccgaaggcaatccgccgctggacgaaggtacgtccatctacgacctgtatgcggaccgcgccgaacgtatgggcgatgagccgctgtacacctacaagtccggcaacgattgggtgaccgtcaccgccaacgagttcctggctgacgtgcgtgccgtggccaagggcctgattcattacggcctgaagaagggcgatgccgtggcattcatgtgccgcacttcctacgactgggacctgaccgacgcggcaatcatggcctgcggcggtgtgctggccaccgtctacgacaccgattcggccgagcagattcgcaatatcgtcaacaactccgatgcccgactgctgatcgtgcaggacacggacatgcgtaagaaggcggatggggccgtcgaagagtgcccgtccctggagcacatcatcaccatcgagaccggtggcttggacgagatcaaggcctacggcaccacggtctcggacgaggagctggacgagcgcatcgattcggtcaagaagaccgacctgtgttccatcgtgtacacctccggttccacggccgcgccgaaaggcgtggagatgacccacgagcactactgccagaccgcgctgaatctgccggcctacatgcccgatctgctgcacgacaagaggaacaccatcctgctgttcctgccgcaggcccattccttcgcccgcgccatcaactacatcgtcgtctcctcgaacgtccgcatctacatcgccaccggcatcaagacgctgatcagcgatctgcaggtggccaagcccactctcatgatcgtggtgccgcgcgtgctggagaaggtgtacaacgccgcgtcccagaaggccggccacggccccaagggcgtggtgttcgcctccgccgtggtggccgcgcagaactatatgaaggaagtctccgccaatggcaaggcgggtgcactgacccgcactcgccgcgctgccttcgatccgattgtctactcttcgctgcgcgaagtgctcggcggtcgcgccaagtggattgtggccggcggtgccccgcttgacccggaactgctggctttcttccgtggcgcgggtgtgcctgtatacgaggggtatggtctgaccgaaaccaccgcgccgtgcgcgttcaacccgctgggtacgccgttccacgctggttccgtgggcatcgcattccccggattctccctgcgcatcgccgaggacggcgaaattcaggtcaagggtcgtgccgtgttcccgcgctatcacaagaacgacgaggccactgagctgtcgttcaccgaagatggctggtatgccaccggcgacttgggccgtatcgacaacgatggcttcctgtacatcaccgggcgcaagaaggatctgatcatcactgccggcggcaagaacgtctcccccggcccgatcgaggaagtcatccagcgttgcgagttcgtctcccaggcgttggtgctgggtgacaaacgcccgttcatctccgccctggtgacgttggacgagaagtcgttgcgcccgtggctcgccgccaaggggcttgacgagaacatgtccctcgaggacgcggcaaggaacgccgccgtgcgcgccgaagtgcagcagtgggtcaatcaggccaacgagggcgtctcccgcgccgagtccgtgcgcaagttcatcatcctgcccgaggagttcacccaggagaacggcctcatgaccgcctccatgaaggtgattcgtcccaaggtcatcaagcgctactccaccctcctcaacacccagatgtacaccaagcggaagtaaaccgtatagcaaaagctccctctgacgagggagcttttttcgtctatacgccctagaagccgaggcgttctagttgcttggggtcggactgccagcctttggctaccttgacgtggaggtcgagcttggctttttggccgacgatgcggttgaccggggtgcgcagcttcttcttgacgtaggtgaggttcgaggcgcccttgccgatgatgatcggcttctgggagtcacgctccacgtaaatggacacgttgacctgcgccttgccgtcatagccctgaccggtctcgttgtcttccggatagtcgatggaatcaaccaccacggccagcgaatgcggcagctcgtcgtccagggtctcaaggaacgcaccgcgcacgagttcggcgatggtgtcttccggacgctcctcgctgatctgatcgtccgggtacatctgcggaccctcgggcgtgtgctcaatgagcacgttcttcacttcagccagattgtcgtgcttcagggcgctcaccggcacgatgtccgagaaatcggcgaaatcgttgatttcgatgagcttgttgatgagttgctgacggccaagctcgtcgatcttggtgacgatggcaatcagcgggatgcgccacttgaacgtaccgtcctcacgcttggtggcgaagtcggtacgcagtcgggagagaatacgcttgtcgccggggccgatttcctgatcggcgggcagcaggaaggccaccacgtccacatcggccagagattcgtcgaccacgtcgttcagacgctggccgagcaacgtacgcggacggtgaataccgggcgtgtccacgagcacgagctgcgcgtggtcggcggtcaggatgccgcggatcgccttacgggtggtttccgggcgagaggatgcgatggcaatctgcttgccgatcaacgcgttgatcaacgtggatttgccgacgttcgggcggcccaccacggccacgaatccggagcgatacggcacgtcctgcttggtcacgttctccgtctcaccggtcgcgtcgacttcggcaacgccggcaacatcggaagcatcggtaacgtcaatgtcatcgacgtcgttcgtgctgttgttctggtcggtcatatcactccttgctggcggtatcatcgccttcgacgggctcgccgtcagtttcctcatgggtcttgttattttcctcgccgccctcgacgtgcgccggttctacgacgatggtggacaccttcttgcggcgtccggcggagtccacggcggtcagtcgcagaccgcgcgtcacggccgaggcaccgacaatcggcacgcggcccagaatcttggtcagcaggccgtacacggtatcgacatcgtcctcatcaatgtcgatctcgaagatctcctccagatcggcaatcggcgtacgggcgggcatcttccacttgttgtctccgattttctccggctcagtacgctgggtgcggtcgtgctcgtcttccagctcgccgacgatctgttcgatggcatcctcgatagtcaccatgccggcgatgccgccgtactcatcgaccaccacggccacatgctggcgggaacgctgcatctcatggaacaggtcgtccaccggcttggattcgggaacaagcagcggctgccggacgatggattcgaccgcgcgctccatggccgccgggttgaaggcggtggcacgcacggcgtccttcaaataggccacgccgatcaggtcatccacatcctcaccgatcaccggcacgcgggagaaaccggagcgggagaacagtttcagcgcggaagacagtgtggagtcgcgctccatgcagatcatatcggtgcgcggcaccatgatctcgcgagtcaacgtatcagacagggtgagcacgttgcgcaacatttcggagacttccggatcgaagtcgttggactccaccagtcggtcgatggcggccttgccctgctcgagctgaatcttctcaagctcctcgtcgtcggacagatcggagtccttggagcggcggcccggtcccttggaaccggacttgtcgccaccgatgcgtgcgaacggcgtgagcttggtggccaacgacacgatgcgcgagttggaaatcatgatgccgaccggcttggccatgccggcggtgcgcgggcggaccagtacggagaccacggctacgataatcgcgaacaggaatccggagagcagttcaatccacagttccgcaccccacagggatgcgatggaagacaccagtacgccgtcgagcacattgcaggcgatgcggaagaacgcacagctgccggcggtggcgtaacggtcggcgatgagccgttgcacgcgatgaatcttgtcgatcttcttcatcttgaggaactggcttgcttcggagtcggtctgcacctcgaggatgagattgttaaggctggctcgcgttacgcgggccacggcgccttcagcggcggccatggtcagcgagagccagacgaacagggccgccacgagtacaagaatgacggtgatggcgatcggcgtggtactggaatactccataatgatttttcggtgtccttgaatgtccttgaacggtatcgaataatccggatttggtgtgattgatttgggagcttatttggaatcgaggtcgcggccagcaccgtgcgcggcgtcgtacagggccagcgcgtcgggtgtgccggcgggcagcgtggcctgcacgttggcatcgtggcgtagggcgaagaaggtgagcagcagctgtcgctgcaggccgaacatctggcgctcctgctcgggggtcacgtggtcgtagccgagcaggtgcaggatgccgtggatggtgagcaatagcatctcctgcatggtgctgtgcccggctgcggcagcctgttgggcagcgacccacgggcagatgacgatgtcgccgagtactccttccatcacggttttgccgtcgccggggcgcagctcgtccatcgggaagctcatcacgtcggtcgggccttcgaggttcatccaacgcatgtgcagttcggcgatgggatcgggatccacgaacatgatggtcaggtcggactgggtgctcacgcgcatctggtcgagtacccaaatacccaaatcggagaagaccttggggtcgatgacccactgggtttcattggtgacgtcaacgctcatcgtctgtctcgctttggttggttgaatccgcttgctggcgggcatcgaagtcggtatggttgcggcggcccttgcgttcgatgtcgcggtggtcgccggcgatggcggagtgacggtcgtaggcggccacgatctgtccgaccagctggtgacgtaccacgtcctcggttttgagatgcacgaatgcgatgtcgttgatgccgcccaggatgcgttcgatggtggccagtcccgagcgaggcacggtcaggtccacctgcgagatatcgccggtgatgaccatcgtggtgttgaagcccagacgggtcaggaacatcttcatctgctgttcggtggtgttctgagcctcgtcgaggatcacgaacgcgtcgttcagcgtacggccgcgcatgtaggcgagcggcgccacttcgatggagccgtcgtccatgtaccgcttgagctggtcggcgccgagcatgtcgccaagcgcgtcgtacagcgggcgcagatacgggtcaaccttgtcattcagcgtgccgggcagaaagccgaggctttcgccggcctccacggccgggcgcgtgaggatgatgcggcgaatctgcttgtcctggaaggcacgcacagccttggccacggccagatacgtcttgccggtgcctgcggggccaatgccgaaggtgatggtgtgcgattcgatggcgttcacgtaggccacttgtccggcggttttcgcacggaccggcacgccggcagcaaaggtgatgacgccgggaaccgtgggcttgcggtacgtcgggtcgtgggagccggcagaacgtgcatgggcgcgttcgtttgaggtcgattgcgccagtttgtcacgcaccgggccgtgaccgggatgttcgaggcgcacgtggttcttgagcacgttctggtcgagcatgcgacgcacggtgtcggcgtccataggcgcggtgtaggcggcttggatgatggtattgaccaaatcctcggcctgtgcggcctgggcttcggtctgcttggagcgggagacgatcgccacgcggttgccgcgcacgataatcgtcaggtccggaaaggcgcgctctacctcgcgaatgacctcgtcaaccgggccgagcacggcgacggggtcaagttggggcgggatggtgatggtacgtgtagtcgttgccacgaagcggatattcccctactactcgtcgagcttttcgccggtcatcacgtgcgcgtgcacgtggaagacggtctggccggcgtcgagaccggtgttgaacaccagtcggtaggcgccgtgaaattccttgtcggcgatgttctgcgcaatggagacgatgtgggccagctcggtcgggtcaccggcggcaagttcggcgacgttggcgtagtgcttcttgggcaccacgagcacgtggaccttggccttgggattgatgtcgttgaatgcgtaggtcgtctcgtcctcgtagaccttgctgctgggaatctgccctgcgatgatcttgcagaacaggcaatcgtcggattcgctcatcatgctccttggtttgatgttgctacgcaccagcttagcgcgtgggcgttactcgtaacgtcccaacacccgagacaacagcgacaacgctacaggaccggccgtcgcggctctcagaatattgcgccccagtacgcagctcaccgctccggccttgacgaaatcagctacctcctgctcactgatgccgccctcaggcccgaccaccacactgacagtccgcggcaggccgtcctggagcgtgcgttccaccaactgcgcaaccttctcctccacgccggaccacgtatcggtagcatcctgatgcagcacaatcaccacatcgccatgcacgcaggccctgcggcagatggccacgacctccttgctggacgcacacgcctccagttgcggcttaaaggcgcgccgcgactgctcggtggcggcatccagtaccgaattccacttcttgtctgtacggccgaccttccacttggcaatggatcggtccgcctgccatggcaccacttggtcgacgccgatctgagtagccatatcgatggcctgctcatcatggccggttttcgccaatgcctgaatcagcgccaaccgggtgagcggctcgggttcgcgccccacttccacgacttcagccagtccggcttcaggatcggccatcactgcctggattctcaagccgctgccgtcggaaagttgcaggctgtcccctgccttgaatcgcatggcctgcacggcatggcgcttgatgtgagcgggcagggttagcttccagccggcgtggagttcgtcgctgttcaccgggacgtcgtcgacctgcgggtcgaaaagaaaaagggcatcagtcatgacttcaaggctacacgcgacacgccgggcacacgcgcgaattgcatcccggtaatttcatgctaagctatctactcgttgtccaaacgacacctgcccgggtggcggaatggtagacgcgctagcttgaggtgctagtgcctattttatacgggcgtacgggttcaagtcccgtctcgggcacagataaaccccttgcattgcaaggggtttttcgttatctgcacacacgaaaggccaccaatgcagttcatcacgctggacaccgtcgacgacccgcgcgtcgaagcgtatgtgagcctcaccgaaatgcagttgcgtaatcgcttggaaccagccaagggcgtgttcatcgccgagtcccccaaggttatcgaccgcgcgctggccgctgaccgcgaaccgctgtcactgctggtcgaggaaccttggctggagggcatgaaagacaccttcgacttcatcgacgggcgctggggcgcggatattcccgtctacgtggcctcacctgagcagctcaagcgtctgaccggctaccgtttgcatcgcggcgccctatgcgcgatgcgacgctggccgttgccctccgtagccgaggtctgcaagagcgcccgccgcgtggcagtaatggaaaacatcgtggaccacaccaatgtgggcgcactgatgcgttcggcggccgcgctcgatgtggatgccgtgctggtcacaccctcctgcggtgatccgctgtaccgacgcgccgcccgcgtgtcgatgggcaccgtattccagattccgtggacccgtatcaccgggttcaacgacgacggcaccgaaaacaagcattactggccgttccagggcatcgacgagttgaagtcgctgggcttcaccaccgtggccatggcattggaggatcgttcgatttcgttggacgaactgacacgccgtctgcacgcgcctgccgaagatccgacgcatatcgacaagctcgcgctgatcttcggtaccgagggcgacggcctgtcccaccatacgattgcccgcgccgatttgaccgtgaagattccgatgagccacggcgtggatagcctgaacgtggcggcatccagcgcagtggcgttctacgcgacacgctaaggaatcgcacgcgctccgaaaaggccggatccttaacaaatctacgaaactgttcatcgcaagttcacggcacgcgggggcgaaagccttgcatgttcgtttttttctgcaattattaactatgtaaaccgaatgcaaggaagcatccggcccggcagtgcggtgtcgaaagacgctcagtaacagagaggacagttacgatgaccaagaatcccaagattctgtcgattgtgcttgcaggtggtgaggggacccgcctgatgccgttaacccgtgatcgcgcgaagcccgccgttcccttcggtggtgtgtatcgtctgatcgatttcccgttgagcaacctggtgaactccgggtaccgtcaggtcgtggtgctcacccagtacaagtctcactcgcttgaccgccacatctcccaggtctggcgtttctccccgctgcttggctcgtacgtctcccctgtgcccgcgcagcagcgtctcggcaagcactggtatctcggctccgccgacgccatctaccagaccatcaacatcatcgaggatgtccagccggacatcgtggtgatcgtgggtgccgatcacgtctaccgcatggacttcgaacagatggtacagcagcacatcgagtccggcgccgagttcaccgtggccggtatccgccagcccatcgaggaatcgaaccagttcggtgtgattgaggtcgatcccgatcacccgaacatgatcaagaacttccaggagaagccgcccaccaccaccggtctgccggacaatccgaaccagattctggcctccatgggtaactacgtcgccaacaccaaggccctgttcgaggctctggctctcgatgagaaggctgccgacaccaagcacgacatgggcggcgacatcgccccgtacttcgcttcccgcaacgaagccggcgtctacgacttcaactcgaacgagattccgggctccacggccactgatcacgcttactggcgcgacgtcggtacgattaagcagttctacgatgcgcacatggatctgatcgcctatgtgcccgagttcaacctgtacaaccaggattggccgatttacacgatgtccggcaacctgccgccggccaagttcgtgcacgccggccgcgaccgtctgggccacgccaccgattcgatcgtctcccccggtgtgatcgtctccggcggtgaagtgcaccactccgtgctctcccccaatgtgcgtatccactcgtgggcacagattgtcgattccgtgctgttcgacggtgtagtcatcaaccgccgcgcccgcgtgtacaaggcgattcttgacaagaacgtggtgctcaccgagaactccactgtcggcatcgataccgagcacgatctggcccgtggcttcaccgtcacgccggatggcatcacggttgtcccgaagaacaccatcgtcgatgactgattgaccagtccagacatggaaaagccccgcatcatgcggggcttttctcgtatagagctccctctgatgagggaacttactaagcgctatcagtactttggcatattgtcgaagctgaagcctagggcggcgagctggtcgcggccttcgggcgtgatgcgctccatggtccagcgcggatcccacgtccagtcgatgcggaactcctcgaccagaccggccagcgtggatgcgcattcgtcctcgataaggtcggtcagcgggcaggccggcgtggtcagcgtcatcgtaataatggcgcggcctagctcatcgatctcaatgccgtagaccagacccaaatcgatcacgtcgatgccaagctccggatcaatcacctgatgcagtgcctcgcgcacgtcttcggcagtggcgcggccgatatcgtcaatcgccttgatcggaatctcgctgccatcggactgttcgtcatcctggcaaccgcatttgccgtggtgaccgccacacgcacaggtgtcatcgccggacgcagcagagtgctcgatcgggcgtccgttcgggaagcccttggccaaggccgggttggccatcacgcggcgagcggcctcctcgtcctgcaggacgccgttgacagcatcgaaaacggacggctgtggttcgggaaccaaattatcgttggacatatttcctcagttctttgcagcgagggctttggcgatggagtccttcagcccttcccagcctagcagagcgcatttgatgcgcatagggtatttcgacacgccttggaataccacggcgtcgccgagcttttcttccaggttctcgtcgtccagaccggcaccgcgcgattccatcagcttgtggaatgtctgttccagatccatggcctcgtcaacggttttgccgtccaccagatcgaccatcaccgacaggctggcctgcgaaatggagcagccgtggccgtcccacaccaatcgcttgatggtgtgcggttcgtcatcggagacttcgacatggatggtcgcctcgtcgccgcaggtcgggttgaactggtgcgattcaccgggcgtgcagtattcgtggctggcttgtacggtgacattggccgctgcgtccgcggactgttcgaccgctgcgttgggcgcaaaggattccttgccatgcggatgtttcgacgcctcgaggatgacctcttggtacatctgttcgaggtcatccccgctcataccgaattcgttcatggtgttctgttttactccactccaaagaacttacggatgcccttggccgcttcgaccaacgcttgggcatcttcgaccgaattgtagacaccggaggaggcacggttggatgcgtataggccgaagtggcggtgtaccggctgggcgcagtggtgtcccacgcgaatcgcgatgccctgggcgtcgatgaactggcccacatcgtgcggatgcacgccggccacgtcgaacgccacggtgccgatgcggtccacgttttcgcgcggcccgaggatgcgaatgccatcgacgtcgccgagcttgagcagttcggcggcgatggtcttctcatgggcttcgatgttctcgagcccgatgttcatcatccattcggcggcgacgcctgcggccaccacttgggcgaccggctgggtgccggcctcgaagcgggccggaggggccatgtattgggcctcgtggtccatgtaggcgagctcgaccatggagccgccgaagttggccggcggcagggcttcgagcaggtcgcgcttaccgtacaggaaaccgacgccggtaggaccgtacatcttgtgcgcgctccaggcggcgaagtccacatcaagcgcgtggaaatcgaccttgaggtgcggtacggactggcaagcgtccaagatgaagatcgaacctacttcatgcgcacgcttgatgatcggggcgatgttggtgatggcacccgtggcgttgcccacgtgggtgacggccacgaccttggtacgctcggtgatgacttcgtcgaggttgtccgtacgcacacggccgtcctcggtcaggtcgatccacttgaaggtggcgccggtacggtaggacagctcctggaacggcagcagcaccgaatgatgttccgcacgcgagacgacgatctcatcgcccggcttcagggcaaaacgcttggcggcttctcccccacgccccagcgatgcattgccgaatgcggtggcgagcaggttcagtccggccgtggcaccaccggtgacgacgacctcctcttcaccttcggccgcattcgcgccgaccagcttggccaccttggctcgggcctcctcaaaggccatggtgctacgggcggccagctcgtgcgcaccacggtgcacgccggcgttaattgtacggtagaagttcgcctcggcgtcgatcaccgcattcggcttctgcgaggtggccgcagaatccaggtacacgagcgggtgcccgtgaatctcctgatccagaatcgggaactgcgcccgaatcgccttaaaatcaaccattatgttccccctacttacgtaacaattgtacgaaacgagtgggagtctgacatggcctgttcgcgaccgtaaagacctggcctaagcggcccggagcgtgtcgagaatagggcatgtcagactcccacggtcacggactcaggccagtgcggactcggagtcggcgccttcgggcaggtactggtcgtagccgttctcttcgagttcgtcggccagctcagggccgccggtcttgacgaagtggccgtcggcgaacacgtgcacgatgtccggcttgatgtacttcaagatacgggtgtagtgcgtgaccatgaggatgccgaactggttggcttccttggcgcggttcacgccttcggacacgatgcgcagggcgtccacgtccaagccggagtcggtttcgtcaaggatggcgaacttcggtttcagcagttcgagctgcagcacttcggcgcgcttcttttcaccgccggagaagccttcgttcacggaacgggaggcgaacttcgggtccatcttgaggcgcttcatggctgcggacaggtccttggcccactggcgaataccgggagcctcgccgtcgatttcggtcttggcggtgcgcaagaagttggtcatggacacgcccggtatttcgaccgggtactgcatggccaggaacaggccggccttggcgcgctcgtccggagtcatcttgaggatgtccttgccgtcgaggagggcctcgccggagtcgaccacgtacttggggtggccggccaacgtgtaggcgagagtggacttgccggaaccgttggggcccatgatggcgtgggtttcgccggagtggacggtcagggtggcacccttcaggatcggcttgatgccttccttggtttcgacgtggacgtgcaggtccttgatttcgagtgttgacattgttgtgctcctaaaaatgctgttcttacttgtcttcgaggacctgtgccatggcgtcgttttcaccacgggccagtcggcggtcaatcacggtcatcagatgttcggagatggcgggaatgccgatctcctcgacgagttcgccgaagaagccgcgcaccacgagcttgcgggcgtcggtttcggggatgccgcgggattcgaggtagaacagttcctcgtcgtcgaagcggcccaccgaagaggcgtgaccggcaccgatgatgttgccgttttcgatttcgaggttcggctcggaatcggcgatggcgcccggggtcaggaccaggttgcggttgagctcgtaggagtcggtgccgggggcggtgggctggatgagcgcgttgcccacccaagtggagtgcgcgcccttgccgtcaagcgcgcccttgtagaccacgcgggacttgcagtcggggtggttgtgtaccaccatcgtgcggtgttcgatgtgctcgccggggtccacgaagtagatgccgagcatgttgaggtcgccctgttcgccgccgaagtcctgatccatgcggatgcggacgatgtcgccgcccaaggtcacgacggagtggcgcagggatgcgccttcgccgacgtggatgcggtggttggccacatgcttggcggttttggcccattcctgaacgaacgtggtggagacgtgcgagtccttgccggtggtgatttccacgccttcggccagtcgtgcgtcaccgtcgtgttccacgacgacgtccgcatgagccttgtcggcggcggcgatcaccagatggaaagcgtcgagatcctcccccgcgccgtgcaccttgacgagcacgggctgggcgatctcaccggacagtcccagaatggttgcggtgcggccggattcccattcgactgcggagacgcggtcgttgggcttggacacagtgccggacaggccctcaccgagcttgatctggctgagcttcacgccttcggccaacggcgagccgtcaatcatggagacttcgatctgcgtttcgccggaaggcttgaacacggtgaagaactcgttgatgcgctcgataggcgtgtagcgccattcgtcctgcttgcggctgggctccgggtagtcgcctgcgttgaacgagcgcacggcatggtccacggaggacggcatagcggccggaatcgcgtacgggtcgttggggtcggcgaccggaatcttgatttccttgacgggtgttgtgttgtcggtcatcggaatcagcccaccgatccttccatctgaagttccacaagtctgttgagttcaagcgcgtattccatcggcagctcacggctgaccggttcgacgaagccgcgcacgatcatgcctcgcgcctcttcctccgtgagacctcggctcatcaggtagaagagctggtcttcggaaatcttggaaacggtggcttcgtgggccatcgaaacgtcgtcttcgcgaacgtcgacatgcgggtaggtatcggagcgggagaagtcgtcgaccagcagggcatcgcacacggtcgagttggacgaaccgtacgcgcccttgacgattttgaccagaccgcggtaggcggagcggccaccaccacgggaaatggacttggcgacgatggtggagctggtgtgcggggcgaggtgaatcatcttcgcgcccgtgtcctggtactggcccttgccggcgaagccgagggacatggtggatgccttggcgtacggttcggcgaggatgcaggccgggtacttcatggtggccttggaaccgatgttgccgtcgacccattccatcgtgccgccctcgcgcacgtaggcacgctgggtgacgaggttgtagacgttgttcgaccagttctgcacggtggtgtaacgcacgcgggcgtgcttttcgacgatgatctcgacgatggcggcgtgcagcgagtcctcggaccagatcggggcggtgcagccttccacgtagtgcacgtaggagccttcgtccgcgatgatgagcgtgcgctcgaactgacccatggccggggtgttgatgcggaagtacgcctgcaacgggatgtccacatgcacgcccttcggcacgtatacgaacgagccgccggaccatgccgcggtgttgagggcaccgaacttgttgtcttccggaggcacgacggtgccgaagtacttcttgacgagttcagggtattcgcgcacagcggtgtccgtgtcgacgaagatgacgccctgcttcttcaggtcctcctggatggagttgtagatgacctccgactcgtactgggcggccacgccggagacgaggcggttcttctccgcctccgggatgccgagacgatcgtaggtgttgcggatgtcgtcaggcagttcgtcccagcttttcgcctgcttgtcgattggcttgacgtagtacttgaagtcgtctgcgttgaagccggagagatccacaccccaatcgggcatgggcttttcgaggaacgccttgaatccacgcagacgcatgtcgagcatccactgcggctcgcctttgtcggcgctgatcgcgcgtacgacgttctcatcaatgcctcgttttgcggcttcgccggcggcatcagaatcatgccaaccatagttgtagtcgccgaactggctgatgatctcgtcatccttcttgatcttgtcctcgttgacgcgggtacgatcagccacatactggctcatctccacgtcagcggcggcgtttggtgctgtgttttcggtcaccatcctgccttccttgtatcacacttaatcctatgaaaacctagcagaacccaagtgcaaacactagccgccctgacgcatattggctgtgggcttgattacacgaatgcgatacagcgatattggagccgggcaagcttgtcccatgcacaccgaacatcgcgtatgcggcattatgtgtcgcaccactgcatgccgtatttgttacatatcacactgttgcatatcacacttggatatgcacgctcgtgcccatattgcaccagttgtagaaccattcggccacatcccatccgatacccacgcaaccatgagatccgttggcaatggagggcattacggcatccgctacatatccgccggcaatacggtggattgcgcaaccggaggagaagtaattgacgaagcccacgtctttgacatcccatgtttccaccgtgccatcggcaagattcagcgtgccgctcatatcttgactgggcaacttttgccatacgttgaagtcacctgtcggcgtacacatcatgccaacgcattcgccggtgacgttgtcgttgccctccgcgaccacgacattcaatgtcttgaccaccgtgtcattctcataggcatagagcttacggtcggacaggtcaatcgccacgcgatgagcgaccttgacttcctgtttgggatctaccttgccgtccacattcactgagccagttcccgtggccagcacctgagccaagcgagcaccaacctccgtatccgcgccatcggcaatcacaatgccatcatggccttctgtttcagtgctcagcacctcgccagcattattgacgacgaccttcttgtcttcacgttccaatttgagattcggcttgatttgctcgtcatagtattgctgcagcttatcggcatcaaagaccacgtagccattacgtacttcattgtctttcagctttgactgctggttggcgtcgatgcgcatggccgaacccagcatggacgcattcacggtggcgatgtctttatccgccaccttgatggccacggcattgttcactagggtttccagcgtggttttcgcctcatcggcaattgcattggtaatcgtcggttcggttacgtcgagttccacccgaacggtctgtggctggacactgcccaatgactccactgtggaaatggcttgcttcgcaatgctggtggcgttggctccctggccattttctcccgcaataacgttgaagccactgttgttatcgttcaatgcgacttgcgcgtcaacaggttcttgtgcatcaatgttcagcgccttatctaccacactgccatcagcgagctcgggattgatttgcggggccacatcatgcgtaatccagaacgcatactgttgccaccatgcgtcaccgcgttgggcattgatgacatcggatgcgattgcttcaccatcaacttcgatgccgagatctttcagcgtgaacgtcgccgactgcccctggtatttcgctcgtaccgcggtgttgtcgacctggtcgttgattaggtcggcaatctcctgctcggttttgccggtaactgaatttccccatagcgttgtgccaggcagcacgtgatcttggaagaaccaaacaccgccgccacaggcagcccccaaggcaaccagcagacaagcaatcaccacccacggccagatgcggcgcctcctcatctcatcgccctgaatggaatctgatgcagcagcatccacactgtctgccacagtgccgctgacggcattattcgcaccaaacagaggcgcaaactgctgggtcgagtcatcaaggtgttcggtcatggtcggtctttctgcgatggcctactaagcgttatctgcatactaccaacacaccatagaaacggtaatttttttaccgtcgccttccaatacatcatgctgcatgctgctcatacaacaaaaaagacgtggtggcgaaacatcattagatatttcgccaccacgtctttaccgtatgtcttgcactacgccgatgacggcagccagcacatcatgccgcgatattatgcacggcacgaaagtgcgtcagcgcgccgcctgatggtcgagcgcggccttgaccaggccggcgaacagcgggtgcggcttggtcgggcgagacttgaactccgggtgagcctgggtggccacatagaacgggtgcacgtcctgcggcagttccacgaactcggtgagctcgccgtccgggctctggccggagatgcgcaggccgccttcgcgcagacgatccttgtaggccacgttgacttcgtaacggtggcggtgacgctcggtgacatgcgtggtgccgtacagttcggcgaccagcgagccttcctccagctcagccgggtaggagccaagacgcatggtgtggcccatgtcgcccttgccggccacgatgtccttctgctcttccatggtggcgatcaccgggttggcgcaatcgggctcgaactcggaagagttcgcgtcttcaatgcccagcacgtggcgggagtattcgatgaccatggactgcaggcccaggcacaggccgagggcaggcagcttggtttcacgggcgaacttcagagcgccgatcttgccgtcgatgccgcggatgccgaagccgccggggatcacgatgccgtcgacgttgtcgagagcggcggccgcaccttcggtggtttcgcaacgatcggccgcaacccacttgacgttgaccttggcccagttggcaaagccgccggccttgatggcctcggtgacagacaggtaggcgtccggcagatcgatgtacttgccgacgatggcgatgttgacctcgtgcttggggtggtgcacacgctccagcaggtcggcccattcgtcccaatcgacgtcatggaacggcaggccgagctcacgcaccacataggcgtcgaggccctcctcgaacaggatcttcggcacatcgtagatgctcggcgcatccacgcagttgaccacgccttcggcatcgacatcgcacatcagggagatcttgtccttgatggactgattgagcgggcggtcggagcgcagcacaagggcgtccggggaaatgccgagctggcgcagcatcatcacggagtgctgggtgggcttggtcttgagctcgtgggcggcggaaatgtacggcaccagggaaacgtgcacgaacatgcagttgtccgggccgagatcgcggcgcacttcgcgggcggcctcaaggaagggctgggactcgatgtcgccgacggtaccaccgatttcggtgatgatcacatccacgtcatcggaagcctgggcgcgcatacgagacttgatttcgttggtgatgtgcgggataacctgcacgcactggccgaggtattcgccggcgcgctccttgcgcagcacttcctgatagatctgaccggtggtgacgttggccttctggctcaggaagacgtcgaggaaacgctcgtagtggccgatgtcgagatcggtttcggcaccgtcttcggtcacgtagacctcaccatgctggaacgggttcatggtgcccgggtcgacgttgatgtacggatcgagcttttgctgcagaacatggataccgcggctgcgcagcaaacgaccgagcgaagatgcggtcaggcccttgccgagagaggagacaacgccgccagtgacgaaaatatgcttggtgacgtgttcttgagaattaccatgtgttcttctaaccatggaatttcactctatcatccgtgtatgacccggcgtgttcaccagacgtgtcggccccgacatggcgtacttgaacaatacgaatagtaggctcgtcaaaaagcatacgcaaggtcataatcacgtcaaacgtcttatccgccagctattgcaggtattggtcgagacgcactaggcctaacgcatataggacaaacgctgttttcaggtttttcagcgaggcccattcatcggcaccgtgcgcgttgccggcacctggtgcgatgaatggcggggtctccaggtcgatgccgtcgaccgccggcacatggtcggcatggaattcgggaccgaagttgagtgcgcgcgggataaagcgggcgtgggtgccgtcgccgacagccacgggtcgagcctcgcaaccgagcacgtcgttgtaggttgcggtgagcaactggacacgcgggtcgtcagcctgcacgtagtatgggtcatcgttaaggatgtcgacaatgcggccgcccgccgcttcggcttgtgcttgaatacgctcgatgatttgttcgtgtgcctggcctaccgcataacggatgtcgaagtgcaatacgatggcatcttcagaagtctcacctgataccgcgcctaataccttgtctgcttcagcgaactcattcgccggtataatcaaaccaccattggcggtagtcggtccgctttccgcattctcgcaatcgatacccaagccggtgccatatgagtcttttgtccattgggcaatcgcctgtgctgcagtgaggtcacggccttcgagcagaccggaccgggcaagcgccgtagtgagcaccgctatagcgtttacggtaccggacggctggcaggcatgaccggcaacaccggtggcctcaatcgtgacgccttgcgctgttgcgttgatatgcaatcgctcggcgatatctggagcgatgttgccgctctggcagaatgcttgccgcacggtagattcgtcgacgccggtgagggtgattgcggcggccccgggaaccgtgttagtggcggtgccggcatgccaaccgcgcaattgcggcccgaccggcagttcgacatccacatcgagcagtcctttttggatattgttcaccgggaagggaccatcgatgacgatggcctggtacggcgcgccgatgttggcgacgaaccatttgatgtcgttgagcgcgatctcttcggagccgccgaacagtatacgtacgcggtggcggaaacggtggtcgtgttccttgaagaaacggagtaggaaatagctggtcagcgcgacgcctttattgtccaatgagccgcgaccgataacaatatcgccaatagcctgcggatcgaaggcatcgtgcgtccaaccgtcgtcggcggggactacgtcgaggtggtcgacgaaggcgatgtcacggtcggtctccacgttctcctgtggataaacgacttccatgacgtggccggtgtagtcgcgcgtaggcagcccgtctcgtcctgccttggccagcatatggtcgaatacacggcgtacttcgggtccataaggcgcgcccggacgaggattcgggtccgattcgtcggaaaccgacgggtagcgcagcagctcacacagctcatcgacgaactgtgcgcggtgggcgtcaaaccagcgtgacgcggcatcgacgagatcacgttccgtggcggtgagagtcatggcttcctttacttggacgcttatggtttcctcaggtaacaggaatcccgggcgcaacgtcgactgctacccgggattggctggagggcttggttctattcgctcagcaagtgcgccacagcatcgagcgcgagcttgtagccgtagaaacccatgccggtgatggtgccggtggccacagggctgattacggaacgcttgcggaactcgtcgcgggcggacgggttggagatatggacttccataagcggcaggttctcgtcaatgaccatgtgcgcggcgtcggcgagagcatacgaatagtgcgtgaaggcggcggggttcatgaccaccggggttttctcgtcggcggcttggtgcatccagtgcaccatttcggcttcgtcgtcggtctggcgcacctcgacttcgaggccgaggtccttgccccattcggcgcagagcttgcgcagggtgtcgaggtcctgacgaccgtagacgtcgggctggcggacgccgagacgtccgaggttagggccattgacaacgatgactttggtcattgggactccttttgtttgtgcttctctccctccaccccttcggggcacctccctcatcagagggaggtagaaggtagatccgactccggggcacctccgttagaggggagccaagtacttttttctgaggggatggcgaacggcacggcctacggccgttcaattactgctggatacgacggaatgcttcttctacggcttcggcgggcgggttgtcgaggtgtacgacgtgaccaatctcgtcgaggaccacgaagcgcagttcgttgccacgggctttcttgtcgcgatgcatcaatgcgagcacgtcgtcgaacgagccgccattccacgacgtcggcagacccagcgaagcgagcaacgagcggtgatagtcaaccagatcctgatcgatgtaaccgatcagatgggccagctcggcggcatacaccataccgacggccaccgcattgccatgcctccagcggaagtgctcgagcctttcgatggcatggcccatcgtgtgcccgtagttgaggaattcacgcagccccttctccttcaaatcggaggagacgtggtaggccttgacctttaccgtgcgctcaatgagctcggcaaccacgtcttcgagcggcgagccgaggaatgtagagccgtcgaaagcgcgcagttcagctgcgtggtcttcgaggatatgcaggatttcggggtcgcggatgaaaccggatttggcgacttcgccgagaccctcgatgaagatgtcattgggcagcgtagccagcgtcttggtgtcggccagcacaccggcaggcgtgtagaacgagccgacgaggttcttgccctgcggggtgttgatgccggttttgccaccggtggaggcatcgaccatggccagcagcgaggtcgggcagtttacatagcgcacgccgcgcatccacgtggcagccacgaaaccggccaaatcggttgcggcaccgccgccaagccccaccacggcatcggaccgggtgaaaccttcgtcgccaaggcgttcccaaatgccgttggccacggtaatggtcttgccgggttcggcatccggaatcacgatgtcggaaacctcatagccgccctgacgcaacagggcgcgggcacgatcggagtgtcgctgcaccggctgagtgtggataagcgcgattttggcgggtttgggtcccagcacgtcgaccagatggttcatggcaccttcgccaatgaccacatcatacggctcaattgccgctccggtaacatgcactgctcgctcagataccatatcaatcactttcttcgctgcgccctgaggcgtaagcccccgggtatggacatgaacgttggcgacctcgcggaatactgggtcacgctgcttgaacagttttttccaacgggagttggcgttgccattgagcatgggccggcctcccccacggttcgcgcgttccatggcttccgccggatcggcatcaaggtagaccacacgaccgccatggtcgatgtaggaggcgagggcatgctgggtggatggcgtcatgggagcgccaccgcccagcgaaaagataccgtcgaaatcctcaagcatatcggcgatgagatcggcctcgacctcgcggaatgccggctcaccgtattcctcgaagtaggagggaatcttcatgcccacttcacgttcgatctccacatcggcatcggcgaacggcagacgcaacatatgcgccacttccttaccgacacgtgttttgccggctcccatcatgccgatgatgacggcgcgggggcgtgcggtcataatctacgaatcctctcgacgattggtgggtacagttgctgatggttccgcggcagtcgtcacgaaaccatacgcccttcgttcagcgcatgtgctccggccacgaggcgagatacgactcaaggttgcgccgtgtttcggcaacactgtctccaccgaacttatccagcgcgtacttcgccaaagtcagacgcaccatggcctcggccaccacggatgccgcaggcacggcggtgctgtcggaacgctggttgatggcttgtgcggattcgccggtcagcacgtcgaccgtacgcagggccttggggatggacggaatcggcttcatggcaccgcgtacgcgaatcacctggccattggacataccgccttcaatgccgcctgcgcggttggacagacggtcgatgcggccgtcggcgttgaccacgatctcatcatgcgcctgcgaaccggggcgggaggcttccaggaagccgtcgccgatctccacacccttgaacgcctgaatgcccatgatcgcggaggccagagccgcgtccagtcgacggtcggactccacatacgtgccgatgccggcaggcacaccgtaagccagcacttcaatcacgccgcccaacgtatcggaggcattcttggcctcgttgatgcgttcgatgatgcgggcttcggcctctttgtccagcgtacggacaggcgaggcgtcaagcgcttccagatcgtcaggtgtgggcaacggcaaatcagggttggtctgcacgccaccgagcgccaccacgtgggctacggtgcggatgccgaacgcctgatccaggaactgcttggccacctcgcccaaggccacacgggaggcggtctcacgggcgctggagcgctccagtaccgggcgggcgtcgtcaaaaccatacttgcgcatgccggtcagatcggcgtggcccgggcgcgggcggctcagcggcgcattgcggccttcgcgcggcaggtcatggtcgagtgcatcggcgctcatgacctcggtccacttcggccattcggtgttggcgatttcgatggccaccggcgagccgagggtcaggccgtggcgtacaccggtcagcagacggaccttgtcttgctcgaacttcatgcgggcaccgcgaccgtatccaagtcgacggcgtgccagtgcggaaacgatatcgtccgtgctaatacgcacgccggccggcaacccttcaatcatggccaccaatgcttctccgtgcgactcccctgccgtctgccaacgcagcataacttccctcgtttcatgtgtgtacgcctatgtgtacgtctaactaggggttaatgttaagccatgccatacctgttcacgctacccggtctgctatgtgggcttgcgctgtccattgaggatgttcgtcaccggcgggtgccgatcgcgtgggtggctgcgggcgcgttgcttcagctggccgccgatttcgcgtatggagtggtgatgaacgacctgttcgtgctgttgcaggcgctgttgttcaccgtgctatgttgcctgatccagttcgcgttggcattgctggtgccgcggtcattgggattcggcgatgtgaccgccttgatacctatgggattgtctgtcggactgtttggcctgttgcctgtggtggtctggtggctggcgatgggcgttgccggcatcacatggattgccttgtggacgcgattcgatccacaacgcacatcaccgacacatgcgggcaaggtgccgtatgtgccggtgatattggcgggcgcgattgtggcggtggctgttggggtgttgtcctagatttcttccatccgcttcgcgggagccccgggcttaagttgagcgttacattccctgcagtgctcccctcagtccgcttttttgcggacagctcccctcggcgagggagccaatgaagagaccaacgtccgatcagcttccccaagcgaaggaagctaacgggatgactactggttttcggcttgccacttgcgtagttcggccacgttctggtcatgttcatcggcggttgcggcgaacttggtttcgccggtgtccagattgaccgtgcagaagtacagccaattgccgctttcggggtgcagtgccgcttgaatggcgttatcgccgggattgctgatcggcgtaggcggcagaccggagatcttgtacgtgttgtacgggttggactcgtcttgggtcatctcggtggtcacctgcgcgggcttgacgttattgccataggccacggtggaatccatgcccaacgacatgccctgctccaaacggttctcgatgactcgcgtcactttgccgtagtaatcggctttgttgacctcggcctcggcgatagaggcgatgatcatcacccgttcgcggtcaccgccggccggcacgcccaattcatccaacttggcgatacgcttatcgaccatggccttgaggatttccgaagcgctcttcatgctcttgacgttgtaggttcccggctccagccatccttcaaagctaccgcccgcttcattgggcagaatatccttaccctcgttcttgataatcgtgtcgaattcgctttgggcaatgccggaaagcttcgcggcgttggcgaacacatcggtggcacgttcaccgggacgaacctcgaggaagcccgccgcctggttggtgtcggagagaacgtcgatcactttggatgcggccatatgcttcttcaatgtgaacgttcccggatagagtgtcgtgctattggcgttgaccacgctggtgaacgcggcagtagacttgatgacttcggccttgagcagattatcggcgatctccgccgcgccttggccctcgctcacggtgaattcgacctcgccatagcccggtcccggatagtccgcgatggccgtcgactggttgctccgactgtcacgccatgcgatgagcttggttacgccgaaatagccgccgccgataagcagggcgacgatgacgatagcgatgataatgccactgatacgcttgcgcctgcgctgtgcacgtcgcttgcgcatctccctgcgggatttcggcggttctggcggctcggccccgcgcattggttctgacccctgttcgacccaatgcgtgttgtcatcaaagaactcgttaaaatcatcggtcataaccgatacctcactgctcccgggtacggtcgagtgccgtctgcaaaatcaccactgccgactgctggtcaaccaccggcctgtgcttgttcgaagctttatgggcctcgaacagctgacgatgcgcactgactgttgtcaatctctcatctatcaatgatacctgcggaatctgatactccgtagaatcactgtcttcactctctgcttgcagcctcttctccagattggccgcccacctgcgcgcttttttggcgcttttgccttctgtaccgtccatctgcaggggcagtccgacgattacatggtccacatgttcgtcttcgatgacgttcaggacctcgtcaatagcaaagaaatagtcgccggcaacatgaatgttgccagcaggatgtgcaaaggtaagctccgggtcggacagtgccagtccgacccgggcattacccaaatcaacgcctaaccacaccactggcggaatcaggctttctgcgcctcgtgcttgagcgcttcgagggcctcgtcgatcttggaggcatcgacaccgccaccctgggcgaagtccgacttgccgccgccaccgccgccgaggaccttggctgcgccacgcaccagatcaccggccttgatgccggccttgcgggcggcctcgttggtggccacggcgaccatcggcttgtcatcctcgttcacgccggcaagggccaccaccacgggggcgtcttcaccgagctgggcgcgcacgtcgagtacggtcttgcgcagggcatcgaccgcgccaaagtggcccacgttcttgacggccaccttgaccggggccgcggagttcttggtgtcagcaaccagcgccggaaccgaggcggccagctgggactcgtacatggaggccaagcgacgatcggattccttgagcttggcgagcagggcgttcacacgctcggcgagctcgtccggacgagcgttgagcttgtcggacagctgggagaccagcgcgtgctcacgagcgttgaagtcataggcaccctggcccacgacggcgtcgacacgacgcacgccggagccgatggaggcttcggacaggatgttgaccatgccgatcttgccaacgtggtccacgtgggtaccaccacacagctcgcggctccagccgtcttcgccgatggagaccacgcgtacgatgtcgccgtacttctcgccgaacaggtgcatggcaccgagggcgatggcgtcgtcgaacttcatttccttggtggtcacggcgaggttgtcgcgcagcttgtcgttgacgcgctcctcgactgcggagatcacggacttggccggggccttggaccactggaagtcgaagcgcagacggttcggggcgtcttcggagccgcgctgggtggcctgcgggcccagctcctcacgcagcgccttgtgcaccatgtgcgtggcggtgtgcgagcgggcgatggcgccacggcgggccaggtcgatgttggcgttgacttcggcgccgacgaccagcgtgccttcggtcagacggcactggtggacgatgaggtccttgatgggcttctgcacatcgtcgacttcgagcacggcgccgtcgtcggacaggatctcgccctggtcggcgagctggccgccggcctccgcgtagaacggggtgcggtcgaggatgacctcgacgttggccgggccggtcacggcgggcacggaacccttgccttcctgcatgatgccgatcaccttggcgcgggcggacatgtcggtgtagccgaggaagtcgatcgggctgacgagcgtcttcttgaagtcgtcgtaaacggaaagatccacgttgtgacgcttcttgagggcgtcggcgcgggcgcgggacttctgctcggccatgagttcacggaacttggcctcgtccaccttcacgccctgttcggcggccatctcgagggtcagctcaatcgggaagccgtaggtgtcgtgcagcttgaaggcgtcctcgccggccacgacgggctcggcggaatcgctcttggccttgttgacggccacgtcgagaatcgtggtgccggtctcaagggtgcggcggaaggcgtcttcctcgccatacgcggattcggacacctcatggaaggtgtcgttgagctccgggtagctggcctccatggcggccttggaggtcgggaagagggtgggcagcaccggatcggtcacgccgagcatgcgcatggagcgcacggtgcggcgcagcaggcggcgcagcacgtagccacggcccacgttggacgggcgcacgccgtcggacatgatcatcagggcggagcgcacgtggtcagcgaccacgcggaagcgcacgtcggcgtcctcgttctcgccgtacttcaggccggagagctgctcggcggcctcgatgaccgggaagacctcatcggtctcgtagatgttgttcttgccctgcagcaggtaggccagacgttccaagccggcaccggtatcgatgttcttgttctcaagctcgcccacgatgtgcaggtcggtcttggacttgacgttgtcgacctcgtagttctcgaacacgaggtcccagatctcgatgtagcggttctcgtcggcaatcgggccgccttccttgccgaaggcggggccgcggtccacgtagatttcggagcaggggccgccgggtccggggccaccggtggtccaaaagttgtcttccatgcccatcttctggatgtgctcggggtccacgccctcgttgatccacatggaacgggcttcgtcatcgtcggtgaacgtggtcatccacagcttctcggggtcgaagccgtagccgccctcatcctgcgaggtggtgagcagctcccaggcgtagtggatggcctcttccttgaagtagtcgccgaaggagaagttgccgagcatctggaagaaggtgccgtggcgggtggtcttgccgacctcgtcgatgtcgagcgtacgcacgcacttctggttggaggccatgcggcgcttcggcggggtctgctcacccatcaggtacgggatgaacggcaccatgccggcgatggtgaaaagcgtggtggggttcggggaaatcagggatgccgagggcacgatgagatggtcgtgcttggcaaaataatcgaggtatcgctttgcgatgtccgcagtgcgcatgagcggatgaactccttgtttgggtaatgggcgcagttgcgcctggtattggtggaaaagactggattatgaggattagtttgttctagctgattcagtgactagatggcaaggcggcatgcgcgtgtcagttggcgcgctcgatgtactgacggttgagctcagcctcgcgggctcgacgggtggcattgaactcgttgaccaacccttcgagtgttttcatcggcacattgtcctgatcggggccaagcaggaactggcgtgccgcatcaggcgtattggccttgacataggcctgtgccttggtgacggcaacgattccgatggccacgccgacgccgacccagaagatgcgtttgaacatcactcccccttctcggcggtgtcgttgacggtggttttcgcggcgttcttcgcaaggaaggactgacccgtggttttcagcgcgtagaaggtggaagcgatcttgatgatgggcttaccgaggaaggagccatacagatcggtcaacgcaccaacgttgttggcggtggtggaagccgcggcggaaatcttgttcacgtcttcgagcgacttgttgacctgcttgacggtggtcacgccttcgtccagcgcggggatggcgtgttcaccggactcccggaccgtctgcgatatctgatcaaacatcttgcccagcctgatcagcggatagatcatgaaaccggccaatactgcgaacgcgatggccgcgatcaggccagcgatctctccgactcccattgtttcctccttgcggtcacacttactcgcctaagggtagcactccttccctatttcttggcataccattgcatgcgcagggcgaaaaccgtgcgcgtgggcgtatgcggctataggcgaaaggctgtcctgctgacgctttcgtttgcggcgtgccgccgtggaccgtacgtgctattcgatatgtattgcttgctatttgctacttgccgtacgaaacgatggtcacggcttcgccgaacggcttgtcggtgtcgaagtcgatcacggttaccgaaccattggccgggcgttcgttcagatcgaggtcagggccgccgaaccggtgaccgaggctaagcagtgtgttgccatgcgaaatctgcagcacatcgtcgccgtccttgagattcgggttgtcggcgataagacggaacgcaccttcgacgcgcgtccaatattcctcatcggattccgcgtcgtggaagggatcggcttccttgagaaaatcacgcgaggcccccaacccgaacttctcgacgatttggttgtaggttttgacgccgtggggcgctcccgcggcgtaccaggccatggccatgtcaagtccctcgtagtagccgtagaactgctcgcggaagtgcatgtccgtcacgagtgcggggcgcgggttacccgcggcttcgttgatgtcgagaattttctcggccgtctgctgggcacgcgtggtgtccgaacagtaggcggcggcgaacgtcaatcctttcagtcgctcaccggccttgacggcatcggcgacgcccgactcggtcagcggcgaattcgaccatccctgcagacggttgtatcggttgaaataggtctgtccgtgacggaccagatgcagatgaagaatcatggttctgattatgtcaccattccggcggtttcggtgcgggttgccggaagtcataagtcataacggcataggtcactacctgagatatgcgtaatccgggcagtatacctaacgattcctgagagtacacttagaatactgtgagcataaccttgaaacctgcaccatctcgatcgtctgtgcctgcccatttcaggggtatcgatggactgcgcgctctggcgattcttggagtcatagcattccacacccgcccgtcgctattgcagggcggattcattggcgtgacgatgtttttcgttatcaccggttttcttgccacacgttcggtactgaacatggtggaccgcaccgggtcctttggatatggccgatatctgatccgccgcattactcgtttatggccggtgatgctggcgaccattgccgtggtgccttggctcacttggatgttcgctcccagcctgttgcagaaagtggtttccgattcgctgccgagcgccttgttcgccagcaattgggtgtacatcttccgcaaggtgccgtatttcgaggcggccggattgccttctcctctgacccatctgtggttcttgggcgtgacgatgcagttctatctggtttggccgttgctgatggtggtgctcggcaaaatcaccaagtccaaatgggtgcgctccatggcgattcttgtcatcatggctgcttccaccgccgacatggtgctgctgtttgacccggccaatacctcccgcgtgtattacggtaccgatactcgcctcgccgagctggccgccggcgcgctgttggctatctggattgcgccttcctcgcgaggtacggaagctgcggaagctggagcggcttcgcaaacagtgcagatcgaacgtcaggccggcgacaagacgggcgcccgtctcactatcgtctgcaatgttcttggcaccgcggctttggcggcactgctgaccggattctggttcgccaacgggtatctgtcgtacatgtaccaaggcgggtacctgattaccgcgttcatatcgttgtgcgccttggcctgtgccgtgaacaatgactcaatctggtcgcacgtgctgggttgtgctcccctacgctatatcgggtcgcgatcgttctcgctgtacgtcatgcattatccgctgctgcagttcatgaacccggcgacacgaacgcaggcgttgccgtggtggggttgggttcttgaggccgtcgtggtgttggcggcgtcggaagccttctaccagctggtcgaggcggcccgtaaatcggtgcagatgcctcgtagccaacacgccaagccgctgccgaaagccggctaccggctgcgcccgggcgcgtgggtcatgtcggttatcggattggtgaccgttgtggcgctgacgtgggcaccggtggactggaatggcatcgctcaagcgcgagccattcagctgcgccccgaactcgcggcacccgccaagccggtcaagaaaccggcgaagcccgagcccgagtcttctgccataaatgccgcgaacggcgaaaccaataccgctgacgcgaataagaacggttcggattctcagccgcccatcatcaaaccgattgcggaaaaggtgccaaacaatcttgacatttcgaagtacgcctatgatccggcaacggaaagctgcaacgcggatatgatgatggtcggcgattcagtgacgtcgggtacttcggacgccatccaggccgcattcccgaacgcttttatcgatggcctgccgaaccgtcagctgccgcaggcggtggatgtgtatcagcaggacaccgctgccggccacagtggcagtgtggtggtgtttggcctcggcacgaacggcgtgatttcgaatgagcaggaagtgcaacagctcattgacctgaccggcggcaagccgacatacttcatcaccatccgtatgccatacccgtggcaggagaacaacaacaatacgatgctgcgtgaggccgccaagaagaacaagaacgtgggcatcatcgattggcatgggtatagcgaaggtcatagcgaatacctcaacgatgacggcattcatccgaatatgaccggtgcctatgcgtacgcgacgatgattcgccaggcggtgtgcggccagtaatcgccctacaacgcaggaaccccgcggcttctcgaaagaagcgcggggttcgagcggtatgtcctggatttgttgaccagagggcccggatcagcgggcgtagaattcgaccacgtactggatgttgacctgcaccgggatctcttcgacctccggcttacgggtcacagtggccttcagggacggcaggttcacgtcgaggtagccggggaccgcaggcagcacgtcacggtgcacgccttcggcggcgatctggaacggaaccatggtctggctcttggccttcacctgaatggtctggccgggcttgacgcggtaggacgggcggtccacgatgttgccgtcaacgaggatgtgacggtgcaccacgaactgacgggcctgggcggtggtgcgggcgaagccggcacgcagcaccaggttgtcgagacgggtctcgaggtcggtcagcatggcgttaccggtctggccggcagtacgggtggccttctcgtaagcggcgcgaagctgcttctcggagatgccgtactgagcgcgcagacgctgcttttcgcgcatacgcaccgcgtaatcggactcggtgcggcggcggtcacggccgtgctcgccaggagcgtacggacgcttttcgaagatgcgctgagccttgggggtcagtgcgatgccgagggcgcgagacagacgcacctgacggcgagaacgctgaacgttcgtcattggattaatccttctgtcgttatctgaacggaacgcttgccttgcatatgcctaacaagcgctgagtcgggcctccccagcgcttcgtcgtgaataaacacgaacgggttggttttcttgcgattacctaccgccgacccgctgatgggctatgactccagacggtatctacctgttggcagacaccagcagaccatattacaccgaggctatggacagcactccggcgtccatgcgatacacccgatctgcgtattcgagtgcatcgggatcatgggtgaccatgagaatcgccgtgccgttgttggcttggtctctgagcagacgcattacgatgtcggtgctctcttggtcgaggtcgccggtcggctcgtcggcgatgagcaagctcggctggttcatcagcgcgcgggcgatggagacgcgccgcatttcaccgccggacagctcgcgcgggtagctgtctgccagatcggcaacaccaagctgggtgaacagcgtgcgagctcgggtggcgaacaggtccgaacggctcgcagccgtgtttgacggcgtgttttcctggtctgtgattggcgcaatgacatccggcatgaacgggtcggcggctgaatcggcggccgcttcatcattggtggcagcggcttgcgccacggcatccgttgcttctgcgttttgggcgaacggcagcggctccggaaacatcgttgcgggcagaatcacgttgtcgagcacggtcaggttgccgagcagggtctggctttgagtcacgaatccgatggtgcgattcctcagcacggacagtgctttatcgcccaagtcggccacattgcgtccagccacgctcacggttcccgaggtcgggcgaatcagcccagcgaccatgttgatcaacgtacttttaccgttgcccgaccggccgacgatggcgatgaattcgccggcatcgacggtgaggttcacgtggctgacggcgtcgaacggcgtgccgcggcggacgaactggcgggtcaggtccgtcaaggtcagcagatggtccggggagggcgtctcggttacgtgcggcgaatccggcgcagtcggcgcgttcggctgagctggcgtggtcggctggagcttggtcggctcaaccgtggtcggctgaagcggcgtagttgtctcagtcatatcactccccctctcgcagggtcaggtaggcttcgggccggccgagacgccacatggtggccagcgaaccgatgatgccgatgaccgtagagcacacaatggtcacggcaatgaatccgatcaccgcaaccgggctggcttgcagatacggcaattgaagctgtttgccgatcagcgaactgaatgggaaaatcaccaggctggccgcgccgacgccgattacgccaccgatcagaccgatgatggcggattccttcagaatgatggcattcaacatgccgcgcgtggcgcccatgatgcgcagggacgcgaattcgcgtttgcgttcgttcaccgacgaggcgaatacggcgagcagcacaatcacgcccattacccagatcaccgccacgaaaatcttgaggtaggtgacaagcgcggtcagcgaagttctggtgttggcggtgatgccgccggggtatacgtaccccaaatcggcgaatcgggaatcaagacgcttgatgttctcagctacggtctgcgcttcgtacccctgctgcgtcttaatcatcacggtggagacggctttgccggcatattcggcggacatgacctgcttggagaccttggccgaggcggcgaccatgtcgggcacggtgttttggttgatgaacaccgagttgtcgaggctggtgccggtgttggcgagctgggcgacgaccggccatgaacggccgtagagttcgatggtgccgtcggtggacacgttgacgtttgcgcctgcaatcatctgaccgtcttcaagggggccttcgaactgggaggcgacccatggttcgatgacgaagtcagtgtccgggtcgtaaccgatgatctgcagcttttcggcacagcaggcggcggccagcgatgatatataggtctgttcggtggcctgtgcgatgccgtcggcctgcatgacctcgtcggcgatgtctttggtgaaatagaaagtgctgggattgccgttggtgagcagcgcttcggccttctgcacggtgttttgcggcacgaccatgaggtcggcgcccaggcgcttttccatactggtcatgccagtgttgaggttcatggtcagcatggtgccgccgaagaatgtcagcgcgaggatggtgacgacggcgagcagtgcgccggtgcggaacggcttgcgtttgaggttttcaatcggaaggccgcgcaatgcgatatgggatggcacgatgaatccttatgttgcttatagtgcggttgcaataagcgaggccggagtccagcgttcggaatggctgggctccggccgtctgctcgatcagttgcgcttggcggcgcgagagtcgagccagatggcgatggccgcgaacacgatggtgagcacgccgagcacgatgagcgtgggcagcataaccatgcgacagtgcatcatcgcgcccttgcagatgccgatcagaaaggtgggtacggcgagtagtagcagggcgtcggctgcggcggcgatattgaggccgatgcgaatctgcggggcgacgaacaaagccacgacgccgaacacgaggatgacgacgccgatgccggtggccgcctgctgcgagtagtggcaggcacccggcatgtcatggccggtgcaggcgtgcgcaaaggtctggggcgcgatggtgatcagcgcgccgaacagaatattgggcacggatgcaaacagcttgttcttcataactactttttcctctcccctgttcccagggctcgtaggcacaacctccgcattatgcccacactgtgatgaagaacacaagtcttgttttttgcgaatttatttggtatataactcagcccctcgtcagaggggccaatttatctacaacttctcaatcggcgctacgcggagcatgaggcgtttgacgccggcggagccgaagtccacggtgattaccgaattgcggcccttgtcttgtgcgtcggtgaccttgccgagaccgtactggtcgtggctgatcatgtcgcccacggcgaagtcggcgatattcaggccattgtccttggtgagcttcgagctaggcacggcagagccggtcgaatcggatttcggtgcggtacgacgcgtggtgactttgccgccacgggtgccaccatatgaaccggacgaagaaccggaacgggaacgcgacccgtaggacgacctcgaaccggagcctgaagaaccataggacgaacccgaacgggagcgggaaccataggaggacgagccggagcgggaaccatacgacgatgaacgggaaccatacgacgaagagccggaacccgagccatacgacgacccataccgcgaccgcgacccataggacgaacccgaaccggacgaaccacgcgagccgaacgtcgacgacccgccaaacgcggcgccgccaaaatcgtcatcatcccagccgcccaaatcgtcggcgaatccatcggtctcccagctggcgcgcatacgctccacgccggcttcacggcgtttccaatcaatcagcgaatccggaatctcgtcgaggaactggctgggcatcatatcggcggcctggccccactgggagcggacggcggcgcgcgtgacatacagtcgctgcttggcgcgcgtgatgcccacataggcgagtcggcgttcctcctgcagttcagtggtgtcttccatcgaacgcgaatgcgggaaggtgccctgttccatgccggtcaggaacaccaccgggtattcgaggcccttggcggtgtgcaaggtcataagcgtcaccttgccggagtcctccgcctcgccgggtagttggtcggagtcggccacaagcgcggtggtctccaggaatgcggacaacgtggcgtcaggcgtgttctgttcgaattcggcggcagtggactgcagctgggagaggttctccagacgggaggcgtcctgcgggtccacggatttctcgagttcggcccttaagcccgacttctccaatacttcggccacgatctcgctgggcttggagtcgtgcgcgcgcgtgaactgcgagagcgcgcccatcagatcgcggaatgctcgtagcgaggtggcggtgcgtgtcggcacctcgatctcatccaagtgcatgagtgcgtagaagaagctggtgccatgctcgcgcgcgtaggcgagcagcacgccttcggcgcggtcgccaagcccacgcttgggcacgttgagaatacggcgtagattcacatcgtcgtccggattgacgagcgcctgcaaataggccagcgcatccttgatttcgcgacgttcgtagaacttggtgccgccgacgagctgatacggctgattcgtgttgatcagcgcctcttcgagcgagcgggattgggcgttggcgcggtacatgatcgccatgtcggagtaggcgatgcccgcttcggcgtgcaggcgcgcgatttcggtggccacccactgggcctcctgctgggcgttgtccgccgcgtagccgacgatcggctcgcccttgccgagcgcggtccacagtttcttgggcttgcggccctcgttgttgctgatcaccgcgttggccgcatccagaatggtctgcgtcgaacgatagttctgttcgagcatgatggtcttggcgttcgggaagtcctgctcgaagtcctgaatgttgcggatgtcggcaccacggaacgcgtagatggactggtcggaatcgcccaccacggtgatccaggcggggccggacttgccggcgttaggcgcgcccgggatggccttctcccccgtgtccacgccggccagctcgcgcacgagcacgtactgggcgtggttggtgtcctgatactcgtcgaccagaatgtaacggaagcggtgatggtagtactcggcgacggccgggtcagtgcgcagcaactcgaccgtgcggccgatcagatcgtcgaagtcgacggcgttggccagggccaagcgatgctcgtattcggcgtagatcaccgcgtagatggcttcaaggtcgcccaccgtgccgaactggtagccgcgctggccgggcgtgaagtcgggcgcgtgaacggcgaggttttccttccaaccggtcagattgttcttgaggtcggagatatggccgagaatcgagcgtggagtgtagcgcttgatgtcgaggttgaattcggtggcgatgattttgacgagtcgctcggagtcggcggaatcgtagatggagaagccggacttgagtccgatggacttgccgtcgcgcctcagaatgcgcacgcaggcggagtggaaggtggagacccacatgcgctgggccaccgggccgatcagcgagccgagtctttcgcgcatttcggcggcggccttgttggtgaaggtgatggctagaatctggctcggccatgcgccgaactggctcaagatccaggcgatgcggcgggtcagcacgcgggttttgccggagcctgcaccggctccgatcagcagcgcctgaccgcggtattgcacggcttccgcctgctgcgggttcaggtcgcccacgagttcctgtgcgctgcgtgcgatgacttccggctcgtcgtacactgttgcctccctttgaatcgcgacattcatgtttaccacatgcacgggtcagcgcaggacaacgtacacttacgagtatccatatcattcactgacatacaacaatgggaggttcaatgcaggaacttgaggagcgaatccaaagcgagggaacggtgaaggcgggtaatgtgctcaaggtggacgcgtttctgaaccaccagtgcgacgtacgcctgttcgaccgcatgggttcggcatgggccgctcatttcgccggcaagcacatcaccaagattctgaccatcgaggcgtccggcatcggcattgcgtgtgtggcggcccagcatttcggcaatgtgccggtggtgttcgccaagaaggcgcagtccatcaaccttgacggcgaccagtacaccaccacggtctattccttcaccaagcagaaggagttcccggtgatcgtggccaagaagtatctgaacgccggcgaccatgtgctgcttattgacgattttctggccaacggcaaggcgttgcgcggtctgatcgatctgtgcgaagcagccggtgccacggtcgagggcattggcatcgccgtggagaagggcttccagggcggcggtgacgcgctgcgcgctgaaggctacgatgtggattcgctggccatcgtcgagtccatgaatcccgagaccggcgaaatcacatttaggcactgagcacattggctgctcccgccggcgggagcaacagagagaagaagagaatcatgtcagagaagaaaaccaatcattccgtatcctttgaggcgttgtcttcgctggacgcgccagtatccttctggaagggcattccgttcggcctgcagcatgtgatggccatgttcgtggcgaacctcgccccgatcttcatcgtcgcctcggccgcgaagatgaccccggcccaatcggccaccatcatccagtccggcctgctggttgcgggcctgggcacttgcctgcaactgtacggcgcgtggctcatcggctcgcgacttccgatggtcaccggcatctccttcacctacgtggcggccgccgtggcgatctgcgcggacaagggctatggcgcggtggtcggcgcggtaatggtcggcggtctgctggaacttgtgctgggtttgacggccaagtattggcgtcggttcgtgccgcccatcgtctccgccatcgtggtcacgtcgatcggcttctcgctgctcaacgtgggtgccacgagcttcggcggcggcagcggagccaaggacttcggttcctggcagaacctgacgctcgggcttatatctttggttgcctgcctggcgttccagctgttgatgaagggcacggccaagcagctgtccgtgctgttcggtctggtggtcggctatgtggcggctatctgcatgggcaaggtcgatttctccggtttccagaacctcgccatcgtgtccgtgccgcagttcatgccgttcaagcctgagttcgactggggctcgatcatctccatcggcctgctctacgtcgtctcctcggtcgaggtgctgggtgacaccgccgcgctgaccaaggtgggcctgaaccgtacgcccaccgaacgcgagaccgcgggcgccatcgccggcgacggcctgatctccaccgtatccggcctgttcggctgtctgccgctgacctcgttcgcacagaacatcggattggtggccatgaccaaggtcgtcaaccgcaaggtgattctctccggcggactgattctggtgctggcgagcttcgtgccggccatcgccgaggtgttcaactcgctgccgcaggcggtgctcggcggctgcacgatcatgatgttcggcaacatcattctttcgggcttccagatgattgccgaggcgggcttcacgcagcgcaacatcacgattgcggcgctttcgctgaccatcggcatcggcttcacccaggtgagcgacatcttcacgcagttcccggcactgttccaacaaatcttcgcctcgaactgcatcgccgtggcgttcgtggtggccgtgatcctgaacaccgtgctgcccagcgaggagcacttcctctctgcgcccaaggaggcaccggccgcggacgccgagtgataacaacgcaacatatcagctgcgcataatcacatgatgatgccctatcgtcttgcaggatgatagggcatcattgattttgggagagactacaagttgaaccatgagttcgagccggtggcgtgtcgatcaatcgtcatcttcccattcgaggatgtctccgggttggcagtcgagtgccttgcagatggcgtccaacgtggtgaagcggacggctttggcacgtccgttcttcagaatggacacgttggcgggagtgatgccaatttgttcggcgagctcgccgacgccaatcttgcgtttggccatcatgacgtcgagattgatgcgaatcgtcatctcaaatcacctgctcgagttcgcgcccgagccggacaaggagaacagtttccatacggccacgaacgccgcttcgatgcagaacaggaacagcacgcccataatgagatatggccagcgcatcgacgtctggctcgggtagaggccggccagcgcgccgctcaatcccggtacggcgaatagttggccccataggcaggccagccagaccagaatcacgatggctttcaacgcgagcaacacccatcggttcatgtagtttttcatagcccggtcctttcaggtgccgacgtttttttggcgacaccgcgaacatcgatatgactatatcgaaaaacgatataccttgcaaggcgtattgcgtcaaccggcattggtcgctcgtatacatataggcttcggcagactgtcagcagaccgtcagctcaacggagtgaacgccatatgagccacccattcgcgcacgagcgtgatgacggcttcgggttggtcgatgtgcgcgttgtgaccggcattgtccagcgtcacgaaggtggcgttgggatagtgcggcaacagggcttgctgatcttcgtatccgacgatctggtcttgcttgccggtgacgatgagcaccggacccgcatatgtgccgagcatttcctcgggattatcggccagccaatagcgctgatccagtcgttcgtatgccgcacggtcgcacaacgccacgccgggcaggatgaaccgttggtagcgtcgccacgcgtcgaatgactggttgacgcccatggtaatgaaatcgaacacctgttcctgcggcaaggagtgcgtcagcttgggattgggctgtgcaaccacatgttcggccacatgccggccggcatgctgcgggtccacgaccggcgcgatcaatgccataccggccactcggcgaggttcgcgcgccaatacttcgcggacaagcgcaccgcccatcgagttgccgaccatggcgaatggagccgctttaccgacaagaccgtcaatggccgtttgcagccaatccgccatttccggcagcccgcaggcatgctcgggcaatgccggcgtacggccgaaaccgggcagatccagatatatacggcgaattgaatcattgccgtcaaacgccttgtcgagcatcatcagcgaacgatggtccacacccatgccatgcacgaacacgacgggcaatccatcatcattgccctcaatcgcgcagtacggctgcaattgcgccatgtgttcctctccttcaacccggtacaaatcgcctttcacacaatagcggcagcagctcccttggtgtcggagcaatcccgaccgccattctcggtttcgaggggctgatttgcgcggatgtcatgaagcgtgaagacttgtcacaaagtcgcgtgatgacgcagccgccgttcaggtggatatgccacgctgtcatgatgacggccgagccggaacacggcaaatcccgcatgctgcataggccagccggtcacggtcagccatgacaccgaaatattggaggcgcaatgggacaacaggtgcggtacggcagacgccgctcccatggcgcgggcgcgctgattgcagccgtcatacttgttgttgcggcgctgatcgcggcatggacgctgctgccacggctattcacgcctcgcgagaccgcgcgcacggccgaggaagcatattgcgcggcggtgtcgtccgacggagcccgccgcaccttgacgcctgatcaggcgcagaacgcggcgctgattgcgaacatcgccgtcacgcgcggactgccggatcacgcggcgacggtggccatcgccacggccatgcaggagtcgaggctgacgaatctggactacggcgacttggattcgctcggcctgttccaacagcggcccagccaaggctggggcacggcggagcaggtgtccgacatgacctatgcgacaaacatcttctacgatcatctgctgcaggtgccggattgggagacgattccggtggaggacgccgcgcaggaggtgcagcgctcaggctacccggaactatatgccgcatgggatgcgatggcacgcgcttgggcctcggggctgaccggtgaacggtcggcgggcgtcacgtgcgcgttggagccagcaacctcctcggacgcggacgggttggttgccgccataggaggtacactgccgaatgtcaatgtctcggttgtgcccccaaatggcaaaaccggcacgaacaacggcgctgcgaccaatacggccagcacaacgttgacgatcacgctgccggacggcctgtccgccgacaaccgcactcgactttgctggcagacggcaggctggctggtcacgcatgcacgtcaatacggcattgacgcactgcacgcggacggcatggattggaaccgcaaagccggcacatggatcggcaccgaaaccgccgagcagaccatcaccttcacgcttgcgtgatgtgacctataccgccgttgcgaccacaaatccgactggttggagcctacgccgtcgatgccgcctgaggcacgatacggatatgtttttactcgttcgaatgagcccaatccacgacggcttcgatgttattgccatccgggtccagcacgaatgcggagtaatagccgggatggtacgggcgcggaccgggagcgccgttgtctcggccgccggcggcgagcgcggctgcatggaacgcctgcacggcttgctgactgtcagccaagaacgcgatgtgtgtgaccggcgtgaccggcggagcctccgcctccagcccttcaatcggtgacacgtagaaatcggagtgcagggttccgtcatccacgccgaatccgagcgtaggctcatgatgcgccttgacgatatagccgagcggtgcgagcgcctgtttgtagaatgtgatgctacggtcgatgtctttcacgtgcaacgtcagatggtccagcatggtcttggtcgccctcccctggttcttgtattcgattgctgcttgcagtgtaagcccgaacgtttcccacagggccgcgcatggctatgatgagagcaatcgcacgtcgagttcgagacaatattcaaaacgaatccaaggcaataaggggaatgacgatgaccaaggcactgattgtggtggatgtgcagccgacgttctgtgaaagcggcgaactgggtgtcgcaggcggcaacgcggtcgccgagcggattgccgattatgtgaacgcgcatcgcagcgagtacgcgtatatcgcaaccacgcaggactggcatatcgagccgggcgcgcactggtcggcggagccggatttcgtggacacgtggccgaagcatggtgcggccggcacgctgaacgccgaattgcatccggcgatcaaggcgctgaatatcgagcatcatttcaagaagggccagtattcggcggcatattccggttttgagggtatcgaggacaataccgaccgtatccagacccgcgaggaggtcgaggccgagcaatccgccggcaagacgctggccaacgcgctgaaggccgccggcgtgagtcgcgtggatgtggtgggcatcgccgaatcgcattgtgtcaaggacaccgcgctcgatgccaagaagctcggcttcgaggtcaccgtgttcgaggatctgaccgtgccggtcagcgaggaacttggtgttgcggcccgcaagcagatggctgcgggcggcatcacattggctgagtcccgctgatcgggccggatatacccagagcgaagcacacagccgtagcatcaatcacgcgcaagattcccacgccacccaacatagcccgcccgcctcgaccggccgatatcatcggcgaacacgcggaaccgaaccctacatcgacgttcgtttcgtctggtttggcccatgaattctgcatgaattggggtgaactggcggggctggaggcgagcgggcggcggattatggggcacaatggtttcaaggaggccgccatggtcgatgactatactgccaaaatgactgagctgatcgaactcatgcgtctgatcggcaacgatacgcaacagtgcgaggtcaaggaatgcaagcgcaagatctcctcgaccatcaccgatacgctgtccgcgttctccaatggctccggcggctggattatcctgggcctgtccgaaaagaacgggttcacgccggtcgagggattcgacgcgcgcgccatgcaggaggcgctgagccaggcgtgcgagaagatgacgccggtggtgcggcccgtgatcgtcacctgcccgttcgaaggcgcgaatctggtgttcgcgcgcatcgacgagatgctgccgcgcgacaagccctgcttcaccaccgcgctcggaccgcacggcggctcgttcatccgtaccggcgacggcgaccggcgcatgacctcctatgaggtcgaccggctcatcgaggagcatctgcagcccacatacgatctggatatcgtgcccgacgccacgaccgatgacctcgacccgcagcttgttgccggactgttggcacgcgtgcgcgaacagcatccgcgcgtgttcgccgaccgagacggcatcgatgtgctgctggatctgcaggtgttgcgccatgatgattccgacgagtcggaggtcggcggaatcctgcgccccaccttggccggactgctggcgttgggccgctatccgcagaagttctatccgcggctcggcatttcgattgccgtgtttccggggacgagccgggacgatgtgttccggggtgacgaacgattggtcgcctcgaagtcggtggtcggttcgattccggtgatgatcgacgatgcggtcgactcgttgatgcgttggattggcgcgaagaagcccgactatccgccgctcgtgttgcgcgaggcgattgcgaacgcgctcacccaccgtgattattcgcccgatgcgcgcggcacgcaggtgcatatcagcgtgttcaccgatcgcatcgagatcaccaatccgggtggcctgtacggcatggtgacacatgatgtgctggcgagccctcatccggtgacgggcgcgccgttcgtctccacccgaaaccagttcctgttcacgctgctggagtccacgccgtatccgggcggcgggtttgtgaacccggaaggcggcgacggctaccagcgcatcgccgccgcgttgcgcgaggccggcatcgagccggcgaccacgcgcaacgacatcaacacgttcacgatgaccatcaccaagcagcgcacgatggcgaacagttcaccgggcgacgtggtcaaggcgattatgaccgtactggagcggcattcggccatgagcgtcaaggagatcatgcgcgaactgcagttgacgccgctggccgccacatccggtatgcgcgagctgatgaaggaagggcgggtcgcccaagtcaagttcgccgacgacccggtacagcggtatcggttgaaaggctgatttctcactcggccagctgcgtggtggcaggcgcggccagggcggggcgggatcggcggaagcggccggcggccaggccgatgcagatgaacatcacgccgaacagtgcgaccaatcccagcgagccggaccagccggcgacgcttatgccggtttccgccgccgtgccgaagccgagcgcgttgtcgatcgcggtgcaataccaccagccgggcaggaacttggctatggtcaccatcacgccgggcatcatgtcaatcggcaatgcgacacccgacgtgaacatgatgagcaggccgaagatgttggcgaacccgttggccgcctcttccgagagcccgaactcgctgagcatgaatccgcaggcgacggtcatcagcgcgtacacgcaggtcgcgccgaacgtcatcagcactcccccgacgctcaggtgcaacggatcgagccccgccgccatcatcagaccgattgacagcaccaaatagccgacgcatacgacgagcgcgaatccgcccaacgtcagcaaccgctggagtcccatcaggaccatgcgtcggggcgaggcggtgagacgccgccgcacctcgccggtggtgaacgcgcccaggatcatcgatccgcagatggtcatcgccagggacagcgggtacagcgcggttttcatggtgccgccgaatccgctgaccgccgtatccgcagcgcttgccgactcctcggtcggcgtatcgaccacggcgatctgatggttcacgtctgtatcgctggccgattcggcggccattttggcggcctgggacagatccttgatatccggcttgtcgacttgcccttccggcagcgagtccagcatgtcttggtccagactcgcgccatcaaaaccggcggcccctcctgtagcgttcatcatgccggcgagcgccgcctggtcgaccctcgtctgcgcgccgatcagtgcggtgcgggtgagcgagaggaacccgccgacgttcatccgcgccatcgacccggagccggatgcgtagctggtaaccgtgtccacgttcggcggattgtcgccgtccgccgccgcggcgacataatcgtcagcgaatccgtcgggaatgatgacgatcaggtccacccagttcgaggcgacggcctgttgcagcgtttcgctggtgtcgtcgaggtccaccagttcgctggaatcgcgcaggtaggcgcgcatcgacgtggcgatatcaccccggtcggagtcgcggtcgatgatggcgacgcgcgtcttggtcgattcgaacaccgcagacatggagccggatgcggaggtcagcatcgcccagctgatggacatcatcaggatgcctatgaatacgaggtagatcatcaggtagacccggtgcgcgaacagcacgcgcagcgtggctttacaggtgttcataacgttgcctcctcagcattgcgatgccggccaagaggaataccgcgctcatcgccagcagaatgatgcaggtggtgatgaacggccggtagctgtcgtagtacaggatgtcgtagaacaggttcgtcacctgctgtgcggggttgatggtgccgagtatgggcgcgttgcgggctatccagtcgctgatctgcatggcaaacccgccgtacagtccggtgaacagcgacagcgtgcaggagatgccggtcgacagcccgtatttcgtgttgtacgagagcttcggcaccgcaccgagcagggtgcctgctgagctggtcatgaacgaggcgatgatgaccgcgaggatcgccgccggttcgcgtccgccgagcgagacgttgcaggcgagccggatataggccaatgcgatggacagggcgaccgacgagcacagccagcaggagaggaagcccgcgacgagctgtttggcccggctcagcggcgctacggtccgccgtatgcccagcgcggacaggttcgcctgtgcggcggcgactgtgctgatggagtatcccatggccatcatgcaggacatggccagcagcgcgtaatagtatcgggcgatctcgtcaggctggaaatgcgtgagcgtcgtctcatgggtcatgtcgacgttctgcccgacgctgttccagaagttccggctgagcgcggcctgtggattgtcggcgatggtctgccgggtaacggcgtcggtgcggttgtacaggtcgatgacgctgcgcagggccgcgaggctaatgtccagtccgctgttttgcgtggagtccttggctgtgacggcggtttcccggctcacggtcatcgccaatcggccgttattgtcggcggtcagatagccgttggcagtgccgtcggcgagccgttgttcggcctccttcacggtgtcgactgtggtgatggtcagcagcttttggtcgatttcggcgtaggtcgtgtcgtctgaggccgattccgtttccccggccagcgcgtctacgaaggtgcgggcaccgtccgcctgctgccaacgggtgtcttcgatgacggccatcggcaccggcttgagttcgtatgcttcggccagcccgccgaacagtccgttgaacatggtcgccagcacaatcgggaacacggtcatccagaacaacgccgaccggttacgcaagttcgctttcaatgcgaccagaaatgtggtccacatgatgtctccttactcaggaactcccctcagtcacctttggtgacagctcccctcggagaggggagccaagttatttgcttgccgactgaggggagcatggtcagtccctcagtgctttgccggtgagttcgaggaacacgtcgttgagggtgggcgggcaactggtcaggtggccgatgttggcgccggagcgtttcaccgcgtcgagcacgtcggtcaggttgtgttcgccgcgacggcatcgcacgtcgagttccttgccgtcgtaggtggcttcgatcacgcacggcagcgcacggacctcggccatcgccgaatccgccagatcgagcgtttcgatggtgatgcgctcgcccgtgtcgatcatgttcttgagctcgtcggcggttccgagcgccaggtgccggccgtggtccatgatgaggatgcggtcgcagatctgttcgacctcctccatgtagtggctggtgtagatcaccgtggcgccggcctggttgagccgctggatgccttccagaatcgaattgcggctttgcgggtcgacggcgaccgtgggttcgtcgaagaagatcaggttaggcttgtgcgcgatgccgcaggcgatgttcaggcgtcgcagcagaccgccggacagtttgccgggccggaacttgcggaagccctggagtccgacgaattcgatggactcctcgaccagcggcgcgcggtcggttttcttcggcacgtacagcgagcagaagtagtcgatgttttcggtgacggtcagttcgttgaacacggccacgttctgcggcacgatgccgatacgacgtttcagcgcgtaggaggtcggcgtcatcggctggccgaacacgcgaatcgtgcccgaatcgtaggtgagcagcgcgaggatgcagttgatcgcggtggttttgccggacccgttcggtccaagcagcccgaaaatctcgccctggttcacgtcaaggtcaaaatagtcgagcgccaccatgtcgccgtagcgtttgaccagttggctgacgtgcacggccagagccgggttggttgtcgagtcgtgttcggaagctctgttgtcggttgtcatagtcactcccttccttggcgattccatcatcccaagaaggggccggacgccgccacaggcaaacgtcacgacttggccgtacaggcgtgacatttgtcattacagtccttcggcgtcggtctgcatggccttgtacaccttatcgaccggcatcaggctgatctcgtccatcgaatagttggacgccctgtggctttgcgtaatcatcggtatcatccctttacggttgtgtcgacgacatccgacgcttgtgcctcatctattcgggaagtgtaggcccgttgtcttggaccgtcatgcgggtaattccgcacgcccgtcaagttcgtcgtgttccgcacaccgctagactggtggtggaagagcgtcgagccggggaggtgccatgcgcgtgttggccgagatgggcttgctactcgtgttgggcctggctttggcctggcttgtcgggctacggtccgatggcgtgttcatcgccggcctgctgttggccgtttccgtcgccggattggtggaatggctgcgtcccgcgcaatggtcttgggtcttgtgtacggcgtatctcgtcatcgccgtggcggtgccttcatggtgcgcgttcatgccgctcatcgcctacgatactgcacggctgccggccctcgcctcgaccggagcccgggctggggcacggactgcggcaagtggccgctcccccagtgtctcgcggaccgcggcctctcgccgttcccttgccgatgcaatgcgttcggccccgtggctttcggccgccgcgcgctggatatgggtgttgccgctgatcgcgctctggttcgcccgtggcaccgaccgtctccagacgctggtgatgacgctggtcgccctgcttggattcgttctgggccgggcccgcgcctcctcggacgaggcgcggcgcgcgttgctgcacgcgcaggacagggcgcgcgaatcctcgcgggccactcgttcgcgcatcgccgacatcgatgaggaacgcgcccagtcgattcgcatggcgaccctcggcgagcgcacgcgtatcgcccgggagatccacgacaatgtgggccatctgctgacccgcgcgatcatgcaggcgcaggccggcaaaacggtggccaaggcgacgaacgatacggtcgctgcgcaagggttcgccacgttgggtgcgacgttggatgatgcgatgacgatggtgcgccgttcggtgcatgatcttgaggatgatggcactgatttcgccgcgcagatcgatgatgccgtcacgtcgttcgacggcatctcccccggtttcgccgtgacgctggccaacgatatcgccaaggcgcctgcgccggtctcgcgctgtttcgcgaccgtgattcgcgaggcattgtcgaacgtggtgcatcacagcgcggcgcgcgaggcgagcgtgacgttgcgtgacttccccgcgttctggcagttggtcattcaggatccggggccggccgtgtccgagtccgatgggtcccggacggccgctgcccgcccgcgtgcgatgcgcgccacgcacgtcggctcgcgactcgccgccgacggcgttgccgatatgcgtggttcggccgatgagctgatgcgcggcatgggtttggcggatatcgaatcgcgcgtgcgcgcccttggcggcaccgcggtctgcgggccgtatgaggacggctggcgtgtgttcgtatccgtgccgaagaagcgttggaccatggaatcgagggattgatgagaatcgcaatcgtggatgatgatccgatcgtctgccagtcgttggagacgattctgacggccaccggcacggccgaggtgctatggatggcaaatgacggagacgccgccgtgcgccgttatttcgagacaccggcgagccgaccggacgtgctgctgatcgatattcagatgcccggcaccagcggtttggatgccgcgcgcgagattctggccacggacccggccgcgcgcatactgttcctgaccacgtttgcggaccagtcgtatatcgcgcaggcgatgggacttggcgccaagggctatctcatcaaacaggatgtggcggcggtcgggcccgcgctgcaggcggtgatggccggtcaggtggtgctcggcgcggaagtgctcggcaagctcaccgaacgaactccggatcctgccgattccgacgattccagagataccgccgattccatcgagggcctgcttggcgagcgcgaacgtgagatcaccgcgctggtcgccgagggcctcgataaccgcgacatcgccgccagactgttcctgagcgaaggcacggtccgcaatcgcatcagcgcgatactggacaagctcggcctgaccaatcgcacccaactcgccatcctctggctcaacgcccataggtgagggggcttttggtcaagtaggcctctccctccgacatcgcttcgcgatgccacctcgaacgcgattcaggacagcttgcagctgacctcttattcgctcgttgtcactcaccctcgcctaaaaacgcctccggcgttttcttcacggctcggctcatcagagggaggttgtgaaaaaccaacctcagctgtttttcatgacgatactgtcgatggtgttggccacgcgctcgcagtcgtcggagcactgttcgaggtgacggtagacgtcatgccaggcgaacacctgcagcggatcggtgcaggtggtgtgcagcgtgcgcatcgactcgatgaacaggtggtcggcgtccgtttcgatcgtgttgatggcgaacaccagttcgcgcaacgtcttggaatgccggaatcgcggcagttcgttgaccagctcgcagatgctttccgtggcgcgcaccaccatatccgacatctggaccgcgtcgtcgcgcatgtcggtcacgttgtcgtagtacatgcggttgagcacgccttcgatgctgtcggtcacgtcgtcgagcacgtggccgagctcgtcgatgtcctcgcggtcgaacggcgtgatgaacgcggtcaccagttcgtccatcatgtcgtggcgcacctcgtccgctgacttctcaatcgcgtgcatgctgtccatgcgttcgcgcagctggcccggattgaagtcgtgcatgacctcggacagcagcttcgcggcctggcatgcgtagtccgcgctgcggcggaatccgtcgaagtagaacgtgtctttttgtctcgccatgatgggtggattcctttctagaacacgaccatgaacagtttggccattacgaagctgatgagaccgcaaccagggaaggtgaacacccaggtgagcatcatgtcgcgcaccacgccgaagttgatggcggagaggcggcgtaccgcgcccacgcccatgatggcgctggtcttggtgtgcgtggtggagacggggatgccgagcacggtcatgacgagcaggcacagcgcgcttgacagatcggccgagaagccttggtatttctcgagtttcaccatgtcctggcccacggatttgatgatgcgttcaccgccgacggacgtgcccacgcccatgatggtgctgcacagaatcatgagccagatcggaatcatcacaccggtcacgctgggttggccattgcagaacgccatgccgaggaacagcacgccgatgaacttctggccgtcctgcgcgccgtgcatgaagctcatggccgccgcgcccacgatctgcgcgtaggtgaagaacccgttggtgcggcggcggtccatgccagcgcaaatcagggtcacggccttgcataccaaccagccgacggcgaagccgaacaggaggcttgcgaccagaccgtagagcaccttgacccattctcccatgttgatgccgccgatgccgccttggatggcgatggccgctccggacaggccggcgatcaggctgtggctttcggaggtgggtatgccgagcagcgaggcgcccacgctgtatacgacgatggagaacagcgccgcgcatagggcgatgagcgccgcgttcgtgtcgccgccgaaatcgaccatgttgctgatggtggaggccacggaggcgttgagctgcgtcatgatgaagacgccgaggaagttgaagatggccgccatgatgacggcggagcgtacgcgcatgcatcgcgtggtcacgcaggtggcgatggcgttgggtgcgtcggtccagccgttgacgaagatgactcccagcgtcagcaacgttgtgacggtcagagccgggttggaaagcacttgttggaggaaatgcgccagtgagacgtccaaggggaattaacaccttcttcttcgggggcggaagccgtcacactgattgtaacggaagaatggctacgtagttcccatggcgcgcgggttttatggtgttgttatgctattgcggcctgtcagcagcaacaactggtattggggtggagacggtcgtattcctcgcgggcgcgaatgaattcgacctcgctcatcggtgtttcgccgggatgctcggccgcgaaatgctcaagataatggtcgtagcgggcctcgccgctgatctcacgcagataccagacgatgccgtgccatacggcaacgagtttgccgagcattttgtctcctttcgctgattattggctccccttgaaaaaaggggagccaatgacgcactacgctgcaacctgcccgttccgcacaagctcatgcagcttggcgctgtattcgcgctgcaccttcttctcaagcgcggtggcgaccaggctggagggcgcgaaccactgggattccacgaacggctcctcggacgtcgtttcggcaccgtacttgccagcggcgaacgtgcgcgccacgaccacgatgccgactaccacgaagacgcccatcatgaccaggaagaacacggagagcacgccgtccagatacgcgttggacagcgcggccttggcgttggtcagcgcctcgccggtcagctcgccggagtcgatctgcgcctgatacttggaggcggtggtgaagtagctcagcggcccgaagatcttctggaagtcggcggtgaaggtcacggcgatgtcccacacgagcggtaccaccggtatccacaggtgcttccagtagcccatcttggccacacacacggtgatcagcacgaagcaggcggcggcgagcagctggttggagatgccgaagataggcaccatcgcgttgatgccgccgttcgcgtcggacacgcccatccacagcagtccgccccacagcgcggtggcgatcagcgtggtgatgatgttgccgggcttccaggtcgggtcggcgaacttcttgagcttgcgcacgttgccgagcatttcgccgatctggtagcgggccacgcgggtgccgttgtccacggtggtcaggatgaacagggcttcgaacatgatggcgaagtggtaccagaaggccatcgagtcgtggccgcccaggtaggacttgaggaagttggccatgcccatggcgaacgtggtggcgccaccggtgcgggagacgatggaggtctcgccgatgtcggcggcggcctgctcaagcgccgcggcgccttcgtaggtcttggccgcgccgttctcgtccacggaatcccaggtgacctgcatctggttgccttcgatgtcggagaccttcatcgactccacggccttgacggcggcatcggcctgttcgcccggcgtggaggtggcggagatgctcacgccggatgcggcggtgatctgtgcggcggacatgttggtggagaagtacacgccctgcgagatggtgatcgcggcgatcagcgcgatgacggcggtgaacgattcgacgagcatcgaaccgtagccgatcatgcgaatctggttctccttctccacggccttcggggtcaggccggagctcaccgcgccgtggaagccggagagggcgccgcaggcgatggtgatgaacaggaacgggaataggttgccggagaaggtcgggccggtggaggtggaggccagttcggtcagacccggcaccttgacggacgggttggcgatgatgatgccgatgacgagcagcacgagcgtgccgatcttcatcagcgtggacaggtagtcgcgcggggtgacgagcagccagtgcggcagcgcggcggcggcgaacgagtagatcaccagggcgatgacgagctgcttggcgtccagtgtgaacacggcggccacggccgggatagaggcgatccatccgccggcgacgatgtcgagcacgagcagcacgaaaccgagcagcgtggtctcaatgacacggccggggcgcaggaaacgctggtagcagcccatgatcagggcgatcgggatggtcataccgatggagaacacggcccacggcgaggcggccatggccttgatggccacgagcgccaggaatgccatggcgatggcggtcatcaccacgaggaagatggataggatcataccgccgaacttacccatttcatcagtggccatctggcccagagagcgaccgcggcgcttggcggagatccacagcaccagcatgtcctgcacggcgccggcgaaaatcacgccgaggatgatccacagagtggagggcaggtagcccatctgcgcggccaggatcgggccgacgagcggtccggcgccggagatgccggcaaagtgctggccgaagagcacgcggcggtcggtgcgttcgaagttcgcgccgtcatgcacgcgctcggccggggtggcgttcgcgtcgtcggtgcgcatgatcttgatctggatgtaataggcatagaagcggtaggcgatggcgtaggagctcagcgccacgaccaggaaccagatggcggagatccgctcaccgcgcgagacggccagaatcgcccatccgcaggcacatacgatggcgatggcggcccacagcagggccttcttccatgtccataccattttgggacgcacgcctacgggcagtcccttcgaattgcgaatcacacgttcggcttcgtccggcgtgtaatcgtccttgaattccaacttgccaggtgccggggcctgggctgcggcggtggtcataataaccctctgttcctcttcaataacctttgcgggaaaggttctcttcattgcgacccttttggggtatctctcgtctgcttatggcactggttggaagcgtagccacggcatgtcgcgcctcaggaaaatgtcccaatatgtgagcttggccacatgttcacggactgcgtttcatgccgattacccgggattcgcaccgcgatgtgcgaaaatggacacggtgtcaatcaggaggtgcacagtggttgtaagcatggattcgagccgcacaatgcccgattgggtgaagtacggggtgttctggcacgtgtatccgctgggcttctgcggtgccgatatcaggcccgccggcccgcgccagttccatggccgcggccttgacgcgataattccctggctggagtacgtgcgcgatctaggcgcgtccggcctgctgctgggtccggtgttcgagtcggcgacgcatggatacgacacgctcgaccatatgcatatcgatgtgcgattgggcggggatgccgcgttcgatcagcttgtcgcggcctgccgggacatgggattgcaggtgatgctggatggcgtgttcaatcacgtgagccgcaatcatccggccgttcaggcggcgcttgacgagaccgccggacgcttgaatccggccgacaacccgtggcatggtctggtccgcgcgcatgtcggtgataatggcgaacccgctttggatgtgttcgaggggcacggggatctggtggcgctggaccattcggctgacgagaccgttgactatgtggtccatgtgatgagccattggctggatcgcggagccgccggctggcgcctcgacgccgcgtatgccgtgccgagcccgttctgggcgcgcgtgttgccgcaggtcaaagccgcacacccgtattcgtggattttcggcgaggtgatccatggcgattacccgcgcatcatcgaggaatccacgatggattcgatcacgcaatacgagctatggaagtcgatccagcatgcgctggagacggagaacttcttcgagctggattggaacttgaagcggcacaacgcgttcctggattccttcgtgccgcagacgttcatcggcaaccatgacgtgacgcgtatcgcatcgcagattggcccggccaaggcggcgttggcattggcggtgctcatgacggtcggcggcgtgccaagcatctattacggcgacgaacagggctatgtgggcgtcaagcaggagcgtttcggcggcgatgacgacgtacgtccgaagttccccggctcccctgccgaactgtccacgctgggagagccgacataccggctgcatcaggcgctgatcgcgctgcgccgtcgcaacccatggctgctggatgcgcgtaccgaggccgtgaagctggaaaacaagcacttcgtctatcgttcgacgagcgccgacgcccagcattccctgaccgtggacctcaacatcgagcaatcccccactttcaccatccgcaacgccgatggcagtacagcgtatcaatggtgagctccctcatcagagggagctaactcattcacctctgaatgcctcggatcagcaggtcgagcaggtaaccgtacgaccggtcgacccgttcgcggccgcgtgtgcggggttgtgcggaacgcagttcgaattggatgaacccgtgtatggacacccagatggaggatgcgattagatgggggtcatcgccgcggaatacagatgctgcctggccgtatcgaatgatctgcgtgatggcgtccaggcagtgctgggccgagtccgacgcctgccccatccagaccagcgcgtaaatgccgggggcgtccagcgcgtgttcacggtagattatgcccgccctgcgcaggcgcagcacggggtcggattcgtcaatggcgatgagctgttcgcgcagatcggtgaagtatgtgtcgatgagcgcatcgcacaccgcctgcttgccgccgatgtgctggtagatgctggtgggcgacacatcggcctgtgcggacagcgcacggatggtcagaccatccacaccgtcccgttccacgatccgccttgccgcgtcaaggattctcccgtggatttcaagggtgggcgtgcgtttggatcggggctgcgattgcgtcatatccgttattctagggtgcgtacaggccattaccgccgtttcggcatggccacgatcacaacgactgcggcgataagtgcaatcgtcatggccgctaggcaggcgaacaggcatccgcatcgcaaacaccggcctataacacaatcaggcccgacgaccatcaaaggtcgtcgggcctgattcatacgcgctgtcggactaacggcgtccagacttcatacggaatggcgcattgtggcgattcttcttggaatgacggcggttcgggccttccgtgttgccgtatttggcgatcatgcggcgttcgtgacgcttggcaccttctgaacgctcgtcgcgtacgatgcggttctcgttcttgcgatggatgcgcttgccgccttcgccctgacgggtgttgcgcatggactgtctgcggccgtcatgggagcgctcgtcataggagaagccgtaatcctcgtggctgcgttcattgcggcgaggcttgcgcggacgctcgaaatcgcgggaatcggaccgttcgaaatcacggcccgcattgtgcctgcggctgccgaaatcatcgttgcgaccgtatccggccctgtcgcgcttatcgaacttgtcgcccttgccgtaccgatcattgcgacggttcttgccgtgctggtcgcggccattgtcctgacgctcgtcgtaccggttcttgccgtatccgtcgcgacggtcgcccttgcggcgctcctcgcggcggtcatcgccatgctcgaacagatagtcgcggcgctcggcctcggggttgctcatgcctgcacggcgttccgcacggttgcggttcttcttcacggccttcttgctggccttgtcgccgtgcttgcgctgcggctcgccttcggcaacaaactcgccgcctgcgttctcgtgctggaactcggtctcggcaacgttctgctcgtcacggttgcgattgcgattgtgcttgcgcttgccgccgcggccggactcgtcgcccgccgcgttcttggcgcccctgttcttgcccttgcgcgggttgcccacgggctgcgacttgtcgaggctccaaccatctacgcgctcggcgcggtcgcccacaagctcaagcacttcgggcgaatcgtgggtcacttcgatcatcttggtcttgatgccggcctggttcagcaagcggcgcgtctcgcggcgctgctcgggcagcacgagggtgaccacgtcgcccgccttgccggcgcgggcggtacgaccggagcggtgcacaaaggacttcgggtcggccggcggctcgacctgcaccacgagctccacgccgccgacgtctatgccacgggcggccacgtcggtggccaccatgacacgcacatcgccggaatcgaacgcagcgaggttgcgatcgcgctggttctggttcaggttgccgtgcagctcggcggccggaatgccgttctgcgtcaggttcttggcgagcttcttggcctggaacttggtgcgggtgaacaggatgcggcggccttcgcccgaggcgagcatgcgcacgagttcgtgcttgtcgccgcgcgtggtttcgaacacgtggtgggtcatcaggtcgggttcggcggtggccgaatcgacctcgtgcaccttgggatcgtgcaggaaggtgttcaccacttcatccacgccgtgatcgagcgtggcggagaacagcatgtgctgggcgtcgggcgaaatctgctcaagcagtcgcttgaccggtggcaggaagcccatatcggccatttcgtcggcctcatcgatgaccacgacttcgacggacgagagcgtgagcgcctgctggcgcagcaggtcctcaaggcggcccgggcaggcgaccacgatatcggcgccggccttcagatcacggatctggtggatgtacttgacgccgccgtacaccgtggtggtgttcatgccaaacgtgtgggccagcggcatcagcacgtcgttgatctggttcgcgagctcgcgggtgggggccagcaccaggccgcgcgggtgcggcaggaagtcgtcggcgcggcgctcttccaggctggccttcttgcggcgcttgatttccttgcggaactcctccatcgcgatttcgccgaacgaatcgtaggaaccgaggcgggtgaccagcggaatggagaatgcgagggttttgccggagccggtgcgccctcggccgagaatgtcgcggccggccagtgaatcgggcagggtgtcggcctgaatggggaatgcggtcttcttgtcatctgccgcaagcacgcgcaccagcggtccgggtacgccaagttcgccaaaggtaagggggcgggattccgcgctgtcgttcatctggaaatcagcggaatcgtcacgatcatcgaaattattacggggcacagtggcctttcatgtcaaaggttacgcaaattacgcaagctttccgagcttagcgtaagccccctactttgcttggtgctcgccacactgtcatcccactctttacttatgaccccatggggcggtaactcgcccatggggcggcaacttgcccatggggcggtttgaagaaattgtgaaaccgcagaataaagccattttcacctaccgccccatgagggttttaccaccccatgggatatttgccgccccatgggttttaccaccacgtaaggcgagcaccgctccatggaacacgcaaatggcccccacccgtgaaggtaggggccattgtgcaaaagggctgagccaagatacagcccagtagccctaaaacacactacaaaatatccggatcgtctttggcaatagtgccggttgccttgccaatggccttcaggccgtggtaggccacaagaatcacgatcgtgccaatggcaatgccgttgaaggaaatgccaccaacagtgaacgcgaattggccgatggcaatgatcatggtgatggctgccaccatgatattcagcggcttgtcgaagttgaccttgttctccacccagatgcggataccgatcatgccgatcatgccatacagcagcgtggtcacgccaccgagcacgccggcggggatcgtgttgatcacggcaccgaacttcgggcacaggctcaggatcagggcgaaggcggcggcgcaccagtaggcggcggtggagtacaccttggtggcggccatcacgccgatgttctcgccgtaggtggtggtgccggagccgccgccgaagccggcgagcgtggtgcccaggccatcggccatgagggcggtgccgatctggttgtcgtagtcgcggccggtcatttgggccacggacttgacatggccgacgttctcagccacaagcacgagcacaacggggatgaacatgggaaggatggagaaatcggcctgcggcaggtggaacttcgggaagccgatccatgcggcgtcgccgatggcggagaagtcgacctggccacggatgcaggcatatacatagccgatgatcacgccgaccaaaatattgaggcggcccagcaagcccttgaacagcacggccacgagcagcacggccaacagggtaaccagtgcggtgtcgggcgcggcttggaagttggtccacacggaaggtgccagattgaagccgatgatggccacaatcgcgccgttgaccacgggcggcatgatgatgtcgatccatttggagccggcgtaatgcacgagcacgccaaccagggccagcagaataccggtgaccatgatgccgaagctggcgaccgcaatgcccttgttggcggtggagaccgcggtgatcggtgcaatgaagccgaaggacgagcccaaatagctcggcagcacgttcctgttgataagcaggaacagtgcggtggacatagccgtgaagaacagggtggtggacgggtcgaagcccgtcagaatcggcaccaggaaggtggcaccgaacatggcgatgacgtgctgtgcgccgataccggcggtgcgcacccaagtcagacgttcatcgggctcgactacctcgccgggcgccagcgtcttgccgtcgccatgcaattgccattggaagatattggacattactactctcctcgctctcgcttggggcacggcattcacaaccagccgcaccacgcaccattctagctcacgaagattttgtgaagtctctcttccgggaaaggctatttgccgtaatactccagcaggtgtgggtcgacggcctgcaccacatccaccaaatcgccattggagagatacgggcgcttgaattcgcgccacggctccaccttgacctcccagcggccggtcgtctcgtcgagcacgggccgggcggtctgctcccagcgcacacgcttggaggtgcggccggtttccgggtcgcggcgcgtgtagtgcaggcaggtgcagttggtgatcttccagtcgtccgagtcggcgcgatgcaggaattcctcgtcggccagatcctcgatggtgagcatcagggcgagcatgaagtcgccgtgggtgaccatgaccacggattccgaatcggatttgcggctcagcgaggtcaggatgttgtgcacacggtcctcggccacatcggcaatcgactcgcctgccggcggacgccagtacagcggatcggtattcttgaagttccagttgcgtgcgtagttgtttttgaattcgtccttggtgatggtgttgatttcaccccaagaacgttcgcgcagcacacggttctcctcccatttggccttgggcagggccatggtggctgcggtttcgcgggtgcgcacgtatggcgagaccatgtaacggtcgaacagctgctgctggctgaccagccaacgaccgatgcagtcggcctgcttgcgtccggtggcggtgagtctccaggagcggtcgggtacggtgacgttgtcctgcgtatacagggagttgtcgccctgttcgcccgcctggacgatgacgttcgcttcggattcgccatgccggattacgtatagatcgagcggcatgctcatatggattcctctttcgttattggttacgttgtgttgttttctgctgtttcctacttgacctgcgttatggtgtcccccttgaccatgaacgcatgccgggccatgtcgatcatcggctggtcgaacttcgagtcggtgtagaactcgtcgacgacggcgtccggaccgtacagctcgcggaacctcctggccttgttggtgttgaagttgaggtacgtgaccctcatcgtctccacatccacctcgctggccacgagattcctcacgccgagtctgcggcaggcctcccccaccgtcagatcgaaggatgcggtgaggatcacatcgtccgactcaggctggtaccaaggcttgatacgtgcgtaatatcggtcccagaaatcgtccacgagctgttcgacgctcgccacccgtttggatcggctcagttccgtgagatagccttcggtcatcttgcccacgccgtattccatttgttcaagcgtggcccggccaagcttgtatttgaccgcgtaccgcagcacgggggcgatatagcggaacactttcgggtcgtggcgggcggaatacaggtacaagtcgaacaggctttcgccatcatagatggttccgtcgaaatcgaatacgcgcataccttctgcttctactctgttattccttgtctaaggctaatctcggtaagccggcgaaagcgcaaatacgcagtgaatttcacatgaacactgttttttggattgatttcggtacaggtaacgtacactggtgacagcgtggaaggaggtgcgtaatggcggcgtctgaaatcgaacaatggtggattgataagtttcaggagaacctgggtccgattcgcaaggtagccggatggacgactcagcaactggccgacgagctgggagtcgcgcgacagacggtgtctaacttggagaccggcaaaagcccgatgaccaaactgcagtatctcgctttacgtacggtgttcagcgccgagatcgcacgtcgtgaagaccgcgatctggcacgcatcatcaagactttggtcgacgatcccattgagcaacgcattcgcgaacggcgcgcccaagagcaggacggcgaggccgttgccgacaatgccccagtcaatacggacggtggcaacgttgccgacaacgccgccaccgagaaacgcaagcccagtgccgccacattgaaggcttcaaagactgccgcaacgggcaagcccacgctcagcacggcgatgcaggctctcgccgtcatcaccggcgcattggccagtggaaccgccgccggcatcatcacttacttgatgttcccggacggcggcccgaacaagcgctgagtcgccgaaatatcgaaacggattgaacaacccagttcgaagccctgagcaccattttgtccgtgtcgcaccagcgtttccctcattatcagctgtttcgagttgcatgaatgcaccgtttacaggccgagaatttcgtgcttttttgcatcaaattcttcttgggagagaatgccgatatcaaccaattccttcaatttcttcatcgcctcgacttgttcttccacagacatggatgccgtgtgagaggcgggagcagcggcttccggcgccggcgcaggcgccggcgcttgaaccggggcggccgtcataggattaatggcttgtgccatattcatgcccagcaacatgccaccatcgccaaagccgttgtcttggatgccttgcgcaatgcgctgctgggcagccatattgccagcttgctgggaaacgccctcgtatgcggcaacattcatcttattcgaggcgaactgctgcacgagttgacgtgattgctcggtgaactcgatactttcgatgcccacactggacacttcaaagccaaaacgatcattccacgtacctgcattggcccgatcgccacgcacgcatgctgcgatgtcattcgccttgccgggcaattgcgaaatacgatattcattggacagcaaattgatggccacaataaacgactgtacgaattcagacagaatctgcctacgtggcccttcatcatcgaatgaatacgacacggtagtggcaggcacaaagttacgaacgaatcgaactggatcagcgacctttagcgacatggatccgcgtgcgcgaatttccaaatcgacgccatagaaccggtcgttatacaccagcggcgcagaagtgccgaatttgatgccacgaatctcacgcaggttgacgaaggccacatatttggtgcggccaggctgacctccgaaggtgaatcgatcggcaacctgattgaagaacgatccgatgccgtctccggcgagcacgctctgctccccgttgcgatattcataaccgcccgactcggtgatgacgttttcgatacctgtttcagagaaaatgaacgccgcagtattctctggcacatagatacgcgaaccattggtgattattccctcggaaccgtattcattcgaaccgcgatcgttgttgcttccgcggggaatgcccggcacaacgacggtgtgttccgtgaacggaccagcggtgatgatatcacgccacaggtccgcgaatgtaccgccgagcgcgccggcgaacgccttaataactgccatctgttttttcctcgatatctcatgcatatggccgatcttgcgactatgcaatcgcaagaccggccgttatgctggcatgttggttatagctgcgtttcgcgatcgcagtattcgcatcgaacgacttctttgcgatgaccggaaagcggagcgccacaaccttcgcaattcaccgaaaccacgggttcggtaatcccaagcccactacggaatgcgccaaaagtgtccttcagcgccccggccagagcctccgttccggggatggccttgttgaagaccggctcatccattggcgtgtactgtctgccgcgtatacccatgtatcgtcatcgttcctttcttggaaaaccgttacctcgatacgccagtctgatcactggcccaccgatgcgagcttctgcgtgcatcgagtcatgacctcggtgtagtaggccaaatcctcactgctgagggagttttcgtcaatggcgtctaccttctgggagaactcagagtaacgcttcatcatgctggcatagtcggtagccatgctgaccacgttgtcggatttctgatatttgttcatgaaggcaacatactcatcgataaaggcctcgtagctgtccatcgtggccttgaagtcagcactgtcattggtgttctgctgcgccttctgatccgaagactggtcgctctgcttgttggcatcgctggaatcagtgcccgtaccagtgctcttatcatcctgtttcgcggcgtcgccgtccgtagacgtatcttccttcttttccggaacctggatagtgatggacatgatggtctcgtcgtcagtgtcacgagaaacgctcacactgtatccatcggcgttcttggcattgaaactgtcagcggacttgctatagtccacggtgaaaccgttgtcttgcacggacttgacgtagtcggcatactgcttggcgtcggtaccgcacacctcgatggagaaatagtccgaagactcgcttttaatttcaccctttgtggatttcggctgcggcagcagcgccgcgatatccgactccggccatgaatatgcttcgcacttggtggcgagcgatgcttccaattccgcccgatcagccttggccttcgcatcgtcacgaattacgaacacgccaccgattaccagacccacaacggtgataccgactgccacccaggccagcactcggccttgcaccttgccactcgggcgggtcacgtatacggcgaagcctgagagcagtgccggaatcaccgtggcgaacagcagtccgccccaggatcggccagaaacatccacaaattgggcgagtacgaacaacactccccaaataatggcgaacacagccagcttggaagtcttcttcaccccttgtgcattcggagcaagcacggcaggcgcagcggcaccagcaaaaccagtggcagcaccggcaccatgtgtggcgggtgcaggagccacaccaatacgcttgtccagagcggcgaggaactcatcaacgcgcttggcgctttcgtttccagtcgcctccagacgaatggcggcccctgccgcaccctgcgggactacggttagcgtgcagttcaccccatcataggagtggaaggaaaacgctccggtctgggtgttttcgttatccaaggtaaacgtggcgccagtagtcagctggtcgtgaataacttggaacagctgttgcggactgaccgcatatacacgatcaaatggcgcgccggcgggccgctgcgatgccgtagccggagccatcggagtggtggtagcaccatcagacgctacgttcggttggccagccggtacagtattcggcacggtaggcgcattcgcgcgatcttccggtgcgtcattcgtgccttcggacggtggaaccggctgaggttgttgatcaaatggcgttgtcatgatgcccttctttccttaagcagcagcattaccagcacagaagaggcaagcccggcaaccgttacggtcaatccgactgccatggcaagccggtatcgttcgctcatcattgcgtcccttcttattgctcgcgttgctctgcgatacatcgaaaccagtgtatggcgttgttattatgtacgcaaattagcattttgtattcatgttagctttattgtcgatgcttgataccgcgcatgaacatcctttccgccaccgcacctacacggatggcatcgaccattgtcggcgacacgcgcgggccatacatcagctgacaactgaatttttcggcgtgtttccgaaaagtcggcgtcctgtacgctgggaatcgagcaaccgcgtacgatggcgcagcacagcacccgcaacacagcgacaaggagcataggcaatggcagacatccccgaagaacatttgaccgaggaactgctggatcggctgctcgccagcgccagcattgagcagtatctcgatgagggacttgtcagcgcacgcacgctgaccgactatctgttcgaccgtatggaagcccatggcctgaaacgagccgacgtggtgcgggcatccggcctcaacgccacagtggtttatgacattttctccggcaaaagccgccccggccgagatcacgccatcatgctggcttttggtctcaagtgcacattacgcgaaacccaacggctgcttcgtcttgcaggcgtttccgaactgtggtgcaaacagcgacgtgacgcgattatcatctggtgcatacgcaatggattcgaccgcattgccacggacgacgagttgtatcgtatgggagaggcgacgttgctgccggccgattgacgacattcggcccaacaacactcaccagtgagacgcaagtaagagggcatcaaggagagacatggacgataagcaagcgatgcatgcgatgagcatcgacgatgcgtaccatgttgagcgcacgcttgctcgcggaccttccggcgtcaccgaactggtgagcattgacggcaacggcccgttcgtacgcaagaagattccctctcccctagcgcaacgcaatgtgtgggcggcgctcagcgcctgccagagtaatcgtctgccgcgtgtggaagcgacgtacgagctgcccgaccggttcgtcatcgtctacgattacgtgccgggcagcacgcttgcgcaaattgcggaggaaaacgggcggcttgcgccgaatgtggccgtgcagcttatcgaccaaatttgcgaagccgtgcaggagcttcaccagcacggcgttatccaccgcgacatcacgccggccaatatcatcctggctcgggatggcgcgcatctcatcgatttcggcattgcgcgcatccggtcagaggcaagcaaccgttcacgggataccacggcgcttggcacctacggattcgcctcgcctgagcaatatggctttgccaaaaccgacgcgcgttccgacgtattctcgctgggccggctactcggattcatgctgaccggcgtatatcccgatgccagcgactacgagcagcgacttgccgatgatgccgcagtaccggctcgactacgcgccgtcatcggctatgcgtgcgcattcgagcccagcaaacggccacagagcatccaagagtttcgccaggcgctgttctcccagtccaatccgcccataccgaacgcatcatcggcaaatccgccatcaacgagaacaacgaacggcagcgcgtcggcgtctcgactattccggcgtctgcacttgagcaaacgcgccatcgtgctgtggtccattgccggagcggcactgataatcgccgccattgcgggaggcattgtgttggcaggccaacttggcattatcgggtcggcaacatcacccgattcctcgacacaatccagcagccaatcaaccgataaggccgatggcgggcactcctcgaacgggtcaggaaccgacaatgccaatggcacgggcggagtaggcggcactgacggcgctgatggagacaatcaagacaccgtcaccgacaatcctctgaaaatagtggaatccggctggtcggcggaccagcaagggtatgtccactacgctttcgccctgcgcaacaccagtaagacccagcaggtgcagtatccgcagattaccattacggggcgggccaaagacggttccatcgtgttctcgcagacgcaagcactgaatatggcattcccgaatcagactgtatatgacgccggtcaagcaggcgaaggcaccgccccagaaacggttgattttactgtgctcaatccggatacatacaacgtcgccaaggctcagggaaccgccgccttccccatcagtggaatatccaaaatagacaacagggacggcggcacgacgttcaatggcgaggtccacgccgtggcagatggattcaagccatccgatgggcagcaaatcaagatttccctagtactgcgcaacgcacagaacgcaatcatctatggagatatcacattcgtggattggccgggcaatggccgatccgcaccattctcgatcaccgtttacgatctgccgaagtatgcatcttacgatctgtatgcgcaaatctggtagttgactttgcgcctgcgaggtggctgtcaggcgactgtcaggcttgtgtccgagtcacctgtgcactggtgttgtggcgcgcctggccgaacagatagatgccgatgggcagagtcagcacaccgccgatgatgaacaccagcgaaatcgggatcacgtcggccaacggcgcgaagatcaacatacccagcggcatgctgagtgtgctcatggtggtgtcaaggccgaatacacggcccaccatcttctcatcggcctcggtctggatgatggtgcgcatcgggcccatgcagatggccgaagccaaaccgttcaccacatcaatcagcaaatacgccagcagattgtgaaccacgccaagaccaacgacggagacgcccaccagagtgatgccgaaggcgaccacgcgcatgttgttgcggatgagcttggcaccgatggtagacatcagcgcgccgccgagcagcataccgatgctccatcccagctcgttggcggcgagtttatcggaggcggtggtcaggttgatgaatccgagattcaaatcgatgccctcatattcgcgggtcatgagcaacagcgtaaggttcatcggcgccacggccacgaagcacaccaaggcgtcaccgagcaccacgttgcgcaggttcgcccggcgccatgtgtagctgaaaccatctttcaagtcagcaaacacacgacggacgctggcaatcagcgaacgatcagcattggcatccgacatcggttcgagtgtgggttgcccgctattctccgcttcagccatacgcctcgcaacatgttccgcgctcttcttcggcgctttgatcgacgccacaaagccgacgccgataatggccgtggtcacatcgactaacagaatcgaccacagcggcactgtgttgataagcacagcagccaccgcaggtgccacaatcatattcgccgaattaatcacgccgtatattgagttgacgcgcaatagtttgcccgagggaacaacatccggtatgaacgactgcacagcgggcgtctgcaccccgcctcccgccgaacgaatgaacagcaccacgaaaatcatggtcagactcgcccatcccatcgcgaagctcagcgacagcacgacggtgaccacagcaatcaccatatccggcagcataatcagcaacttgcgactgtgacggtcggcccaggagccgccgcaaatcgagacgatggcctgcggcaccacgccaaacaacgtggccagcagcatggccgaaccggttttagtctgcaatacgatccaccaccagatggcatattgcacaatattggagcccagcagcgagaacgcctggccggtgagtagaagcactacacggcggatccacgcacgctcggattccccgttggccactgctgcggcataggcggcaccgggtttgttcgcgctatggaccgctgcgcgcgcattcgcattgtcatcgccggaaacctcgggtgtttcgcgcacagttggttcagttgttgtactactagaagacatacgagtgttctcaattcttcaattccactacaaaggtcacatcacggcatacgcacgccgacgcgcgtatgcgtgcacgactccagcaacgagccgtacccgccgttagatggcaggcttcagtatcgtgacgccatgcgttagcgtcaccatgcaacgataggaacacactattcgatagtataatcatgaaggcgtgacgttgcccttgcgcaggtgccgtaagactccgcggacaaagcaatgaggcttccccgcgagaagggaagcctcatattccattcattctattcagcgatgatggcgcctaatcaccgatcatcctttgggaacagcgcatcgaaggcatgttccatcacggacttacggcggatcacaccgacgagtctgccatcagcatccaccaccggcagtttcttgaactgcttcttggcgaggattcgggccacctctccgacatgctggtcgggcgtggcggcaacgaccttgcgcgtggcgatgtccatcaccttcttgccggaaagcgcctgcaccttggaggccacggtctcgtcgtcgaacaccaccatcgtcgaaccggtgccggtggaaaccgtacgggattcataggtggcaatcgatttcatgacatcgccgtcgctgacgaagccgacgagcctgccatcgccgttcaccacgggaaggctggagacgttgaggcggatgaactcgcgcaccacatgcgtgatgtcatcgctgtccaggcagctgtagggctgatcgtccatgattccgccgatggactgttcctgggcctgcttgaacagggaggcggcgggggccacgtatgcgccggcgtagtgatgctcggcgggctggccttcagtggtttcggccgcgacttcggcggaggcttgcgcctcggaggccttggcgttgcgtgcggccttctccttggcacggctggtgacggtgaagatgcagatgatcagggcgaccagcgagatggcggcgcacagcaggtaggagaacgcgatgccgctggccgtggcggacttcacaccctgggacatgtgcgaggcggtcatggatgtttctgcggtgaccagaagcgaggtcgcaatggctgccgcgatctggcggccggtgttggcgatggcgttgccatgggcgatcatgtcgttcggcaaagcgttgacgccccaagtgttgatcggcatgttggcgatagcctgaccggatgcctgcaatgcgcagaacacggcgacaaacagcactgatgtcccggtgttgatggtgccgagaagaccaagagagatggtcatgagcgcaaggccgccgatgcccacgcctcgcgggccgaatttgtcgaatgcggcaccggcgaccggactcaggatgatgccgaccgccgcggcgggcagcatgaccatgccggtgacggtggcggattggccgagcacattctggatgaagataggcaacgtcacgttggttgcggcgactgcggcgttgatcagagtgaccagaatcgcggagttgcggaagttgcgggtggcaagggtgtcaacgcgcaacaatggctcatcgagcttgacttgcttgtatacgaatgcgacgaaggccacaagaccaacgacgattgagataatgacgaccggactgctccatcccatcgtggaagcggacgagaagccatagagcaggccaccgaacgcgatggtcgaaaggatcacggacaggatgttgagctttgggttcttcaactcgccgacgttcttgagcatcatcgtgcctccgacaaggatgaccagtgccacgactgcgatgccaatgaacatcgggcgccatccgaaactgtcaatcaccagaccaccgacaaccgggccgatagccgggccggcggccatgacgataccggccatgcccatggcggtgccgcgcttatccggcggatagacgagcatcggcactacggcgaccaatggcagcagcacgccggagccggcggattgcagtatgcgtccgacgagcaacagcatgaaattcggcgcgacggcacacagcagtgtgccgaccatgaaagtggcaagagctccggcgaagagctttcgggtggagaatttatcaatcagatagcctgaaatcggcaccatgatgcccgagaccagcatgtagacgctggtcacccactgcacggtgccggtggtgatattgaaatcacgcatcagtgccggcaaggccggtgacatgacggtctggttgagcagcgcgatgaacgagccgacgacgatcacgcccacgatgatgaatcgggtgtgcggatcaataggctttacggaactggcggcggacccgaattccgcggttttctgtgaggtcacagcatttccttctgttggtaacgtcatgtatgggcgatccggccccatgcttgtgtcaagacacgaggacaccgatgagtccggacgtaaaggaaaagccgccatccgttccgcattcatatacggcaaacgattcgcggctttgcgtaagttgatggctatggtgagcgattcatgcgacgtcgactgcggatgggccatcggtacatccgcatgaggcacgtccccgctacaccagcatcgagaatagggccatttgtggattggcaaacagaacattgccgacgaacgacccacggcaggcgcgtgcgatgaacatcgcgtagcgatacaggttcatggcacctccttgatgggtcttcgtacggcggacatcgagaagcctatcatcattcaaatcgacggtgaaacccacgcatgcctgacaatacacaaaatcttcgcaaaaggattgggcttaccgcatacgatccgcctgaatagcggtccggggatgaatcaggggcgagctaagggttgcatctcgtgtttccgtcatgatttctggcaaaatagtgaagctgaacatgcgcggaatcgaccggaatcggaaagggactaatcatgcgagttctcggcaatatcctgtggatcattcttggtggattggccatcgcaatcggatgggcattggtgggactgattctgtgcatctccatcatcggcatcccgttcggcattcaagcgttcaagatggcgggactcaccttgacgccgtttggcaaaaccgtgcaatacggcggcggagtcggctctgccttggccaacatcctgtgggtggtgctggtcggctgctggatggcgctcggctatctgggtgcaggcgtgctcaactgcatcaccatcatcggcattccgttcggcatccagtcgttcaaaatggccaagctcgcgctctggccgttcggcgcacagatctacagtttgtgaattactcgaaatcacatacctacaaaaccaaagattgttgctgtaccaacgtctagtcgttggtacagcaattacggcaacatctccccttacaggaagaagtcgtcaatctctgcttcattgtgcaatatctcggtttcagagacaccaatgaatcttgccaaatcaacagatgcggcgaaacgtagctgtatatttaaatcaagattgaatgcataagtctgcagctcccctagtttccggtatttatcgagaagagtttccaatatttgcgcgtattgcacgtcgagattcgcgacgaacaagtccgctttgcgctgatattcagcgatgattgcccgctctcttgcactcaatatgttcttgccaagaccaagcacattcgaagcgacaattgacccgataagcgcgcccacaacgggaacaggaataagcgtctgaccaatcgccgctcctaccgccgcgccggtagcatcaagggcattgatagttaccaagctcaagaaaccgtcatcatcaatctctccggaacggaatttcatgacagcatctatgagtccaaaagttccggacgctatcgcccctgcgctcggagccgaaagatgacagacattggtcaatccataaattgcatagcccgaaaacccgcctttgaaggcaccctctgctgtcttgacgcctccttccttccaatcctcagcggtaaactgccatatttccttgccttcgtcgtgcttttgatacacgaaaatgccgaagttcaatccaccttggatagcagcacccaccccggcagctttgttagcctcgcctagattcggctgagctttgtgatatgcagcagccttatccgtattggccttattggagatttcgctcttttgctcggatgtctgccgtttaatattgtcggtttcttcagtaaaagtccggtcaatcgcttctctttggacctgatcatatttcaataccgatgattgcatccatttgtcccaggacagtccccggatgttactttcctcttcgataagctgcttaattttctgcacttggttactggttagcggttgtccgttgagaaagacttctttatcgccatgcatgaccgcacgaaaaatgtccatgtggtcctttgaaaacatcatatccatagaacggtattccgcagatgtcttcagctcgttcattaggttcgcatagaactttacctgcactggcttgccgttaatcaacaaatcagcaggaccattatcattaagcgttattgttgatttttccaacccttcaaatgctcgtctggcgttagcgattcccgtctgcgcgaattcagcgataaatccatgtataccattttcaccaccacgcccactgttgacaatgttcatgacattttgattcgctaaatcaaggttccttagcgcattagcttgtcgctcggcgagatctttcagctgacctgtttcattattaagaatctgtctcaatgtgtccatcagagtagacacacgtagctgattcaaataatcaatatacgcggcaatgccctgagcaacattgttatcgatggcgtgcttgtcagcagtattcttgtcagtcatcgagttccagttccttgttaatcatttgcgctaaggtgagcgtcatattgaccagtaatcccgcctgcattttctcttcgtgggagaactggctgtaatcggcgcctgtcaccgcagcattcgcacgctgtacaccatctatctgagtttgcgttgcctcagtcaatgccgcgacttcggcattcttcgcattgaatttgcgaattaatacttccacattctggcgctcaagcaaaagcttgtcagcagtttctttgtttttatgattcgcataaataccagaaccaattgccgcagcgcccgccacgccagcgatggtccatccaaccggaccagccaggcccaggaacgcggttccggctgacatgccaccgccacctgcagccaatgcaccgccaccaagccaagccagagcagcactatttgctgcagctccggataatgcagaaatggcagtaccggtcgaagctacaccgaaggtggtggccacacccattgcagccgtaggtcccatggttgctactgcgattcccaaagcactgagggtggcccctgctccagaccctccttcagctgcttttgcttgcttttctgcctccttaatctcatcctctttattctcgaacgtcgttacttcggtattgatcttatgcagttcaacggcaaattcttttggcgtattagccaattgattgatatgttgttcaacatacttgacatgcacaatagcgatttttctcaagtcatacagcgcttgcgtacttttagctaaatcatccgctacgttttcatagcgttctacggcattgttgtaatcctcgacagccttagctcttagtttggaattaaacaaatcgaccttatcggcactatccttgacgtttttagcgattgagacggtaccctttgccatgctgtcagccgctttgcttacttcgccacttgcgacggccgcagactgtgccacgctccctgcaacagctgccgtcattttgcccgcatcgccggcaagcttacccgcatcgttgacgatcttacctgcccctttggcaacatctttcgtgatttttcccgctgtgtcaccgatatttccggctattttaccggcttgtttggtgaaatcattaagacctttgcccaaattatcgaacatgttgcccatggttgttgctccccttttcacgcacctgccatgatgtccgtcatcgacggcaagtgcttcgttgcacttataggccaagtgtactcataattacgtagctgcggtacatgaccatacatgcacactgcgtagtttgacggattcgcgaagaagcccccatgaatgaccaaaacgtaacttgcttacacacaccgtgatttgacggatttggacgtaagaccttatggtgtgcacaccatgattcaacgtatcgcattcagcagcaacggcgtgaacgaacacgccaagcgccagcagacgaacctgccggcgatgctcgaatgcgccttcaaacagggtttgcgtactgctcagttccagccaataaccggaaacaagcgcagcctgctcgctgccaaacaaatctgatcagtacaccactcattggcgcatagctgaatcattgccggtgatatcgagccgactcgttcgcgccatgcctcatatacgcacctgtacgagcatgtgttcttggcatcgtcgcaactcaatgcaccgcaacaaaaccccattgcataccatcacatattcagaaagaacaacagatcatgaagtatttcactactgacacgcatttcgggcatccgctggtcagcgtgctgcgcggattcaccacgttcgaccctgggcacacgcagtatgacgctctcctctcctcgcaaggacgcaaggccgccgaggattgggcgaagggcgtggtgcttgacgattcccggctcaatttccgcaaggccgcggacaccgatgcacacgatgaagcaatcgtggccaatatcaatcggattgtcggcgaggacgacgagctgtggattttgggcgatatcggataccgaacatcggtccggcatctgaagagctgcctgcgtcagctgcgctgcaggcatctgcacgcggttatcggcaatcacgatgactggtggctggacaatgcacccgcgcgagatctgttcgaatcgattgagccgaacagcacggcggagctgaccggtctcggaattggccgcccgcaggcgacggagaccgtcaatctatcgcatttcccctaccgtgaggatcttgcctatggctggccggatgatgccgtacgtttccgcgatcaggcattgccgttcgacggacatcgtctgctgtatggtcacacgcaccagctgtctccggagggcgcacgccacgaagccctcaacgttggactggacgcatggaatctgcaaccggtaagcgaaacacagattgccgactggttccatgcacacgcgaccgattcaacgcacgtatcaccgctggatatgcccgactcccccgggccggcgcccattgactccgccgcacagcaggaaccaggcggctcggtttcggcagccgaatcataatacaagcaatattggggcgagcagaaccttatgccatcgctggcacctgtctcgccccacagcacaacgaaaggagcttggctatggcaaagctcattattctgcgaggactgcccgcttcgggcaagtccacgtgggcacgctcatggtgtgaggaccccgccaacacgtggccgcattgcgtgatttctctcgatgacattcggctcatgatcgccggctcggcacaggtccgaaaccgactgcaatccgagcacggcaagcgattcaatgacatggtggttgccatgggacggcacatgattgccgacgcattggatgcggggtgggatgtggtggcagatgcgcaacacgctaatccccggtatgcagccgaactggcgctactcgctcaacgtcatggcgcactgtgggaaacgagggattttgacgttcctctagacgaattgttgcgtcgcaatgcggcgcgtgataccgctgaccgtgttccggaagattacattcgttcgtcctggaagcattttcacaccgcgatgttccgcccgttggaaccgggcgatccgaatggaaacctgttggagcgtatgcgcacggacccttacgttcgggttattccggtgcgcggcgaaacagacgtgtatgcgtgcaatttcactgcagaggcatttcgtgaacatcggtggacggatcgcaccatcaatgcgcgagggctttttatcggcggcaacggtcaggtggtgcaacgcgggttcgagaagttctttgctgtggacgagacggaggagacatcgttcgcccaagtcgtcaatcacgctcaagaacatccagagtcgttgcccgtgcgcgttgagcgcaaggagaacggatttctcgggctcgtgggcgcggcgggaactcctggattgttccgcttctggtcgaagtcggggcaaacggattattccgcgcttatcgagcgcccgtttccttcagattcagcggtacgtgccgaattgtggcgtatgttgcatgagtggaatgtcacggcggcgtttgaagtcatcgatcgcgagtccgaccggcacatcgttggatacgaatcatccgggctgcgcttgctgcatttgattcgtaatgccgaatcgttctccatcgatgccgctcacgaggaaacgttcactcttgccggcggcttcgtgcggccggaaacggtggcgatctgccattcgccggaagaagtcgcccaggcaatcggcgacgccaaggcaagcccgcgtgaaggcgtggtgctatattttgccgacggttggatggtgaaggtgaagtcagaccggtacaagttggtcaaggcgatgcgccctcttatgcaacgcgtgctgctgcgtggtcgttccttcaacaagtccggcgacattgccgatttggctcgccgtatcatcgattacgcacacgaacaccacatcgacctggcctacgagcggcaggcattcggcgagcgcgatatcgatatgaccaaggtcaacgacatcgtggaccacgtgcggtgactgctgagttctagcgcaatatcttctgaccaacgtatgtatcacgaaggcatgtgtcgtgaaagcatgtattgcgctagaaccaaatcattctcgttgaggccggataatgaatctctatgctttgaacatgacgcaccatatgccggcatttccttgcgcgaacaactgttcattacgaacattgtactgatgccgttacagaacagaaaagggtgctgtcctactttgctgacgacgttgcattgaaactcgactcatgccatgtgttctacactccgaacgtggggatccgaggcgtatccagctacgagcacaacttcgatttcctgttccagcgtagcgctaaccatccgacccggttctgccaggcaccgaaccgattcgacaaggacgccgtgaaagacatcatgttcggttgggatgacacgaagaaggatcccaagcgcagggattcccggctgatagtcatcggcgacgaccggcagacgccgttgcagcgcggcgcgctcaccgcgttccgcaactacggtgtgccgttatcccctactccaaattggaagagcgggctcccgtggaactcgccgcgtagcttccgagccatataaggactcatcccgacgactcaccgcgagcaccgggatgagtccttggttcttgtgtttcgccatatgattgagtcatgtcggacgacaatgtccggcacgaagggagaccaatcatgaaaaaggcaatcgcgctgcttgttgcggcgatgttgcttaccggcctgtccgcttgcgggggaagcactacggccgatgcgccggccaaatccgatggcacgtcaaagaccgagaccaataaggaagagcccaaaccccagccggccgatctgaccggcacatggaagcagaccaattccaacgacccgagctcatacatggaagctaccatcagcggcgacaccatcgaggtcgactggatcggcaccgacaccaagagcctctactggaagggcacctatcaggcaccggccgcagccggcgattggaaatggaccagccaggacgacaccgagaccatggccagcgcgctcctcgcctcgcaggatgccaccaaggacttcacctacagtgaggcggacggcgtgagctgggagaccaccgcgctcggtaccaccatcaccgtcaagacggccaagcaataaatcccgtgtcgggcggatcaagccctaaacacgaaaccgccccggtcgctctttgcgagcgccggggcggccctgcgacatatcgacgattagacaatctgtcgcattttcttgactgccgcccacatgaccgtctatcatcatttatagatcagcgacaagaatacacaggtatccttcccctcgaaggatcagctggtcgtattattggattttggcctgtccttcatcgaaagtcggcttcatgccgtcgtcgtcacagcacgactagagttgagacgggccatctattccttctaccattcaggttgcgcccatccgtcgaagttgatggatgctctggtcagaggattgtatttcggccgataatagttctttgatttgaaatatctgctggaatcataaacatcatggaccagcacaatcttcggttcaagaagcccgaagaacttttcgtctcccttctcgtacactcgctggaccgtccatagactgtagtcggcgagcgccaagagaatttcgtgatcatacggttggacgttgaatttggtggtgtttcgcaattcatgcgttaccgtgccgcgacggctgcgctgttgcgcgatgtccacggcatgctgaaggttgaggttcgatgtgctgctgcctcgttccgcgacgtcgagaatcaacggatctatcttccctgagtatttgagtagatgggacatgaggtcggcgtagaattcacgtggttgttcgttgtgcctctgctgatagatcgccggtatcttacggcccacaactactcgtgcggagaagtcgatctcctgcgccatgagtttgaggaattcatagcgtagttccgcaggatctttgctggcatgcgggtagaagccgtgccatccctcctttgttctcttttggacgctgggaaagctctggaagaatttgctgctgttgatctcctcacaaaaaccgtcgatagtcgcacgagcatcgtcgaggggacttttcacatgtacgagcccgatcatgaagcatcgggaaactccgtccatcccgatggaggaggttttgcggccccgcttcccggaatggaaggtcatgtcaccggcctcatcgataaatcgatgatggtcctgtggcccgtctactttctttatgctcatgcggacaagtctactatgcgtcacgttcgtcatttcccctcctcgatgacctgcgcgtctatcacatccctctcgtcgtgcaggtcagggatggctcggtcgaggagcgcggcgagactggccgcgtccctgtgggtgtagtggttggtcacgctgatgctggtgtggcccatgatggcggttctggcgtcgtcgggcatgttggcgcgggcggtcatgctggcggtccagtggcgtgcgctgtggatggtgaccggcgggaggccggcggctttcaaggccttgttccagttgtagcgttcggtgctgctgcgcacggggttgcctcgtgagttggtgaatatgaggtcgcgtgggcctatgtcgagtcgtttgatgcgcgcccacaatcgttgccacaggctcgtggatatgggtacgaaccggtgggcggcgtgggttttgggtgtggtgagccacaggataccgtacaggtgctcggctttgagccaggcgggtatcacggcgtcctccggtttgccgtattgctggatctgctgctgcacgttgatgccgggcacgccgtcgcgttgttcgagctcgtagggcatgagcgcgtagcgttcgccttccctcatgccggccgcgaacgcgagttcgaacagcagcatccaggattcgtcaacgtccacggtcagggccggtccgcgtcgtttcgctccccggttgggcacggcctcgatcagctgcttcggctggtctggcgagaggatcctggtctcggtgggctccacccttggcggcttgaccctgcggcacggatccacggggatgagctcctcgagttccgcctggtcgagcatcatcttcaggctcacgaaatggtccttgagcgtggagggcgcgagccgtttggaaagcacgcgcatgcattggcggatatggtcaggggtcagctcggtgaggcggatacagccgatgacctccatgcacgcatgaatcctgccggcgcgggtgcggtacgtggtgggcttgacgttgagccggtattcctccagccaccgctccgcgtaatccttcaggtacgggctcttggcgccgggcagcaggccggtgcgttccatctcggcgaccttcgcgtcgaaccgttcgcgggcatcggccttcgtgcgacccttggccgagacatagcgtgtttgtgttcaattagttgttgcgggtttagtcacgatgatttttcgggtttaggcagagcatgccgaccacggaatggtcttaactggatggtgcttgtatctccgccagaaaggaccggaaaggattatgatcagcatgccccaagtacagtctatccgtcgtttgcggcggaacggggaatccgtcgcgtcgatcgcgcggaaaacacatgtcagcgagccgacggtgcgtaagtacctcgcgaaggaggatctgtcggccgtgccgtcggtgagaaagccgcgcgcgtcggtgatcgacccgtatctgcccgtgatcgagcagtggctcgcggaggatcgcgcgaactggcgcaagcagcggcataccgcgaccaggatctgggagcggttgagggacgagcatggcgcggaggtctccctgtccacggtgacgcgggcggtggcgcggctcaggcgtgagttcgcggcggagcgtgatgaggcgttcatggatctggtatggcatccaggcgaggcgcaggccgatttcggcgaggtcgacgtgctgttgcgcggcgtggtgcagcggatgcatcatttcgtgcttgatttcccgtattcgaacgtcggtctggtgcagttgatgccgggcgagaacgctgagtgcacgtgcctggcgttgcgcaacctgttcgagtggctgggcggtgtgccggagcggatcgtgttcgataacgccgccggcgtgggccataaggggtacggggagcgcgagccgcgcctgacgcacctgttccaggccttccaggcgcattacgggttcgattgttcgttctgcaacccgtattccggtcatgaggagggcgcggtggagtccaaggtcggcatggtgcggcgcaagctgttcgtgccccggccgagcgtatggagcctggagaacttcagcgccgggctgccggaccggtgcctggagctggccacgaaaccgcattgccgcaaggacacggaggaacgtggcctgttctccgaggaccgtgcggcgctgctgccgttgcccgggaagcgtttcgacgtggtcacgtggcggcatatgaaggccgaccggtacggcgtggccgcgcccggggacggcatcgctgttccgcggaccgggcgaacgcgggcagaggggtgatcgtgggcctccgcgcgctcgaggtcgaggtcctcgactcgtcgggcaagcatctggcgacccatcctcgggcgtacggccaggccagcacgaacagcgaggacccgtccatgcagttggcgctgctgtgcaacaagcccgcgtcctggcccaacagccgggtacgtgacgcgttgccggacccgttgcgggaatggctggatcggcaggacggacagacacgcaacgaggcgctgcagaccctcaaacgcgttgacagggaatccgggtgggcgaacgcggtcgaggcgatgctttccatcctcgaatcgaccggcggggcggaccgcgccggtgtcacactgctcgcggccaggctcgccgagggcgtggcgggtatcgaatacgacgatgacaggccggatccgggtgaatacgacatcgcgttcaccgcggacgtcggcgtgcaggaaggcgggcgatgaacacgaagacggacgaagggctctacgagaaggcccgcaagctgttcatctccaaggcgagcatcgacgaattcgccggctgggccacgccccgccaggtcgacgccgtccaccgcctgctcgacacggaactggcgaacagggaacgcgcgaagcacgacaggctcctgcgccgcgcccggttccccgtcgtcaagggtctcgacggctacgacttcacgaacgtcaggctccccgacggctacatgctcgatgagctcctagggctcggtttcatcccgcgcgcgcaggacctggtgttctacggcaagaccgggcgcggaaagacacatctcgcgatcgggctgggcatgaaggcgatcgacatggggctgggcgtgcggttccatcagaccgccgagctcgtcctccagctgggcaaggccaaacgcgacggcacgctcgagacgatgctccgggacatcggccgtgccgacctgatcatactggacgagttcggctacgcacccttcgacatcgacggggcgcgcctgctctaccggatcatcgcgggcagctacgaaagacggagcatcatattcaccacgaacatcgagttcagtaaatggggcacggtcttcgcggacgacaaactcgccgcagcgatcatcgaccgcatcgtgcaccacgggcggctcctcgagttcaccggccagagccgccgcgtcagtgaggccctcatgttcggcaggaacacctccgcgcaaccggaaaaataaggaaaatgcatgcaactgcctaaacccgaaaaaaatacatgactaaacacgaaacaccgacttgacgaaatacacatagcgtcgtttgcccgtggcggggtcgcggccgacctcacgccggaactcccacgagccatccttgcggtggatgatgcttcccgcacccttcgtgcgtcgtctgccgttcgtcgccatgatgttcctcccttgtcgggagcgccttcgagcatccgctacaagcgccctcaaaaagggcactctattggcacactatccgggccacaaacggccagatacggggcataatcggccattcttcaataatcgaaaaacggcgcaattccacagttccgaaaactcgaaaacgttggaatcacgccgttttctggggtgttcacaccctacttggacacattgaacttgaactccacaatatctccgtcggccatgacgtagtcgcggccctcctgacggagcttgccttcctccttgatcttggccatggagccgtcggcggccacgaaatcgtcgtaggagacgatgtcggccttgatgaagcccttttcgaagtcggtgtgaatcacgccggcggcctgcggggcggtccaacccttgtggatctgccaggcgcgcacttccttgacgcctgcggtcaggaaggtctgcaggccgaggatgtcgaagcccacgcgggccagctggtcgagaccggactcgctcaagccagcgtcggccagcatttcgcgggcatccgcctcgtcgagctcggtcaggtctgcctcgaactgagcgttgaggaacacggccggagccggagccacggatgcggcgagcttagcctgcaggtccttgttggccagctcgttgtcgtccacgttgaacacgtagatgaacggcttggcggtcatcagatgcaggtcgtagacggaatccttgtcgaagcggccttcgcgtgcggccttgtcgagcgtctcgccggcttcaaggatggtctttgcctgcttgactgcgtccatgtaggccggctcgatcttcttgccgcgcagatccttctccagcttgggcagcgcgttttcgatggtctgcaggtcggcgaggatcagctcagtgttgatggtgtcgatgtcgtcggccggatccaccttgccgttgacgtggacgatgtcgtcgtcctcgaaggcgcgcacgacctcgcagatcgcgtccgcctcgcggatgttggccaggaacttgttgcccaagccttcgccttcggaggcgcccttgacgatgccggcgatgtccacgaaggtcaccgtggccggcacgatcttctccgtgttgaccagcttggccagcacaggcagacgatcatccggaagcggcacgataccggtgttcggctcgatggtggcgaacgggtagttttcggccagcacgttgttgcgggtcagtgcgttgaacatggtggacttgccgacgttgggcagtccgacgattccgatagtaagagacatgattccaagtctagggagaagctggacaccttgaacctgcatgtggtgaaccggccatatgcaaaggcctccgagcatacggctcgaaggctttgactgtgatatgcgaatatacgcgaactctgattggcagtcagccgacgatggcatcgacggcgtcgatgaccgagccgcggaaaccgtccttttcgagctgggcgacgcccttgatggtggtgccgccgggcgagcacacggcgtccttcatggccccgggatgggtttcggtggccatgtagagcgcgccgacaccttcgaccatcttggcggcgagccggtaggcggtggctcgctgcagaccgtactgcacgccggcgtcgcccaaggcctcgatgtacatgtcagtgaaggcgggcgcgcagccggccaccaccatggcgatgttcatatgcgcggtgtccacgcgctcgatgaggctgatcggcccgaacagctgctcgaaggtttcggtttcgtcgtcggtcagggtgttgacggattcggtgacgagcacgcccttgcccacagccatcggagtgttcggaatggtgcactggatatggatgtccgaagagtcaacggattcgccgtcttcggtggcgaacaggtcctggtacttcttgagattccagccggcggcgatggagacgacgatcttgcccggcttagcaagttcgtcggccagcggcttgacaacggcggcaatctggtagggcttgatggcgatgatgaccacgtcagcggccgtcaccacttccagcgcattgtgcagcgggcgcacgccaagttcggcggtggtcttctcaagcttgtcgtagtgggcagcacaagcgaccatctggccgccggtgaccacgcccgcgtcaacgaagccctgggcgatggcctgggccatgttgccatatccgataaaaccgatggtgaggttctgagtcatacgttttcctttcgtgcatgtatacagagctccctcatcagagggagctcgcttccttgagtcagaacagttcttcgaggtcgcctcggttgagggcttcggtgtagaggtgcttgaagacgagcgagccgtgcagaccgtcatgctcgaattcgttggtggtccagtagtggctgttacccacgcggctcaaggtgtcgagctgcataccggaatcgacatacatgtcgtcgaagtaaacggcggcctgcagcggcacctcattgcgggccagctgttcttcgtcatagatcacgccgaagtgcgtgtcttccatgagcaggtccatggccggcctgaacgggcgtaacgcagactcctgttcgaacatccacgggaacatggcctcgccggtgaagttgagcgggcgttcatcagcaccgaattcgggcttgccatcgcgcacgcgctgggcggcccagcgaatcggctgttccatctcaccgttggcgtagatgaactcctgcagcggccagtacagcgggcgcgacgaagtggcgttcatcaccttggtcaaaaattcgtcagacaacggcgagtcggcagaagcggaaccatcgccatcaaggaaggcgtcgtcaagaatccaatggacacgctcgaagctcggcttcatgccaaagtcggatcccaagcactggaagcgttcgacggtgagcgggtcgccgttcggcatcagcgggaagccgtgggcggccatgccggcgatcacgccaagtcgatgctccacatcggtaccagccatcggattcagtaccgaatcggtgagtttgccaatgaattcggcgacttccgcagtagtcggcagcttgtcggcgatggcggccacgcgctccttgtcctgtgggtagcgctcgtagaactgagtcgtcttgcgcaccatgcgcgggaaggtatgctcgtacacttcagcggcgtcggccggcacgtgcgggatgccgccggtggtgaagctggcgattacgccggccgggaacagggacagtgtggtcagggtcaggaagccgccgtagctttggcccatcgtcacccacttgcggccaccgaattcggtcaggcgcagatgttcgaagtcacgcacgatggaatcggcaaggaacttcttcagatagtcggcttgggctcgtgcgccggccgcggcatcatcgtcgtgcgcggcggcgatgcgggccatggcgtgcgtgtccacacgcgaggagcggccggtgccgcgctgatcgggcagaatcacgcggaaatgcttggttgcctcctcaatccagccatcagaagtcgggctgttgaggcgagggccggcaccgccgggaccgccttgcaggaagatcagcaggggcaggtcgtcatgcacgtgttcgggcgtggtgaccacgcgatagaacagtttgatggtttccccgtcgaacgcccgcccgggctcgtggccggtccagtcgagcggaacatcgatggaatggtcctctatggccagtccgggcacatagtatttgctcagcattgtcatggttcaagactctagtccataaatcctcctgaagagtgataccggttcgtcgccggacacgctagcattgtgcgttatggagatgatggcgcgcgtgagggcatggtgcgcacgggagtcgacccgcacactgctatgggacacgttgctcgccgcggtgctgatcgccggttgtgtgccgttcaacggcgtcaccaaccctgattcgacgggcggcatattgtttcccgcaactcaggcgtcgatgacgctgtggtcgctgccggtcttcgtgccgctgatgctgcgcaggtattgcccggagccggcggcctggctgttcgtggcgctgaccatcacgcatcttgtgttcggcccggcgatcacgtatttcgatttctacgccctgatcatggtgtattcggtgattctgtacggcagtccccgacattcctggcggttcatcgtcacggcgttcgtcatgggactgatcacggcgacggtctggtcggtgtctttcaacgtgggtccgctgtttgccgaaccttcctccggttcgcgcaccatccgcgacggctggctggccgatgccatcacgatgcccacatgcccggcggtcaccggcgtcgtgggggcaagcgccgccgtcaactgcggggccaagatgctcgctgacgtcggcatggaggcggcgctcatcgaatcgagcgtgctgagcattatcatcatggccttgtggcagcgtgcgcgcaaggccacgctcacggccatgcgcgaacgcaatgcttccatcgtggcccgggaagcagaggagacgcatatcgcggcgctggccgagcgtgcgcgcattgcccgcgatatgcatgatgtggtggcccatacgctctccacgattattgtgcagtcggatggcggccgatatgcgggcgcgcatgatcttgccgtcgccaggcatacgatgagcacgattcgccatgaagcggaacgcgcgcagcgtgatatgcagcgtctgttcaatgtgttcggtgcgagtggcagtaccggatatgccgacatcgattcgctgtttgatggccatctggtggtgtcccggcatatgaccggcaaagcgcaacctgaccggctgtccgccgacgcggaaaccgccgtgttccgtcttgtgcaggaagcgctgaccaatacgcgcaaacatgcgggcgagggtgctaaagccaccatcgatgaattctggtcaaacgatgtgctgtcgattaccgtatccgataacggccgtggcgcggcgtctgcagcagacggtcataagcccggatacggattggttggtatgcacgaacgcattgagtcgttgggcggcagcgtgcaggccggcccagggccgaatggtggctttattgtggaggctacgattccgctctcctctgccgccccacagtctggcaccgatgcggaggatccggtgctaaccattatctcgcgtatacgaggattgatgaatcgggcgcgccccaaagtactcgaccaaggagatacgcgtgagtcgaactgggtgggtcgatttgcgcagtggaccgagcggcactatcttctgatggacgttatcgccactatcgtgctgattgcgctatttgattccgccacgtatggcgatttgcaaatgatcggcaatgccccgtattcgccgaaccgcgtgctgactatagcgctgacgattattatgctttcgcctttggcgttccgccgccgcttcccagagggcagcgcactggtcatggcgattctgtccgccgtgcagctgctgtttctgccatccatcctgaccgtcaacatgttcgcattggtgtccgtgcatgccgccgtgctgtatggccgcgaacatgcgtggcgctgggtcagcgtggcactggttgcggattcgtggctggccggcatcaagataatgtccggctggaacggctatgggatgctgattcagatgctgctgcccttcaacggcgaatcggcgatgtcccgctggctgctggtgctttccggtctgatgccgggtggcgtggtgatgctgtttggctttgcctgcattgcgatggcccggtggagccgttcacgcggttcgaacgcgctggtgctcatgcaacgcgaggaagcgctcaaggccgagcaggatcggcagaaggtgctggccgccaatctggagcgcaatcgcatcggcacggccatgcaggccgaggtattgaatacgttggaatcggtgatcacgcaagccgatgatgggctggccatgctgaactccgaaccggctcccgatagcgagcagatcatcgccgcgttcacggtcatcggggaacgcgggcgtgcggctctggcgcacatgcggcaattgctgacggtgctgcgtgaaaccggattcagcgacgagatgcatgaaggcgcacaacccgacatgcaactgcgaccggctgctcctctgtccagccagatgaggcaggcggaatccacatctcagacggattcgtccacgaacatgaactcagggaacaatcagggtgtccatggagcggcgctccgataggaaacggatacagtggagagcatgaacgagagcagaagcattcgcgtgattattgcggacgaccaggagctggtgcgtgccggttttgccatggtcattggttcgcagccggatatggaggtggtcgggcaggcacccgacggcgcccaagccgtggcgttggcggaatccctgcatcccgacgtggtgctgatggatgtgcgcatgcccagcatggatggcattgaggccacgagccgtattacctcgctctccgccgcgccgggcgacgcggccgattcggccagtctggccgccgacgcgaccgtctcggccgaatcggctgacgaccggccgacgcgcgtaatcattctgacgacgttcgatttggacgagtatgtgatggcggccatcaatgccggcgcctcgggcttcctgctcaaggacaccgaaccggaaacgttgctcaattcgattcgtactgtattccaaggcaatgcgattatcgcgccttccgccacgaagcgactcatcgaaaagatgatgcaggacggttacgcgcagcatggttcgttgggtggagaaaccacacactccggtgccgtgtacggttccgccggcggcgtctctggcggtgcggccggcaacggtgctggctcgatgaccggcttcccctcccctgccggagccgcttccgacggttccaatacgtcacgcccggcatacaccgatcccgaactggatctgcttaccgaccgcgaacgcgaggtgctggtggagatcgcccatggtctgagcaatcaggagatcgcggacaagctcttcatttctctgcccaccgtcaaaacccatgtggcacatattctggccaaaatcaacgcccgcgaccgcgtacaagccgtagtcttcgcgtacgataacgggctggtgtaacaaagctccctctgatgagggagcttattgccctacgcctcggccaaagcctcgacgggtggcgtcttgacggctcggcgggcgggagccacgctggccagcagagcggcgagcgcggcgacgccgagcaccacaccgttggtagcccattcgaacgggaacacggtgtcgccgtacaaactaaacaccatgtaggatccgagccagccgaacagggtacccagtaccactcccaccacgccggagacgagcgaaagcagcaacgcttccaccgccagcgagcgccgcagttggccgcgcgtcatgccgatggcacgcaaggtggcggattcgcgtgtgcgttcgatcaccgacagactcagcgtgttcgccacaccgaccaaggcgatgagcacagccaccgcaatcaaaccgaccaacaatgccatcatgccgttgatcatggtctcccattgagtacgttcggccaccggaccggtcacggtaacacccgcactggcggagaacacattctgcacgttggtgaatacgtcgttcaacgcaacacccgcgccttcggcgtcaatgcgcataagcatgatatgcccgtcggccttgatcccaccgttggtgaagtggctggcgtccacgaaggcgaccgcggcgtagttggaggcgatgcggcgatagtccaccttccgcggtttgagcgtcagcgtctgtgtgccgccggattgttcattgccgttttcggcgctgccgttcgcatcattgccggacggaccattggcggcatcggcttgtgcttcggccgctccagccgtgaacgtaacgctcttgtccagcggaatatccttgcctgtagcggcggaatacttgggcatcagtacggaatcgccatcaatggtcacaccggacaaatcggagcgcaccaccttgcgcagcgcgtcgacgccatccacgcccacgaccagcacactcaggctcttgccgtcggcatccttcatggtcatcatgcgggtcggcgcgtagataccgcgctgaacgcccttgactttggctgcctcgctggcctgtttaccagtcatatcggtgccagcggcaatcatgtcgacgctgtagcgcgtggtcagcgcctcgttcatggtttgcttggcgctggcggcaccggtggcgatggtggagaccagcgtcacgccgataagcagtgcggcaccggtggcggccacgcggcgcgggttcttctgaatgttcgcatgtgccactttggcggacggaccggccagtgcaaccatcgcgcccacgccgcgcatgagcaccggtagccagaacgtggcggaaagcaccagtccaaggaagatcaatgcacatccgatgatggcggcgagcagcaccagcggatactgcttgtcggccattgaatcacgtccggcgatgttctcggacatctgccatacagagaatgcgcacagtgccacgccggccacaatcagcagcacggaaatcacggcgcggaccacaccggcccgtcgcgtgtcggtcagttcgatgggtcgcaacgcttccagcggggtgacggcggtagcggaacgcgcagagcctagcgaggcaatcaccgtcataatgatgccgaatgccataggcaccgtgaacaccggaccggatagcaccagtcgcatggtcatgccggtggctttcatcaggcccgactggcatagtgcggccatgagtccgatgcccaggcccactcccagtgcggaggcgatcagtcccagcacaccggcttcaaacagcacggagacatacagctggcttttgttcgcgccgatggtgcgcagcagggcgagtgtgcggcggcgctgtgccacgagcacttggaaggtgttggcgatgacgagtgccgcgaccagcatggcaagtatgccgaagctcagcaggaagatggtggtgatgctggtttcgcccgagctcatgcttttgacggattcctcgacgagcgcggcacgggattgcacgctgaaatgcttagggagcagtgtgctgacctgtttcacggtggatgccgcagccgtgtcactggcatcgtcgatatcgagatagacgaggtagacaggcaggttgccgaaatcgttgctgccggccatcgcggtaataacgttgtcggaaagcacggaagcgccaccgtagtaggcgtaggcaccgttcgggtcgtcggtaaggcctaccacgcgcacggtcatgccggagtcggcagtgttggcgccatcggatgagacggacgcaccggacgcggcatcggaatcaccgtcgtgcgagctcgtgccatcggcgttctgggccgactcatcaccagcgtcaccggtattaccggccgaatcgccggtcttgcccgcatactgcgccgcctgcgagttgacggtcacacggtcccctaccttgacgccaagctggtcggctacggacttggtcagggcaatctcgttgctgtccgccggctggtctccttgcgtgatggtgaccggcagcagcgtacgttttgcggcggtggtgatgacgtagctgctggcatgcttgttgccacgggttacggtcacggaacccgcgtagctggcgcgcgcgtccttgacgccttcggtggcgcggatgcggtcaagctggaagtcgttaaccgtgcgcgtgtagatgtagtcctgatccttatcggtcaggtccttgccgctatccgggctgatcacgtagttcgcgccgccgagctgggcggtgttctgagcggcaagcgcatcgttcatcgcgttgccgaacaggaaggtagcggcgatgaacgcagtgccgatcaggatggcgatgcctgccggaatcagcatcctggcgcttttcttcatgagtttcagagtgatggaaaacatgggggtgtcctgtctctcgctttccggctcagcgagcgtgctgggcggcggcgcgggcatggcgcatggtgccggttctcccagctgggggcaatggagcgtcggtgatgggcaggttgggcacatcctttacaccggcaagacgggcgagcgtgtcggcgcgtgtgctggtgacggcagtgcgcgtggcgcgttcgcgttcggccataagcagctcgttcatcgtttcggcagtgggattcgcctcgtcggccacgatctgtccgtcggcgaatacgatggcacggtcggcgtaggaggcggccaccgcatcgtgcgtgaccatgacgatggtttggccaagctcgttgaccgaacgcttcaggaagccaagcacttcggcgctggaaacggagtcgaggttgccggtcggctcgtcagcgaacaccagcttcggcttggtaatcagcgcgcgggcgatggccacgcgctgctgctggccaccggacagttcattcggtcggtggttcaggcgctgcttcagtcccagggtatcgacgagcaggtcgaaccaggcgtggtcgggcttgtctccggcgagagtcagtggcatgaggatgttctgttcggcggtgaacatgggcaacaggttgaagctttggaagatgaagccgatcttgtggcgacgtagcaaggtgagctgcttgtcgtccatgcgggtcaggtctgccccgccgaaaagaatatgcccggatgtggcggagtcgaggccggcgagcgtgtgcataagcgtggatttgccggagccggacgggcccatgatggcggtgaatttgccgcgttcgaaactcacgttcacgccgcgcagggcatggaccatattgctgccagcgccgtagttcttgaccaagtcgacggcctgaatagcgatgccgcgcgatgcggccgggttctgcacgttcataatgtctctccatatttggccgggccttatgcccggatgatgattccaacttatgaagaaataacggcgcgccccatcgtgcgccagactgaattgggcggtcggccacgcgccggccctcatccttgaggattatgtcgtctcaggtctcacactattcatgcctctgcgcaaacagtgtgaggcatacagacgcaagaaagcccgcactgcatgacatcagtgcgagctttctattccttgggtcaagcgatcaggcggaaggcaccccatgcggctcgatgattcgtgatgcaccccattagcatcgcgccccttctcatcgggccgtcaaccttcctgtcgacctcacttggccaagccggaagcgcgaagggcttcgaagccgcccttcaggtcatcgaggatgtcctcgatgttctcggtgccgatggacaggcggatggtgccttggtggatgccctgatcctcgagctcctccactgtctcctgggagtgcgtggtggaggccgggtgaatcacgaggctcttggcgtcggccacgttggccaacaggctgaacaggtgcaggttgtcgatgaacacgcgtgccgcgtccttgccgcccttgatgtcgaaggtgaagatggagccgccgccattcgggaagtacttcttgtacagctcgttgtccttgcggccttcgatggacgggtgggagatggactcgacttccggaacggtcttcaggtaatcgatgaccttcagcgcgttctggacgtggcgttcgacgcgcagggacagggtttcggtgccctgcagcagcaggaaggccgcgaacggggacagggtggcgccggtgtcgcgcagcaggatggcgcgcacgcgggtcacgaaggcggcgccgccgagggcctcatagaagttcaggccatggtaggacggatccggctcggtcagggtcgggaacttgcccggcacttcggcccagttgaacttgccgccttccacgatcacgccgccgagggtggtgccgtggccgccgatgaacttggtggcggattccacaacgacgtcggcgccgtgctccagcgggcggaacaggtacggggaggcgaaggtgttgtccacgatcaccggcaggtggtgcttgtgggcgatggcggtgatggcctcgaagtcgggcaggtcggcgttcgggttgccgaaggtctcgaagtagacgagcttggtgttctcctggatggcgtcctcgaactcctgcgggttctcggcggagacgaaggtggtggtgatgccgtcgcgcggcagggtgtggcgcagcaggttgaaggtgccgccgtacacgttcttggctgcgacgatgtggtcgccggactgggtgatgttgcgcaccgcgtattccacggcggccgcgccggacgcgacggccaggcccgcggtgccgccttcgagggccgcgatgcggtcttcgaacacgccctgggtggagttggtcagacggccgtagatgttgcccgggtccgccagtccgaagcgggcctcggcgtggtcgaagttgtggaagacgtaggaggtggtctggtagatcggcaccgcgcgggagtcggtggccgggtcggcctgctcctggccgacgtgcagctgcagggtttcaaaacggtacttcttgttgttctcggccatggtattctccttggttgtgctaggtcgcgaggatttttccttgccacccgcctgccgtgttcgggcggttggcgaggtgttggttatgaagttacgacgcttgggccgcgcggcgcaagctgaacgttatcggacttgcctataagggcttataaagccttggaatcattgacgtgagcgactgtcagaagtcacgaaaaagtcgttgaaattatcgcgacacgccgggccgcacgcatgcgctttcaaggtcgactgcggtcacggtgatatcgctgccatgcctttcgcgcatggctcaagtgtccgtgatgattgcttgttccacccgtcaccaagacggtttgcccgctcggtgatgacgtctgtttcatttttctgccgcccggttacatggtttacatgacgaacgactacagtcaaacatcgccaatgaattattccgccaacatggtgaagggattcgaacagacatgaccgatgtaactctgtatgaccgtgatccgaactatattccgcgcgtggccgccgtgcacgacatgtgcggctacggcaagtgctcgctgaccgccgcgattccgattctctcggccgccggctgcgatgtgtgcccggtgccgaccgccctgttctcggcgcacacacgctatgcagtgttcacgttccatgacaccacggatattctctccggttacttggatgcctggcagaaggaagacgtggagctggatggcgtgtattcaggcttcctcggctcccccgatcaggtggcgatcattcagcgtctctaccgcgaatatccgaacgcgctgcgtctggttgacccggtgatgggagacgccggcgaaatgtaccccacgtacacaccggagctgtgcgaggcaatgggcgcgctggccgatggtgccgacgtgttgatgccgaacctcaccgaagcgagcattctcaccaagcgtgactatcctggccaggatattgatgaggccacggttaacgagctgcttggtgctctgctggagttgggtgccaagaacgtggtgctgaagggcattgaccatggcgatggcaaaatcgtcaactatgtggccagcgcttccaccggtgttgccggcaagatcgagctggctcatgagaagttgccatacatgattcatggcacgggtgacgccttcgcctctgccctgtgcggcgcggtgatggccggccgcggcctggccgagtcggccgaaatcgccggtgagttcgtgcgtcacgccatggtcagcacccgtaaccagccgcatttcgaggatcgtggcgtcagtttcgaactgaaccttggcgaactcaccgatttggtgaagtgaccgcaccttggctcccctctccgctcactgggtctgacgtattcagcgaacaatccgatgggttgttttttcgtcacagggaagtcgactggtgagccttggtaaaccttctgaactaatggtggataaccgagttttcatccacacgttatccacaacacgccaaaccgcgtcatagtatccacatttgccggttgcgcttgtgctcttacataagtaacccgcacagtggaatcatgaacgctttaccacctactcagccgacgacgaagtccggcatcgacgccggtcttgcctttcaccagcccatgctggcttcacctgatccgcaggcaatgctgccttcggaacggattgcggccacgatgggcgaccgcaatctgacgcccaaacagttcggcgcgctcggcgagcagtatgccgccgcgtggctggaggaacacggttggacgaccttgagccgcaattggcatacccgttacggcgaattggacatcgtgatgctcaatcccgagtacacggtggtgttcgtcgaagtgaaatcacgccggtccatgcattacggatatccgcaagaggccattacgccggcgaaacagcacaatctcaggaaagccgcctgcgattggctacttgaccggcgtaatcgggtgccgcattcggcggtccgtttcgatgtcgtcaccatcgtgcttcgggtgggcaggccgctcgtgcatcacattgaaaatgccttctgaagcccccccaaaaaaaaacagccacgttgcgaaacacattgtgaaaggagtagacatggctatcggcagcaccctctcagtcggactgatcggccttaaggccttcatcgtccaagtgcaggctttcatcagccctggcttgccatacttcagcatcatcggattgccggatgcatcgttgtccgaagcccgcgagcgcgtgaaatcagcgtgtcaagccactggattcggttggccgcaaacccgtgtgaccgtgaacatgagccctgcggccatgcccaaacgcggttcgtcgcatgatctggccatcgcggccagcgtcctatgtgcggcgggtgccatagggcatgattgcctagaagataccattgtgctcggcgaagtgaatcttgacggctcggtgctgccgattcatgggctgctcccgatcatgctgcatgccgaggaacgtggcgtgcgcaaaatgattgttccccatcgcaatcttgacgaggcttcgatggtggatggactggatgtagtgggcgtgaggcatgtgggtgagctcatcgaactgatgggcggcgatgccacctatacgattcccgatacaccggttaccgacgagaccaccacggatcaatcgcccacaagtcatcccaacgattgtggcgatatgaacgaggttctgggtcaggagcatgccaaatgggcactgcaagtggcggcggcaggcgggcataatctcatcatgaccggcccgccaggcagcggcaaaaccatgttggcctcacgtatgcccggcatcatgtgcccgttgaacgaggcggaacagctggaggtggcatcgattcgatcgctgtgcggcatactgcctcagtacggcatcaccgacatgccgccgttcgaggcaccgcaccacaccgccagcacggcggccttggtgggtggtggcagcggcatcgccgttcccggcgcaatcacacgcgcgcatcgaggcattctgtttctggacgaggcaccggaattcagcgcacgcgccctgcagacgttgcgcgaaccattggaatccgggtatgtggcgctttcccgttcaaaaggcagcacctactacccggcctcattccaactcatcatggcggccaacccctgtccgtgcggatactattacggcaccggcgaacgttgcgcttgccgggaaaaagaccgtatacgttatttctcgcgattgtccggaccgatactggatcgtgtggatattcagatggcggtgccaccagtctcgcgcattgccgcgcaaagcgagccaatcggcgagtccagtgccgggatacaagctcgtgtgattcgtgcccgtcaagtggccaaagaccggttcagacagtatggatgggtgtgcaacgcgcaagcttcgggcaaatggctgcacgccaatacatcgctgaaagcgatggaattggtcaatcgggccctgtccaatcatcaactcacattgcgcggggctgatcgcgccatgcgtctgtcttggacgctcgccgatctggccggccgcgtatcccccactgaacaggacgtccatcagggcatcgaaatgagaacgaggatgacatgagtaacgctactgatatccggcaatctggcggcaccgcaggaagtgtggatcacaccgatacgagtctcgccgtttcgcgcactattcccgtacctcccacggatacgttgtatcgtgccgcgctcacgttctgtcttgatggcgcggatgtgatgatgtacgccacgctcaaaggcgcggaaaacgccgaatccctctggcatgcgttggcgcaatcccatccaagccagccatctgaaatctgcggcccggcgctgtcacgtattgaccgcatgttcgtggacggcctcactcgatggggccgcaaggcgtcggcgaacgcgatgcgctccttccgcaatgcactggcctgctggcataaccgcatgatggacctgccctcgcaagacatcatccaactggccgactggttcactatggatggcacgcaatggattatcggccctggccatccatgttggccctcgcagttggccgacctgtccattcgctccgattgggcgccaccgctgtgtttgtggatcaaaggcgatccacgcgcattgaccagttgcgccaaaccggtcggcatcgtcggttcacgggacgtgaccgaatatggccggtatgtggcacacaccgtagccgaacaggcagccgttgccgggcatctggtcgtgtccggaggcgcgatgggcacggatgcggcggcacattggggagcgttgaatgcgctgcacggcagaatgcccgccaatgtgggcaaaaccgttgccgtattcgccggcgggctcaaccatatcggaccgatgcgtaaccgcacgctgttcgaacgcatcgaggcgcagggtggtgcactgatcagtgaactgtgccccgggacgattcccgaagcccgtcgttttctgcttcgcaaccgcattatcgcggccatgtcttccacattgattgtgacgcaagcccggttgcgttccggagcgctcaacaccgcgggatgggcatgcgaattgctgcgcgaagtgtatgcggttcccggtgacatcaatcagccttgcaacgccgggtgcaataagatgatcggcgaccaccgagcgatgattctgtgtgccgccacatccaccgaggatatatgccatgaacggcataagcccgttatggcagcatgcccaggcatatcgaaatccacaggtcaggactcgtccgaaaacgaggaggccatggaagtgccggcaacgactccgttatcgccagcatcctcggaatcatcggcgtcacaggagtcgtcacaagattcaggtcattcgaaacgttcgaagaccaagcatactcagcctacgcgcactcaatccaaggatgggccggcgagcgcaactgccgattccggtaacgacaaaagcaagggtgaagagcttccctcgtcgcatcagatgccggatcttcgtgtcaagccgaagcccgatcccgagaaggaagcccaacaacgtatcattatcgccaagctgccggaaatggaacgcacattagtggcattgattcgtgaatgccgtaaacgacatctcatcgtcaccccggacgcactattgcgtgtggcgcgagagacggtacccgacgagattcccaatatcggcaccatacttgagctactcggcgcattggagctgaagggagtgatcgagcgggatgccggcatactcaagctgagcagccgtgtcggctaatcggcttccatgacacggctcgaaggctgttcggcgggtgtgcgagaatcgaacccatgagtccgaaacgtttggaagatatgtatgatgcggtgatcgtcggcgccggagcggccggcctgtcggcggcgttgggactgctgcgctcccccgagatcaccgagctcaaggaacaaggcgtggacccgaagatcctcgtggtctccaaactgcagccgctgcgttcgcacaccggttcagccgagggcggcatcgccgcgagcctgggcaatgtggagtccgatgactggcactggcattactacgacaccatcaagggcggcgactggctggtggaccaggatgcggccaaactgctcgccgaatacgcgccgcagaccgtgatcaacctggagcgtcagggcgtggccttctcccgtaccgaggacgggcatatcgcccagcgccggttcggcggccacacgcgcgagttcggcggcgccccggtcaagcgcgccgcctatgcggccgaccgcatcggccaccagattctgcacgccttgtggcagcagtgcgtggccgccggcgtcgagttcgccgaggaatggtatgtgaccgacctggtgctcgccgacgacggcaagcaggcggccggcatcgtggcctttgacacgcattcgggcaagattcaggccatccacgcgcgcaacgtgctgcttgccaccggtggcgcgggccgactgttccacaccacgtcaaattcctgggatctgaccggcgacggcatggccttgaccttggccgccggtctgcagctggaggacatcgaatttgtgcagttccaccccaccgggctcgcgcacaccggcatcctgctgtccgaggcggcccgcgccgagggcggcattctgaggaacgccgacggtgagccgtttatggaacgctacgctccggagcataaggatctggccgcacgagacgtggtctcccgctccatcatggcggagatcgacgccggtcgcggcgtcgccgacccgaaggacccggatggtccgaaggactgcgtctggctggatatgaccggcatcgaccccgaacgtatgaaggaagtgctgccgcaggtggtcgaaaccatcgagcagtacgcgaacctcgatccggccaaggacctagtacccatcaagcccactgcacactacacgatgggcggcatccccatcaccaccgacggcgaggtgtaccgttgggccgacggtgccgtgcaggtagtcgatggactgttcgccgctggcgaatgctcttgtgtctccgtacatggtgcgaatcgtctgggcggcaattctctgctcgacgcctgcctgttcggcacacgcgctggtcagacgatggccgcacgcatcgccgagaacccggttgactcccccatggccgatgattcggccgatgacatgctgaccgatgccgccgatcaggctgccgattctcgcaaagcggagcttgacgaactgctcgccgggccaatagatgattcagacgatggagtgcccaccgccaatccttatcagctcatggcccaactcggatcagtgatggagcaggctctggccgtacgttgcaccgctcagaccatcgatacggcgttgacccagatcaacggtgacatcacaccggttgccgataccttgcgggcccatgacaagaccgccgctttcaatcaggaggtcaccgccatctgggaagtccgtcatctgatcgaactggccgaggtcatgctgcacgcttccgaatcccgtcaggaatctcgcggatccatgcaacgccttgatttccccgaacgcgacgatgagcatttccttgctcactcgatggtcgccgatgatggttcggtaagtttcaagccggtgcacatcaccgactatccgcccaagaagcgcgagtactgatccgctggtggtaatacccaagccgcctagggcttgtggcacaataggttggctaatattggacttgacatcccactgtttcatggaggcagaacatggctgaggcgagcaacacgacggttaccctgcaagtgcatcgtttcacgccgcgacccgagcgtgccgaacgtgcacgcggtggcagcccgtttgccaagaaaggctccccgttcggcggcggctcggattcggcggcgcgccgtcgtccgcgcggcaagcagtgggtgcaggagtacacgattcccgcgcgcccttcggatactgtgttggattgtctgctgaccatcaaacgcaccgtcgacccgacgctggccttccgttattcgtgcggtcatggcatgtgcggttcggacgccgtggccatcaacggcacccccaccctgctgtgcacagccaccatccgcgattgggccaagcaacccggcgccatgcccgaagtcgatgacgaagggttccgacacaccggcaccgaggctgaggaatccgacgattccgcggaaaacgtcgcaaacgcggcggccgcccagaactcagccgcaaacggttcgctgggagtcatcgaactggcgtccctgcccggcttcccgccgcagcgcgacctcatcgccgacatcgaccctatgctcaaccagatcaggaagctcaccccgtatcttcaggcggacggcgtgctcgccaccaccgccgaaggcaaggtggacgtgttcgaatacctgcagaaccccgaacaactcgccaaatacgagctgctgagcaactgcatcgcctgcggcgtgtgcgaaggcgcctgcccggtgtacgccggcggcgacgccttcatcggcccggccgcgctgatttgggcctcccgtttcgtcaacgattcgcgcgacaccaaggccatggagcgtatggatgccatcgacaccgccgacggcgtggccgcctgccagtccgtgcgcgcctgctcccgccactgcccgcgcggcatcgatgtgggcgaggagatgtggcagatcgtggctaaggtccgcgagcgctaagccgcgccgcggctggctgcggcgatcgcctaagcacatgcgtcgatgcatccgctgggtgcccgcacgagagaagacatgaaagaacgaattatggacagaacgcagtacaccaacctcgccaaggcatgggaattcaccgaggaacacgcgcgcgaacgtgaatccgatgcgttgaccgacacccgtacggccgccgacgagtccggccagttgcagggttcggcggcgcaggcccgtctgctgggcatgctggtgcgcatcaccggcgccgcttcggtgattgccgtgggcaccggctcgctggtggagaccttgcagctcgcccatgcactggataacaagggcctgctgactgcggtcgattccaccgcccagggcatcgcgctgattcgcaaggcgttcgccgagctgcaggacgagaccgacaccacgttgcgtgcggtgaacgccccggccagcgtgtttctgccgcgcctcaacgccaatgattacgatctgatcgtggtggcgggcgacgccgagaactatgccgccacgttcgcccaggcctcccgtctgctgcgcgtgcacggcgtgatcgtgttcaccgatgtgctggcgttggaggacggtcagggcggcgtgatcaatccggccgaccgcagcgacaaggccatcgccatgcgtgagctgctcaccaccgtcgaagatgacgaaggtttcgagtccacgctcacccctgacggcaccggcctgctcatcgcctacaaaaagtaactctgtccttggctcccctcggagaggggagccactctatctcgcttacctcacaattgcgctgacggccacgtccacggcttcgtcggcgtcatcggttacggtgaccagtttcgggtcgatcgtcgagatcatgccatgctcggccaccggaccgttgagccagtcaaagagcccctgccagtattccttgccgtagagcaccaccggaatattcgccaccttgtgggtctgaaccaaggtcaataattcgaacatctcatccagtgtgccgaagcctcccgggcatacgatcacgccggaggaatacttgatgaacatggtttttcgcacaaagaagtaccggaagctcatgccgaggttcacccactggttcaacccctgctcgtgcggcaattcgatgccaagtcccaccgatttgccgccggccagtgccgctcccctattcgcggcttccatgatgccgggaccaccgccggtgatgacggcgatgttgcgcttggctatctggctacccatgcgccgtgctgccttgtagatcgattcggtgcgctgggtgcgtgcggagccgaaaatagagaccgcaggtccgagctcggcgagcgccccgaaaccgtccacgaattccgattggatgcgcagcacacgccatgggtccatgtgcagccagtcggtgtcctgatcgggtttcagcaggttggcggtggtgttgtccgagggaatcatctggccgcgtagaatcaccgggccgcgatgataggtatcgcccagcggcgaggcgtcctccagatcgaccgggttcaccggtgtggccgcagcctcagttgccgtctcagcctccaacgccgccgcatcattcgcggctgtggcttccaatggttccatatcgtccacgactgcggacttggatgcggcctcggctagattctttgcttcagcggcctttttgccgtcgttcttcttggatttcttctgcttctttgccatccaatgtcctcctgtacggcgctatcgactcttcgcattctagcgcctgaagctctgcgtacgttttccgcgaaatcatccttgacttcgtgaagaacgtacggtgagtgacactgagcgtacgttttccgcgaaataaggcctcatctcgtgaagaacgtacactgagcgcgtctcagcgtacggttttcacgaaacaaggccaacaatggagtagggaccgtctaagccatcagtggcggaagtcgatttccacactggcggtgccgtcggcgagggtgccggggtgttccgtgggcgtggtgggctctgtggtgtggcttggctgcccgatgccatcaccatcaatcgattcgtcatcctccgcatcagccgctgctgcggctgcggtcttctcgaatcgcttggactgacggctcagcagcacaccggaaatcgcggcggcgatcagggaggccaccagcacgccgaagcgcgcctcagcggaaagttccgcgttcttgtacgccagcgaagcgatgaggaaggacacagtgaagccaatgccgcaggcgacggcagcgggaatcatgtcgcgcacacgcagccccttggccatcttgagcccgcccacatgcgtggacagccatgcggtggtgatgatacccagaggtttgccgaccaccaaagccacaatcagtgcgatgaccagcggcgaggccaacaatagcgggctcatcgactcgaagtgtacgccggtggcgaacaaggcgaagatgggcagggccagcagtgcggagaatggctggagcttgttggcatagcgttcggcacgcggcgagagttcgccgtgcatttcacgagagggggtcagcaggccaaccagcacgccggccagtgtggggtgcacgcctgcctcgaacatcatgatccaagcgaggataccgacgatgccaaccgcgatccacggcacttttttcagtcgtacgaggtatgcccagatggcggcgcatacggcgatgccgatgaaccaataccaggcgttaatcgaggagaagaatacggcgatcagaataatggccagcaggtcgtcgacggtggcaagcgtcatcaggaacgcgcggatcgaaccgggcagggccttggcgaacagggcgagcacggccagcgagaacgcgatatccgtggcggtgggcactgcccagccgtgcgacatctccgagaacgggatgctgctgccggtggtggtcagaatcagcgtgccgggttcaccaggcccgatctgagagaacaatgccgtgacggccaggaacaggatgggcggggcgatcatgccgcccaccgcgcacagcatcggcacggcggccgctttcggattggcaagcgagccggtggtgagttcctgcttcagttcgaggcccacggtcaggaagaagatggtaagcagaccatcctgggcccagtggccaataggcaggtcgagattggtgtaggggatgaacagatgcgtttccgctacggtctcgaacgcatgcgcggtggcgggcagattcgcgagcaccaggccggtgagcgcgaagccaagcatgatgagtccggaaatacggtctgaggcggcgattcgcctgatggtggaccaaagtcccttcttcgcgccggcggtcgtggccatcgcgtctccttgctgcactctcttggatgaaccgtatgtaatagtacggaatatctcaggacgttctgctccgggctgagtcgcgaagggcaaccttaccccacccctgtgtggccgactcaaacgggccaatacaattggaaaagcctcggaagcatttcgctttcgaggcttactgtgcgccagacaggattcgaacctgcgacctgctgatccgtagtcagctgctctaatccgctgggctactggcgcataccactgttgtccccgtggttcgggagtgcgccagacaggattcgaacctgcgacctgctgatccgtagtcagctgctctaatccgctgggctactggcgcatgttgtctttcagacaactcgatatataatacacgccgttcagctgaatgcaactcggcgtgttgcggcgagtcgcaccatcccgaccactaccgcaacggcgtatttactggcctcacgcctcgtgtgtacggactcggtcaagcaaaaccgactgcgcaactttgagacgtccctgcggcacatccacggcttcgcgcaggagtttgggcgtgctggaaccctctacggacgccttgtccacaatcacctgcctcacatcatccaaactcggcaactggaacatcgtgtcctgcaacgtacgttcgataatcgaacgcaaaccgcgtgcgccggtcccctgcttgatagcgatatcagcaatcgcccgaatggcctgttctgtgaattgcagatcgacgccgtcgacggcgaacagtttacggtactgcttgatcagcgcgttggctggctgggtgagaatcgccgtcagatcgtctacggtaagttccttcagcacactggtgaccggcaaacgtccgatgaactcaggcaacagtccgaactcggccagatcatcggcattgacctgttcgagcaattcctcgtctttcatgtcggcgtcgtgccaattcgcgccgaagccggtctctcgacggcctaatcgcttgcgaacaatgtccgtcagccccacgaacgcaccgccgcagatgaataggatgccgcgcgtgtccatctgcgcaacgtcctgctccttatgcttgcgcgtgccttccaacggcacggaggcgatggttccttccaagatcttcagcaacgcctgctgaacgccctcaccggacacgtcacgggtgatggaggtgttctcaccggatttgcgggcgatcttatcgatttcgtcaatgtagatgatgccgtgctgggctcggcttacgtcgccatccgcagcttggaggagacgttggagcacggtttccacatcgtcgcctacatagccggcttcggtcagggtggtggcgtcggtgatgacgaacggcacgttcattacgcgggccaacgcctgcgcaagataggttttgcccacgccggtggggccgagcaacagaatgtttgacttggcgacctcgacgtcagccaaagggtcattgctgcggcgggcagcacgcgtctgggtgggaacggattgcttggcttgtttgccggtctggccactgtgcccgttattcccgtcaagctgctcagcggactcctgaagctccatgttgacgcgcttgtaatggttgtatacggctacggataatgcgcgcttggcgttctcctgaccgatgacgtagcggttgagataatcgaagatctgagcgggcttgggcaggctcagcgaattgacctcggcatctttgacacgctcctcggagatgatgtccacgcacagggcgatgcattcatcgcagatggaggcattgggaccggccaccagttttcgtacctgatgttcggttttgccgcagaacgtgcaacggggtacgtcctcgttgtagctcaccacacgtcccatgattctcctttgccgactgcgccgcaccgtcgaaccgccacgctgcgcattatcattgtcatccttgaaatacaatacccccggtcgttgccgaccgagggtattgcaatgtccggaagttttactggcggtgttccaacacctcgtccacgatgccgtattccttggcttcaggagcggtcaggaaagtgtccacttcgatgtcgcggcgaatcttctcgacgtcctggccggtgtgcttggcgagggtctcctccagccattcacgcatacgcagcatttccttggcctgaatctcgatctccgtggccttgccgaagccttggtcgatggccggctggtggatgagcacacgggcgttcggcagcatcaggcgcttgcccttggtgccggaggccagcagaatggcggcggcggaggcggcctggccgaggcacacggtctgcacgtcgggcttgatgtactgcatggtgtcgtagatggcggtcatggccgtcatcgaaccgccgggtgagttgatgtacatcatcacgtcacggttcggatcttgggattcgaggaccagcagctgggccatcacgtcgtcggcggaggcgtcgtccacctgcacgccgaggaagatgatgcgatcctcgaacaggcgggagtaggcgtcctgggtcttcatgccatacggggtcttctccacgaactgcggcatgatgtaacggttggtcggcgcgggctgggctgcgcgggcggaggccggcatgaaaccggctacgccctgacggccggccaagcggtcggcacgggcggcgaactttgcttcttcacttgccatgagtctcactccccctgctggttgttgccgatggtgtccggcgtggtcacgagcttgtccacgaagccatagtcgagggcttcctgggcggtgaaccagtggtcgtattcgttgtcgcggtagatttcctcgagggtgtggccggtctgctcagcggtcagctcgctcatggtcttcttcatgtccatgatgagctcggcgttgatgcgcacgtcagtggcggtgccgccgatgccgccggaaggctggtgcatgagcacacgggcgtgcgaggtcaggtaacgcttgcccttggtaccggagctcagcaggaactggcccatggaagcacacatgcccaggcccacggtcgccacgtcaggctcgatgagctgcatggtgtcgtagatggccatgccggcggtgatggagccgcccggcgagttgatgtacagccagatgtccttcttcgggtcttcggcggccagcatcagcagctgagcgcagatgcggttggccatatcgtccttgacctcttcacccatccagatgatgcggtctttgagcagacggttgaaaatcgggtcgacggggccggccgggacgtcatcgcccgccatgaccggcaaggtcgcaaaggtattgctcaccttgattctccttctaattactcgaacattgttcagactaccgccttgaagcgactgaaggcggcttttcgcgtgctttttggcgggcagcgtagggatttcggtttattcgagggtgtcgaggacgtcgtcaatgaggaggcgggtctgggaggcggcatcgtcgcccagacgcgggaagcgacgggcggcattggcggggctggcaccggcggctcgcgctacgttggacttgctggcaccatgggccacggctttttccgcgagccgatcgaccagtgaatcggcgacttggcgcatctgttcggccacccataattgggccatatccgcaggtaagtcgtagtcttcggccacatcgctggctgcctcctgaatggcggcccataacaccatgaatggctttcgatagtagtcaatctgctcagtgagcggctcagcggcaagcaattcaagtgccgagcgaatttctgtattttctgacatagctttctttacctcggctcccctctctgaggggagctgtcgccataggcggctgaggggagtttcgaccggggcagctcccctcagagaggggagccagaatatatgtatttacttacgactcagcaaccactttgatatcaacgacgacgtggccacggccatgccgaccggcacaaagaaggtaatcggcgcttcagagagctccatcaccaagcacatggccataagcggtgcctgttgtgaggccgaaagcaacgaagccgcaccgatcaaggcacacgcggttaccgaatcggtcggaaacatcagtatccatacgagaccgagcatcgcacccagcgtggaacctaatgcgatgccgggctgcagcacaccgcccgacgcaccggagcgaatggtcatcagcgtcaccagcgctttggcaacaaaggtgagtgccaacacacccagcaacatccagatattggactgggacagcgggaaaccggcgttcatcacggatccagaagggccgctcccaccctgaagcatggcccagaacgatgccattccagagcccgctcccccgccagaggccgaatcggatacattaccgccgcccgtcagcaagttccatggagaggcggccgctgaagatgccgactgcatggcaccagcagtgccggcggtttcaggaatgaatgtgctgaatccaagttgcgctgcggcacggccgttgcccatcacctgcggcacaacaatcgccaccaaaccggtgatgagaccagccagcgtcatctgccacagaatagccttaccggttggcttgtgcgcttccgcccattgcgaaccttttcggaacaatgcgccgcccactccacatgccgcaccgcagatcagagcgaacaccattaacgttggcgtggattccggttgcatggcggtaatgtcgtagaacaggtgatgccctttgatcgcaaccgccacgaatgcggcaatggcagacatgcccagtccaaacgcaactttttcgattgtcacatctaccaacaggatttcgacggcgaagaacatgccggccagtggcgcgtcatagacgcctcctagaccagcaccggcagccactgccaccaccatgcgccggtcgatgccgtcaacgccctcgatatggaacaggtcgcagaaacgttgcgcgagcatggcgccgagttcgcgtggggcgacttctcggccgatcgaggcaccagagccgacgatgaaaatctgcaataccacatgcgcaatggtttgccagaaaggcattcgctttcctgccacggccttcttgactgagggcaccgcagtcgttttgtgtcgcatcagataccagataatgcctgcgatgctgagtcccacggtcaccgatatcgcacggcgtgcagcgggcacgccgaatggaccaggcaattctgggccttcgatgtagccgagcagcacatgttcaacgccgtagagcaacagggtcagcagacctgctcccacaccgatgagcacgccgagcacaatggtcgccgcagcgagccaaccaaggcgtttgatagtaaccgttggctgcatgtcaacctccgcaccctatgcaacgagtatgccttgggaactcccctcagtctcgctacgctcgacagctccccctcaaagaggggagccaaagaaacagtccttttgccagaataggaagagcccggaaccatgaaacacgattccgggctcaaacaatcatgctaacgcgatgaggctatgctcactcagcatccttggcgtcatccttggcggacagttcgtcggccacggcggcagcagcggaagcggcctcgacggactcggactcttcgtcctcagcggcctcgcccaggaaggcggagaggtccacaacctcgccatcagcggtgaacttgacggcgcgcatgccggcgagcaggcccttggaacggccgacttcctgcacagcggagccaagctggccattcttgatgatggcctggatgaagttgttcggatccatgccgtactgctgggcgatggaagcgaggaagttgaacacgtcggactgggacacctgaacgtccagcttctcggccagagcgtcgagcaccatctgatcgcgcagatccttctccacggtctcctcggcctgagccttctgctccttggtggccttctccgggtccggggtcatgcccttgagctgctcttcgaccatgttggccttgacgcccttcggcaccgggatctcgaggccttcctgcagcttggcgatgaaggcatcgcgagcctcggtggcctgacgaccttcggcgtcctgagcggcagccttgcggatgtcagccttgagctcgtccagagtgtcgaactcggaagcttcggaagcgaactcatcgttcagctccggcagttcctcagccttgacggagttgaccttgaccttcacggtggccttctggccctcgtgctcgccggcttccagcgtgccttcgaaggtggtctcctcgccggcggacaggccgtcaagggcctcgtccagaccgtcgagcatggtgttggagccgagctcgtagctcacgccttcctgggagtcgacggtctcgccgtcaatctcagcagtcaggtcgatgttggcgaagtcgcccttggcggccgggcggtccacgccgaccaaggtgccgaagcgctgacgcagggtctcgaggcgcttgtcgacgtcctcatccttgacttccggcttggagatggcgatctcaagaccgtcgatttccggcagttcgatgtcaggacgacgctcgacggtggcggtgaacttcagcttggtctcgtcgttggcggactgcggaacatcctgcacgtcgaactccggctgagccatcggacgaatcttcttctcatccagggccttggagtacagctccgggaccgcgtcgttcacggcctcaccggcgacggcggcgaaaccgatgcgctggtcgatgatcttgccgggaacgtggcccttacggaagccgggaacgttcacctgcttggcgatttccttacgggccgcatccagatacgggttgagctcttccggttcaacagtgacggtgagcttcaccttggtgggctcgaggttacgaacgctgatcttcacgctaatgactcctcaaaagtcgttatttcttacagttctgccgtaaggcaacctctacatgataacgccacttacggacggtgcaatgagtttcacttgccagttccttgcgccctgctcgatcaggaacgtctcgacgtccacttccaccgggtcttccacccagcacaggttgcgtaggatctgtggcttgatgatcatctcggccggcgtgcgggtgtcttcggcgatgcggttgatcacacgccgcacccgttgcagacggtcataacgctccggatggcgctgttgccacagccgcatggatcggggcgcgttcaccacaccgttttcgtcctgttcgggggcgggcatggtaggccattgggtgggcttcagggctatggctcgatcgatggcctgcttccagaccttcggtttgaccgcacgctgaatcggcgcgtaccgctcgaacattttgtcctgctcggtgccggtatggatgcgcacacgctcgttcagggatcggagcgcgcggaattgggcagcattgtgcggcttgttggtcgccgcctcgatgattgatgaatcggccaataacaggctgggcgcaatatcgtattgccgggcgagtcggtcgcgctcctcccatagggatttggcgatggccaagccccttggatcacgactcagctgggtgatgcgcgagatacgcagccaaggaatcggatgcggtttgcgcggggcaaggcccgcaaccaaagcgtgagaaaactcttcagcggcccactcgtccttgcctgcggctttcaggtcacgacgcatcatggtttcaagttcgataagcacctccacgtcgagcgccgcatagttgcgccagtcgcgcggcagcggacggtaggaccaatcggcggcggaatgctctttggctagcgtgatgccgaggtagtgttcggtgacggcggccagaccaaagcggtgcaggccgagcaatcgcgccgctatttccgtgtcgaacagggctttgggtttgagcccgatttcggcgaatccgggcaagtccatcagagaatcatgcagaatccacgtggcgtcgcccacggcgtcattgaattcattccaatcagctccggcccgggtcagggcgacgggatcaagcaaggcgatgcctgcaccctcacgtttgaactgaatcagccaatcctcgtgtccatagcggaagccggacgcccgttcggcgtcggcggccagcgagcccgtcgcctcggccatcgcatcgcagacacgatgatagccgtccagcgtcgaagtgacatcgggtactcccccgcgaggctctttcagcagtcggggttcggtgtcacggacgtcactcaactggcgtcatcctcctcaaaacggatggtggatctgatgaatgcggcccacgagcggacttgtgcgccggcgtccatagtaccgtccggcccggtcccgtcaagcggggtccatgagacgcgaatctcacacccggcgctggtggagccggccatcgagccaaaagccgtgttttgggtcacggtgactgtgccggataccgaatccggctcgatgccgtcgaaatagtcgcacatgtcatcccagtacatgccgggggtcagagaatcgttttcggcggtttccagcggcagtcgcgcgaacgccacgcaacgccagttggaatcccagtcaatgcgcagctcatgagcataaagcatcatgatccaccctgtggcgattcgtgattcggcatcgctgccaagaccggcggaaaaggcatcgccgagggcacgctctcccgcttcgaattccacgccgataccataatcggccaaggtggaaggcacgggaatctcccgatagcgcacgtcatggatgcgcttcatggtgctgacggattcgacggctgcccatacttcatccggcacaccctgagggcgcacggggcgtccgtcgttggactctcccgtaggaaatgcgtagatgtcggccatatctctagggtatgggcgaacgggccgaatcgtggtatttacgcgcggttcggccctgcaatttaatacacggtgaagccgtggtccttgaactggttggtcacccgttcgcgggtggcggcgttgggtcccttctggttctccagcgggtatgggatgcgcagttcgtgccacttcgggcggccaagctggtggaatcccagcacgtcgatgtgttcgacggcatcaccgaaggactcgcagatcttcgccacgttttcgacgttctcttcggagtcggtcaggcccggcacgagcacaaatcgcacccagatcttcttgccggccttggccagtcgctggccaaaatcgatggtgggctgcaaggtgccgccggtgaccttgtgataggtctcctcgtcgccggatttgacgtcgagcagacacaggtcgatgtcctcgagcatctcgtcggtgtaattcgtgttgaggaagccggacgtatcgaggcaggtgtgcacgcccatctccttggcggcatggaacacacgcgagacgaaggcgggctgcatcatggattcgccgccggagaaggtgataccgccatgcgtggccttgaacaggtccttgtaacgatcgaccttcttgatcatggcgtcaaggtagacgggcttgccgtcgcgcatcttccaagtgtccgggttctggcagtactggcagcgcagcgggcagccggacatgaacacggtcatgcgggtgcccggtccatccacggaggtgttgatgtcccaagagtggacgaagccgatatcaccggatttcagggcggaaaggcggtcacgtcggtcgagtccgattggggattcaaagccggaaaggccacccatcaaagtctgcgaggcataggtcttcgattccttgagcatatgcctggtcgtggtgcggaacgtgggtgttgcgggcatcgttgtcctcctgttccaaatgatgcgaaagtctgtgggaaataaggaaggggtggagccgtgccccaccccttcagttagtcattgccgcggttcgcggggttggtcatcagtcgacgacggcaccctggtggaaggtacgggagatgacgtcgagctgctgctccttggtgagcttgacgaagttcaccgcgtagccggagacacgcacggtcaggtgcgggtacttttcggggtgctcgacggcgtcctccatggtctccttgcgcagaacgttgatgttcgcgtggtagaggccgtggccgttgccggcgtccaggatgccgaccaggttgccgatgcgctcgtcctcgtcgcggcccaggccatcaggggtgatggtgttggtcagcgagatgccgtcaagagcgtcgttgtagtcgatcttgccgacggagaacatggacggcagcatgccgtgggagtccatgccgttctccgggttggcgcccggagcgtacggggtgcccttggcgtggccggacgggaaggaaccggtgttcttgccgtactcgacgttggaggtgatcgtcaggatggactgggtcgggacggcgccgcggtataccgggagcctcttgacctggcccatgaccgtggagacgacccacttggcgatgtcgtcggcgcggtcgtcgtcgttgccgtagaccgggaactcgccctcggtgcggtagccgacgatcaggtcgtcgtcggcgccctcaacgtactcgtactcgtggccttccagggtcttcgcgtccttgttgtagatcgggtagaccttggcgtacttgacggcggcgagggagtcggcggcgatggacagaccggacatgccgcagccgagggtgcggtacacttccttgtcgtgcagggccatctcgatggactcgtacgcgtacttatcgtgcatgtagtggatgatgttcagggccatgacgtaggtctcggacagccattcgagggccttctcgtagttgttcttgaccttctcgtaatcgagggtgccgtcggcctccggggtaatcggctcgatcacgcccttgtcgatgacctgcatgccggtcatctcgtcgcggccgccgttgatggcgtacagcagggccttggcggagttcacgcgggcggcgaagaactgcatctgcttgcccacgcgcatcggggagacgcagcatgcgatggcagcgtcgtcgccccagtggctacgaatttccttgtcggactcgtactggatggccgaggtgtcgatggagatcttggcgcagaagcgcttgtaggcctcaggcagcttcggatcccagaagatggtgatgttcggctcggggccaggtccgaggtgctcgagggtcagggtgttgagcagacggaacgaggtcttggtgaccatcgaacggccgtcatcgccgaagccggcgtcggaccaggtcgcccagtacgggtcgccggagaagatcgaatcgtagtccttggtacgcaggaagcgcacgatgcgcagcttcatgacgatgttgtcgatgagctcctgggcgtcggtctcggtgatcttgccggcctggaggtcgcgctcgatgtagcagtcgaggaaggcggagttgcggccgaaggacatggcggcgccgtcctgggacttgatggaggccaggtagcccatgtaggtccactgcacggcttcctgcgcggtctgggccgggcgggacaggtcgaggccgtactcgttgccgaggttgatgagcttcttcagagccttgatctgctcgtcgtgctcctcacggaagcggatccagtgctcgatctccggctcggtgaagtcgttgcggtacggcacggagtccttgtcgcgcttcttgaaggcgatgagcttgttcacgccgtacagggcgacgcggcggtagtcgccgatgatgcggccacggccgtaggcgtccggcagaccggtgaggatcttgttgtggcgggcgaccttgatctgcttggtgtacacgccgaagacgccgtcgttgtgggtcttgcggtacttggtgaagatcttcttgatctccggatccggttccttgccggcttccttgatggcctgctcgaccatgcgccagccaccgttcggcatcatcgcgcgcttgcagggaacgtcggtctggaggccaacgaccacgttatcgacttccggggagtcgatgtagccggccgggaaggcgtcgacgtcggccggggtatgggtgtccacgtcgtagacgcgctgcttgcgctccacggccaggtagttgtcgtcgaggtacttccacaggtgcttggtcttctcggtggcaggagccaggaatgtctcgtcgccctcgtacggggtgtagttcttctggatgaagtcgcggacgtcaatatccttctgccagttgccctcggtgaagccggcccacgccttggcgtcgagctcctcctgggagacagctgcattttccactgcggtcatgtcactccttaaatggggttgtaggtttcgcatcttcacggaacccttggttcaacagtgtagttggcacttgcttgagaaaagctgaaattgggagtgagctatctcacattgtttctgtgaacgctaccattccaatggcttctagatattgatgggactattgcacgtctccagatatgggaaaccgctcatactgtgatgttcgtatgagcggttcggtcttgagattgacagcagaaccgtatccgtcagttttcgaccgtcaatcctcggggcgagcctgtgcgggtttcacgccgtagttcttccagcgccggttctcctcctcccatctggcgttgcggtccaccacgatgtcccaggcgtgttcggcatcttccttggtcttgtacgggcccatgcgctgttcgatcggtgagaccatgcccagctcggcctgcttcttgacggtgttgaaataccactgcttcttgttatcgtctgtcattggtacctcctcaacggtattacttgctcccgctggcgggagcaatatatgtttattccctgaatgcgttggtgacgggcagtcggcggtcgcggccgaacgcgagggccgtgaccttcggtcccagcgggtattggcggcgcttccattcggcgcggtccaccaatcgcatcacggtgtctacggtgacctggtcgaagccgtcggctaacaggtcggcgcggccgtgcgcgtgctcgatgtatgcggcgagcaccttgtcgagcagcgcgtattcgggcagggagtcggagtccttctgcccggggcgcaactcggccgagggtgccttctcgatggaggagaccggaatcatcacgccgtccttcaacgggatgccggtgttgccgtcctcgttgcccacgatcttgagaccgccgatgccgacgcctgcggccgcggccttgttacgccaacggctgatctcccagacacgggtcttgagcaggtccttgatgggtgcgtagccgcctaccgcatcgccgtagatggtcgagtagccgcaggcgagctctgacttgttgccggtggccacggcgagcagaccgcgcgaattggagctggccatcacgatcacaccgcggatgcgggcctgcaggttctcggcggagacgccatcaaggtcaagttgctgttggtaggcgttgaacaatggctcaatgggctggacctcgtaatgggcgccaatgttggaggccaaatcggcggcgtcgtctttggaaccgtcggaggagtacatggagggcatggagatgccccagacgttctcgccgccgcatgcgtcggccgccatggcggctaccagtgcggagtcgatgcctcctgagaggcccagcgtcacgccggtgaagtggttcttggccatgtagtccttgaggccgagcacgcaggcggtgtatacctcttcgtccgggtcgagttccggaacgatctcggccttggcctgatgttcggcggcggaatcgaagtcccagaacgtcaggttttccatgaacatcgggccgcgttcgataagcgtgccgtcggcatcgaccacgaagctgccaccgtcgaagaccaggtcgtcctgaccgccgacctgattcaggtagatgaccggggcgttgacttcggcggcacgacgctgggcgagctcgaaacgggtgttggtcttgccttcctcatacggcgagccgttgatggtgagcagcaggtcgatgttcttggtggccaggtcggccaccgggccgccgtcctgccagatgtcctcgcagatggccacgccaatggtggcgccgtccacgtcgagggtcacggagcggtcgccggcggagaagatgcggaattcgtcgaacacgccgtagttgggcaggaagtgcttgtcgtagccagcccagaccacgccttggtgcaagaccaccagtcggttgcgcggcttggaggtcttgcggtcggtgcccacggtgccgaccaccacgaacagatcgccgaggccgtcgtcgttgagctgggtggcgagttcgttggccttgtcccatgcggcttggcggaaggtgcggcgcagggccagatcctcgatggggtatccggtgagggtcatttccgggaaaacaaccacttgggcgtttcctgcggcggctttacgggagtagtcgagcaccttggcggcgttggcgtcaagcgcgccgacgcaggtgtcgatctgggcgagtgcgaagcgaagctgtgtcatagattcttagtgtagccgcgtatgacgtcggattgcctgttcttccggcttggcgtcattcattaggtcgtttttgcgttcattaggtcactgcaatgcgatatcagtcgttgcaatggcgcgattccaacaaccagtatcgccgttcaccgacctaatggacgatgaatcgacctaatgaacgaatgccactcccctcagtcagcttcgctgatagctcgtcctgcacttatggacgggcgaggcccgcgcatatctggttcggctgtcgcctcaccttcggctacagacagcccactgggctgtctgcctaacgcctcagcctccggaggtgagccagaaaaggatttacttcagctcgttgagcacgcgcagagcggtgttgacgtagaagttgacgaaggtgggaatggattcgtcgagacccacgaaatgcgggctatgccagtcggcgcaaccttcctggccgtttgacccgacgaacgcgaacaccggcaacgtcaccttggcgaattcgcagaagtcctcccccgccatcgactgacgtatcggttcgagctgcgcgtagtcgttgacatccgccgccacggccttggcgagacctggatcggagaccagcgggtcttgaaagtcatcccagaccacgtcggcgctgatgccgtatgcctcggcggtgtgttccaccacttccttgaatcggcggccgaccagattgccatccgacttgtggaaatagcgcacagtcccttggaatccggcttcggcgggcaccacgttccacacatgtccgccgtgcacttcggtaacggacagcaccagcgggtggaagggcgtgacgttgcggctcacgatggtctgcaggctcagaataatactggcgagcgcttcgatgggcccggtgcccttgtacgggtaaccggcgtgggtgccttgggcgtggagggtcacgcggaatttcacgcagccggccatcatcggctcaacgccgatggccagctggccgggcgcatagttggggttgttgtgcgtgccgataatggcttcgacgtcatccacgagtccggcgtcgatcatggcgcgagcgccttggccggtctcctcactcggctggaacagaatcttgatcgagccggcgaacttgtcacggtgctcggcgagccagaaggcggcaccgagcagaccggtcatgtgcaggtcgtggccgcagccgtgcatcacgccttcattgacggagctgaactccagtccggagtcttccacgatgggcaggccgtcgatgtcagcgcgcagcccgatacgcggcccgggaccggcctcgccctgaatgagccccacaacaccagtctccagcgggttgtgcaggatctcgatgccgtgcgccttgagctggtcggtcagatagatgctggtgccgaattcacggaaactacgctccggatgggcgtgcaggtagtggcggatagtgatgagttcgtggtcgatgtcgatatgttcactcatggttcccgattctagtagcgcgaagaatatattgcggccctcgctccatattggcgagggccgcgatctatggggtcagtatgccttgttattgctggcgtttgagcagtcgtttggcgatggcgttggcgatgccctgcaccacctggaccagtacgatcatgatgatcacggccgtccaggtgacggtctggtcgaacttctggtagccgtaggcgatggcgaagttaccgagaccgccaccgccgatgtagccggccatggcagacatgtcgagcacgccaatgaacaggaaggcgtaggccaggatcagcggtgccagggcttcggggatgagcacggtgcggatgatggtgagcttgccggcacccatcgaacgcgcggcctcgattactcccgggtcgaccggcacgagattctgttcgaccagacgcgaggtggcgaaggtgcacatcaccaccatcgggaagatggcggccacggtgccgatggacgtgccgaccacgacgatggtgagcggctgcatggctgccaggaagatgatgaacggaatcgggcgcacgatgttgacgatgatgtcaaggatgcggtagacgaccgcgttctcgaacaggttgccggggcgggtgccatagagcaccacgccgaggatcaggccgaggaatccgccgatgacgagggtgacgagcaccatggtcagggtctggccaatggattcgaacagtagtggacgcagcacgttccagtcgctatgcgggttggcgaggatgatcatgcgttggctccttcatgtgcggcggcggacgcggcgggcgcggtggcagtatcggccgccagtgggtcatgggcgcggtcttcggcgtaggaggcatgtccggcgactgcgtcggcgtaggccacaggctttgcggcggtgccgaagtcgatgacgtcgctattggcggcgagctcgcgcaggaattcgtccacatgccagccgggcccgttgaattcgtaggtgatggcaccgatggcggtccccttgaccgtgtcgatgccgccgtagagcaggctggattcgacgccgtatttggcgatgagttcggagatattctgtccggatgccttgagttcatggccttgggtgccggaaacgtccttttggcggataagcacggtgacaatgcggcccgaccattcgtgatgcaatcgctcgacccggtcttcctcgggcaggccagacaatgcggtggcaatgaatcgcttggtcaccggctgctggggtgcagcgaacacatcgtatacgtcgccggattcgaccacgcgtccggcgctcattacggccacgcggccggcaatctgctggaccacgttcatctgatgggtgataagcacaatggtgatgccgaattcctcgttcacacgcttgagcaaggccagcacttcggtggtggtttccgggtcgagcgcgctggtggcttcgtcggcgagcagaatctccggattagtggccagtgcgcgggcgatgccgacgcgctgcttctggccgccggacagctgcgaagggtatttgtttgcgtgctcactgaggcccacgaattcaaggagttcgttgacacgacgatcctgatagtccttgcgccagtgatcgagttgcagtgggtaggcgatgttctgggccacggttttggtggagaacaggttgaactgctggaaaatcatgccgattttctggcggatgggccgcagcttggtctcactcagagaggtgatatcagtaccaagcacggtcacagtgccggaggtgggtcgttcgagcgcgttgataagccggaccagtgtggatttgcctgcaccggaatagccgatgatgccgaagatgtcaccgcgatcgatggtcaggctgacgtcatccacggctcgtgcgatgttcgcgccgcgtccgcgtgttttgaattccttcacgacatggtcgaaggtgatgatggggtcgctcatagtgctccctgatgctggttgttggtgtccggtcacggaagcggagcgaatcccgattgttggctcgggtactcgctccgcttggtggtaatggctatggacaggctagtcgtgcgctcgtatcagccgcggctcactgctgggccttggcatccttctcaatgtcggacaggaagccttgcagctcgctggcgctgaacttgtcggcgaacaccgcggtaccgccggagttctcctgcagggcgtcgagcacatccttctgctggtagatggaaacgagcttcttgtaggtctcgttgttcacgtccgccttgcgggccacccacacgttgatgtaggggcgagcctcttcggattcggcgtcatcctggtagatggcgtccttcgggtcgagaccggcatcggccacgtagtcgttgttgatcacaccagcggcgatggtcgggtccttcagggtggtggccacctgttcggccttgagcggggtgaccttgaccttgctcttggcttcgtcgatgtaggccggggtggagaaggcggtccagtcgcccttgagcgtcacgagaccggcggccttgagcacgccgatagcgcgggcctggttggtttcgtcgttcggaatggtgacggtgtcgccctgcttcaggtccttgatgtccttgaccttggtggagtacacgccgagcgggtagatggcggtgccgccgatgggctgcaggtccttcttgttgctcacgttgtagttggccaagtagagcaggtgctggaattcgttgaggtccagctcgccggagtcaagggccgggttttcggaggtgtagtcctggaagtcgacgatgtcgacgtagatgccggccttctcggcgtcctgcttgaacttgacccattcggggttggtagcgccgaccacgccgatcttgaccgggttgcccttgctgcccttggcggacgactcgttggcaccggcaaacgcgcggtagccgaagaacgcggccacggcgataatcgccacgaccacgatggtgatgatgacgttgcgggcggtgtggttcacacgcaccggctcgttattgttaggagcggccggggttgccggctgggttgctgctgtcattggatttcctctctccaaaattgatgtcgggtaacaccataacgcgcttgaaccgcgaaagtgacggaaaatggccgattgccatataggtgtcttttatggcgcgcatgcaatgtccgggattcgtgcgtttgataacccgctataggcgtgccgaacacgccggaagcacgtcggaaagcacgtcgagaggggctttgacaatggaagctatgactaccgatactgccaatgccgatatccgagccgtattcttcgatatcgatggcacgctcaccagtttcacgacccatacggtgccggattccacaatcgaggcgattcaccggctgcaggccgcaggcgtcaaggtgctgatttgcacgggccgcgcgccttcacagatgcacgtggtgctggataccatgccggtgacgttcgatggcgtggtggcgttcaatgggcagtattgttttgatgacaccggcttctttgcctcgcaggccttggatactgctgatattgaggtgattctcgactggctggaccgtcaccccgatgtggtgtgcaatttcggcgagaaggattacgtgtacttcaaccagtccaatgatctgcttcgcgccacgtggagcaaactgggcaaaaccgcaccgacccggtatttcgaggacccgcgcacccgcgcgctggatcatgagactttccagatcagtccctttgtcgggcccgagctggaggccgaactggtgggactgtgcagcaatgtgcgcggggtgcgttggcatccggatttcacggatctgattccggccgatggcggcaagccgcgcggcatccagcggttcatggcgcattacggcatcacgcgcgagcagaccatggccttcggcgatggcggcaatgacacggatatgctcgcctacgccggcatcggggtcgcgatgggcaatgcgaccgccgagcccaaggccgccgccgactacatcactgacgatgtggaccacgacggtgtgcgcaatgccctgctgcatttcagggtgctacgcgattaaaacatcacaacagttcgctttgttctgccccgccgtgacagggcttatgaataagcaaagggctcgggacgaatcccgagccctttggtgttagcgaactaacaacaccgtggaggtgttatcactcgttgtcgccagcggtagcggcggtagcggtgacggcacccttcttgtcggtgttcacgccggagtacacccagtcggtgtagtccgggtggtcgtagccgttgtcgacggcgaactggaaggcctcatcacggaacttctcgagctcgtcgatcttgtcggcgtacttgtcggcgtcgatcatgcgcagagcctcagcggtcagctcgtagcggtcgatgcggttgacacgaaccatgtcgtacggggtggtggtggagccctcctcctcgtagccgtggacgttgaagttgtcgtggttcggacggtcgtagatcaggccacgcacgtcgtgagcgtaggagtggtacgcgaacagcaccggcttgtcggcggtgaagatgtcggcgaactcctcgtcggtcagagcctcgtcgttctccttggcggactgcagggagagcaggtcggcaacgttcacaaccttgaacttgacgcccagttccttcagcttgtcggaagcagccatgatctcctgagtcgggacatcgccggcggcggcaagcacgacctcggcctcatcgttgttcttggcggtggaagcccaatcccaagcggcggcacccttctcgagctcggcacgagcctcgtccagggtcagccaggtggcagcaggctgcttaccagcgatgatggcgttgatcttgttggtggacttgtagcacttctcggcgatggccagcagcatgttcgcatcggtggcgaagtagatgccgatgacgtggtcgttgtggaagcacttgttcagcaggacggaggtgacacccggatcctggtgggagaagccgttgtggtcctgacgccaaacatgggaggagaccagcaggttcatggaggcgatcggcttgcgccacggaatctcgcggacggtagcctcaagccacttggcgtgctggttcagcatggagtcgatcacgtggacgaaggactcgtaggagctccagatgccgtgacgaccggtcagcaggtaggcctcgaggaagccttccatctggtgctcggacagctgctcaacgacctggccggagacgtgcatgtgctcgtcgacctcgtcggagatgtagccggcatcccactgcttgttggtgacttcgtaggaagcctgcagacggttggaagcggtctcatccggtccgaagatgcggaagtcgcgcgggttgttcttgatgatgtcgcgagtgtaggcacccagggtacgggtggcctcgagctggccccagccgtggccgtactcagccacttccttgacctcgtagtcctcgaggttcggcagcttcaggtcgttgcggatcacaccaccgttggcgttcgggttggcaccgatacgcagctcgcccttcggcatgaaggcaaggacgtcgtccttgacagcaccgttggcgtcgaacagctcttccggcttgtaggactcgagccagttcttgagaacctcgaagtgggcctcggtgtcgcgggcggaagccagcggcacctggtgggaacgccaggagccctcggtcttcttgccgtcgatgtacttcgggcaggtccagcccttcggggtgcggaagatcagcatcgggtagaacggacggtgcacgttgtcggtctgagcggtggccttgatgtcgcagatctcgtcccagatggtctcccacagctcggcgaagcgacggtggatggacatgtggtcctcatcatcgaagccagcgacgaactcgtagggctcgtaacccatgccgtggaagaactcgtggagctcttcgtcggagatgcgggacaggatggtcgggttggcgatcttgtagccgttgaggtgcaggatcggcagcacgataccgtcggtgcgcgggttcacgagcttgttggactgccagccggtagccagcgggccggtctcagcctcgccgtcgccgacgatggccgggacaaacaggctcgggttgtccatgatggcgccgtaagcgtgggacagagcgtaacccagctcaccaccctcgtggatggagcccggggtctccggagcgaagtgggacggaatgccgcccgggtaagagaactgacggaagaacttctgcagaccagcttcgtccttggtgatcttcgggaaggtctcggtgtaggtgccgtccaggtaggactgggaggtaccggccgggccaccgtggcccgggcccatgatgatcacggtgttctggccgtggtcagcaatgaaacggttgatgtggccgatgaggaagttcaggccaggggtagtgccccagtggcccaccagacggtgcttcacatcttcgcgggtgaagggctccttcatcagcgggttggaacgcagataaatctggccgatggaaaggtagttggcaacgcgccagtacttgtcaacgccttcgagggcttcctcggaaaccggagcgttgagcttcttccaaggggtgccaataacaggactcgtcatgtgtactcctgtactcctgcacgtgatcgtgcgattgattatttctgttcggtcacggtccctgacccttgcggtgccaaggttttccgttcccaatcaatcgtcatggtacgaggacaacgcgacttttgaacgatttcttgcgggtgtgttcgaaattgttgcggatatttcagtatttgtgcggttcgactgaccgtttgtcaacattagttttttcaacatactttttcaaaacagcggaagcatgcggaaatccagcatttggctagaacagcgcacgttcgatttcccatgttcgaaatcggcgtgttgtccgtctacaggcatgtagtttgttcgatttgcgcacatagtctctgcgtgtcggccttgtcgccttgaccagtgataatcaggggtgttcagcccacgtaaaattccaatgaacgttaggggaatatcaatggcaaacggtcctgtgcttgtcgtcgacttcggcgcccagtacgcccagctcatcgcccgccgcgtgcgcgaagcaggcgtgtactccgagctggtccctcattccatgccggtcgacgagatcctggccaaggatccgaaggcgattattctgtctggcggcccggcctccgtgttcgagcccggcgcgccgaccatagacaccaaggtattcgaatccggtgttccggtgcttggtatctgctacggcttccaggtcatggcctatgagctcggcggcaaggtggataaggccgcgctcggcgaatacggcaagacctcagccaccatcgacgacgccgccggcatcctcgccgactcccccgccgagcagaccacgtggatgagccacggtgtggcggtcgaacaggccccggccggcttcgaagtgctggcccacaccgaaggcgcgcccgtggccgccatggcggacgaatcccgcaagctctatggtgtgcagtggcacccggaagtcaagcactccccgcttggccagaagcttatcgaaaacttcctgcaccgttgcgccgcgctgcccaacgactgggatgcctcctcgattatcgaggatcaagtcaagaagatccgcgagcaggtcggcgacgccgaggtgatctgcggcctgtccggcggcgttgattccgccgtggccgccgctctggtacacaaggccatcggcgaccagctcacctgcgtgttcgtggaccacggcctgctgcgcaagggcgaagtcgagcaggtcaagcacgacttcgtcgccgcgaccggcatccgcctcatcaccgtcgacgccgccgacgacttcctcgacgccctcgcaggcgtctccgagccggagcgcaagcgcaagatcatcggcgagaagttcatccgcaccttcgagaaggcccagcgccaggtcctcgaagaggccggcgcccgcggcaaggaggtcaagttcctcgtgcagggcacgctctaccccgacgtcgtcgaatccggcggcggcgacggcgcggccaacatcaagagccaccacaacgtcggcggcctgcccgaggacatcaagttccagctcatcgaaccgctgcgcactctgttcaaggatgaggtgcgcgccatcggcaccgagctcggcctgcccgacgaaatcgtctggcgtcagcccttcccgggcccgggtctgggcatccgcatcatcggcgagatcaccaaggagcgcctcgacctgctgcgcgaggccgacgccatcgcccgcgaggaactctccaaggccggtctcgaccgcgacatctggcagtgcccggtcgtgcttctggctgacgttcactctgtcggcgtccaaggcgacgagcgcacctacggctcgccgatcgtcctgcgcccggtcagctcggaagacgccatgaccgccgactggtcccgtgtcccctacgatgtgctcgccacgatctccacgcgcatcaccaacgaatgccgccagatcaaccgcgtcgtcctcgattgcacctccaagccgccggcgaccatcgaatgggagtaagccgatagggctttgacctgctcttttgagtgccgtggtgtaccgctgagtttcgtttcgtacgagagtcatggcaaaaccgccagcgacggcagtgagtaaaaacgatttcctagcctccgttccctcgttggaacggaggcttttttctttgccgttttactccctttcacctgcgatttcgccatttactccccgtgtttcaagacaacaaggcacggggaggtattcaagggaatgggagtaaggatttatcccaagtgagttgacgcgcggtttttgtccccgagggcgaaacggggccgtttcggggcccgtgaaactcaaatcgaactcaacgggcattttttgctgggcgttccaatgttcccgttccgtgggataccctgattctctctgtggtactgtttgtggtgtttcctctggctggcggtatgctgacccgttcggctgtcatcaagcggaaggggcagtgtactttgaggagactttcatccatatgtttgacagtgtaactaccattggcttattgctgacgctggtgatgattttctcgttccaaggcaataccattctggaaaaacctctgcacattgttttgattgcggtaccgctgattttacagaccttcctgatttttgcgattgcgtatatcgcttgccgggttttgaagctgctctacaagattgctgctcccgccggaatgatttgtgcttccaacttctttgaactggctgttgctgttgcaatcgccttgtttggaacgacttcccctgcggcactggcaacgactgtgggtgtgctgacagaagttcccgtgatgctgttccttgtaaaaaaacgcaaataaaacgaaagactggttcaaatatgagtaagaaaaaggtggcatttatctgcgtccataattcctgccgcagtcagattgccgaggccttgggaaagcacttggcttccgatgtgtttgaaagctattccgcaggaacggaaacaaaaccgcaaatcaatcaggatgctgtccgcattatgaaagaactgtacgggattgacatggagaaaacccagtattccaaactgatctcggatattcctgcccctgatattgcaatctccatggggtgcaatgtgggctgtcctttcattggtagagcatttgacgataactggggattagaagatccgaccggaagcgaagatcaagtctttgtcgagatcattcgagagattgaaaaacggattctacagttgaagcagtcccttatttgattgaaatagcactctgcttgtggtataatacagatgatccaaaccattgcttttctgctgataacattgggcttgataatcttttgataacaggagtccgacaacgccgtataagttggataattggtatcaaattgagcaactaagagtcaaatcccctaaacagtattgtttagaaccagttttactttggcgagtgggagtaaactggagcggattttgcgcaatcgaaattccgtccgtagagtgtcgcagtgtgccgccacgtacgaaaaagcgtaaagccacctgtgattttgggtgagtaaaaactattgagaccctctggaaacaacgttttcagggggtctctttatgccttttgacctgcagtttcagtcatttttactctaaaagcgcgtacaccacggacatggcgacacgcagcggacgaagagtaaaggatttttcggagagtgaactgtcccagtagtttgtcccaccaccccaaaaacgcccctgaaactcaagtgaaactcaataggaacgcaagggcgtcatcgtgcgagcaccgcagcctgagccgccgataccaggctcgtttgcgacgccgtcgctgcttgcctggatcgtcaacggcaagtacgtcatgtcgctgccgctctaccgcatagagacagacctcaaggcgtgcggcgcgacgatatcgcgccaggacatggcgaactggatgatgaacgtgcacgcgcgctggctggcgaaggtccatgagagaatgaaggtcgagctgctgtcgcatgtcaggattcatgccgatgagaccacggttcaggtcctgaaagagccgaaccgcgaggcgaagaagaaatcgaggatgtggctgttctgctcggcgcgctgcaacgtgcccgtgtatgtattcgaataccacgagacccgcaggaagggcgttgcccaggagtttcttgcgggctggtccggcacgcttaccgccaacggctacaaaccctacttcaatctcggcaaccccaacatcgccaacacggcgtgcctcgtccacgtgcgccgctaattcgcccaaatcgtgaagatcgccggcggcgacgccaaggcggcgtctgcggccagcgttgcgctcgaggcaaggcgcaggatcgacgccatgttcaaggtcgactccaagttcgacgacatggagccgggcggcaggaaggccgcccgcgacgcggagctccgcccgctcatggaggacttcgggggatgggcgcgggcccagcttgtttgtgttcaattagttgttgcgggtttagtcacgatgatttttcgggtttaggcagagcatgccgaccacggaatggtcttaactggatggtgcttgtatctccgccagaaaggaccggaaaggattatgatcagcatgccccaagtacagtctatccgtcgtttgcggcggaacggggaatccgtcgcgtcgatcgcgcggaaaacacatgtcagcgagccgacggtgcgtaagtacctcgcgaaggaggatctgtcggccgtgccgtcggtgagaaagccgcgcgcgtcggtgatcgacccgtatctgcccgtgatcgagcagtggctcgcggaggatcgcgcgaactggcgcaagcagcggcataccgcgaccaggatctgggagcggttgagggacgagcatggcgcggaggtctccctgtccacggtgacgcgggcggtggcgcggctcaggcgtgagttcgcggcggagcgtgatgaggcgttcatggatctggtatggcatccaggcgaggcgcaggccgatttcggcgaggtcgacgtgctgttgcgcggcgtggtgcagcggatgcatcatttcgtgcttgatttcccgtattcgaacgtcggtctggtgcagttgatgccgggcgagaacgctgagtgcacgtgcctggcgttgcgcaacctgttcgagtggctgggcggtgtgccggagcggatcgtgttcgataacgccgccggcgtgggccataaggggtacggggagcgcgagccgcgcctgacgcacctgttccaggccttccaggcgcattacgggttcgattgttcgttctgcaacccgtattccggtcatgaggagggcgcggtggagtccaaggtcggcatggtgcggcgcaagctgttcgtgccccggccgagcgtatggagcctggagaacttcagcgccgggctgccggaccggtgcctggagctggccacgaaaccgcattgccgcaaggacacggaggaacgtggcctgttctccgaggaccgtgcggcgctgctgccgttgcccgggaagcgtttcgacgtggtcacgtggcggcatatgaaggccgaccggtacggcgtggccgcgcccggggacggcatcgctgttccgcggaccgggcgaacgcgggcagaggggtgatcgtgggcctccgcgcgctcgaggtcgaggtcctcgactcgtcgggcaagcatctggcgacccatcctcgggcgtacggccaggccagcacgaacagcgaggacccgtccatgcagttggcgctgctgtgcaacaagcccgcgtcctggcccaacagccgggtacgtgacgcgttgccggacccgttgcgggaatggctggatcggcaggacagacagacacgcaacgaggcgctgcagaccctcaaacgcgttgacagggaatccgggtgggcgaacgcggtcgaggcgatgctttccatcctcgaatcgaccggcggggcggaccgcgccggtgtcacactgctcgcggccaggctcgccgagggcgtggcgggtatcgaatacgacgatgacaggccggatccgggtgaatacgacatcgcgttcaccgcggacgtcggcgtgcaggaaggcgggcgatgaacacgaagacggacgaagggctctacgagaaggcccgcaagctgttcatctccaaggcgagcatcgacgaattcgccggctgggccacgccccgccaggtcgacgccgtccaccgcctgctcgacacggaactggcgaacagggaacgcgcgaagcacgacaggctcctgcgccgcgcccggttccccgtcgtcaagggtctcgacggctacgacttcacgaacgtcaggctccccgacggctacatgctcgatgagctcctagggctcggtttcatcccgcgcgcgcaggacctggtgttctacggcaagaccgggcgcggaaagacacatctcgcgatcgggctgggcatgaaggcgatcgacatggggctgggcgtgcggttccatcagaccgccgagctcgtcctccagctgggcaaggccaaacgcgacggcacgctcgagacgatgctccgggacatcggccgtgccgacctgatcatactggacgagttcggctacgcacccttcgacatcgacggggcgcgcctgctctaccggatcatcgcgggcagctacgaaagacggagcatcatattcaccacgaacatcgagttcagtaaatggggcacggtcttcgcggacgacaaactcgccgcagcgatcatcgaccgcatcgtgcaccacgggcggctcctcgagttcaccggccagagccgccgcgtcagtgaggccctcatgttcggcaggaacacctccgcgcaaccggaaaaataaggaaaatgcatgcaactgcctaaacccgaaaaaaatacatgactaaacacgaaacaccgacttgacgaaatacacccagcttcccctagcctcaccgaagctggcgctgcaccgtgcgctgcagtacgccgtggagttctggccctacgtcatgaacgtgctcgaagacgggcacctggagctctcgaacaacgtcgccgagcaggcccagcgaatcttcgtcgtagggcgcaagaactggctcttcagcgatgcgccacgcggcgcgcgggcgtctgcggcgatatacagcgtcaccaccacggccaaggccaacgggctcaatcccaggctttacgtcgagtggctgctgaccgagatgcccaacgccggcgagctcaccgatgaggttgtggactcgttcctgccatggtcggatagggtgcctgagtcctgcaagctcgacccagccgctgccgagaaggccaaagagatgcctgacgacttcataattaacatcgaccccgatgcgttcgacgacgagatggcgaacaacgccgaggagggcctgtagcgacatagcggcctaaggcataccgcaacgcaaagatggaaacgtccaggacttttccatccgtatgccggaatggccctggacgtttcctgctacgcggtcattttgacgcttacgctctaatgcctccaccgcttgtcgcgggcggggtagacgatccaggcggatgcgtagcttgcgataaggcagacaatgacgcagacgatgcttgtctggaacccgaatgagtcattgataacgccccagattacgcttgcgaagccaatgccgatgtcattggcgagcaggaacagggcgtttgcggcgccccagcgctctggcggggtgttctttaccgctacgctttgattaagtggcaggcttatgccagtggcgagaccatagaagattccggacgccaggaagacaggttccccgtacggtgcggcaagtagcataaggcagcagaggatgccgcacgcgacggctccggtcattgttttgattgcaggtacggtgtccatgaaatgctttgaaatcatgcgaatgataatcatgcttaccgcgctgatggtgtagaagagaccggcgtgggtatagccgagagtagtaccgtacagaccggcaaagaagacgccaaagccaaaagtggggcacatgatcatctgtgggatggcgccaggcaatgcgcgcggctcgaagatgttgaatgagtcacgcagggttctcttggacacctggtcgccttcaggatacttttcactgttaattgtttcggatgtagttactgtggtggagctgggtgcctgcccgtcttttgagtcgagttcgagccgggtttccattttgattcggtatgcgctggagcttggcagagtttgccatttactttcatagcgtgcgttgagggcgattacaagccctgcaaacccaaccagggcaaggccgacatagaggttcgttgagggatcggttcctactaggtaaagtgcgaaggctgggccgatgctcatggcgatagcctgtccgaggccgtggtatccaatgccttcgccgagccgttcttgcggtaagacgcttgctgcggcggtcgaggctgctgttgttgctgcgccaaagcccacgccttgcagcaaacggctgattgtgaagaggggatgccctgaacgacagcggacagtgctgttcccgctatgaggatagcgatgccggcgatgataacgagtgagcacttgccgttgtcgataacagggccgacgaacagtcgtgctaacgcggcggcaatggagaagacgagtgcaagtacgccggcaaggctcgcaccgtaaccttggcctgccaggaagacgctggttccactgttgagtccttggcccatgacgaagcaacagaaggtcagcgcgatgataagcacgaaaataagcgaccacagcttcggatggtcgtccttaccgatatttggcatgagaaccctcctatgattccaatacccgtattctacgtctgcaaaaagtgagatgtaagcgccaaaatgaccgcgtcttaacaacccgctgggcttgaggcagaatcatcgcatcgacttatcctggaaactgcctgacgaaggcgacaggatgcttgtcagcaaggcggcaaatcttaacgagagccaaatccaagagcttgcaaatcttcagcgaggcgttgcagcaatatatcagaacgaatggaccgaacctgtcctctgtcacatcgaaccgcatgaacgcggcctagagtactcgccaacacagagcaagcacagcgcgaaggacaaggtttcttctgaagagcttcgctatctcaactcttgtgtgcttaatccgttcaagctcgatgagccaagggaatacaacttctgcgactgtgtgcacaagatggacatacctgactccatgaaggcacgcttgattgagatggcagggactcctctgtcctcgaggaagccactgtttgaatggtgtgcttataggtatttcaatattggacgcatcctcgacgacgccagggatttatctgccgacagcctcaaagagaggctttgctcccatctgctttcaagctggaaattcgaagatgactcctcacccgaaagctggggaccaatccaatacctgttcattcagtcgatgtttaacgctcatctcaacgagctgagaaagaggggtaccggcatcgagacaacggaaaaggcctcagcactcgccgaagtatcagcggtcttatctcaaacaaggccggtgatctaaatggcgtttgaaaatatagagcaattaatgccggatacgaccgaaacgagattggccttcgaggaggcgcaacgcaccgttgctgattgtgcagatgccgcatggcgggatatttcttccggcgatgtcctaaccgcgagcatttcaacagttcaagaagccgcagatgacgcctggaaagcatgcgagccaacactcaacgctgcaggcgaaactgtccgcgatggcgcaaggaacggagcttatcttggcggcaggttcgtacttggagttgccgacgttggagaaaacgcatatgtcggtgttcaatcgaatattgaactactggccgaagacgaagaagcagcggtgaaaaccgcgcaaacacacgctgttgacgatgcagccaacgcctggggcgacttcatggaagccgatgagcagatacgggaaatcggagactatgtcgaaactggaggcgaaatcgccactgaagttgcgcttggtgccgtagccgtcaccgcttctgcccctgcagcactcgctgctggggctgtactcgttcttgacgaaatgggaaagagcttggaagccggcgctgaagacggtgagatatctcaggaggatatcgtcggagaagtcgttgcgggaactgttacggcagcaacgcttcttgccggacgaggtctaaataactttcttgcctcaaaggcagcagaatcgggcgcaagctcacgaattctggatgatgccggaaaggcaatttacgaaggcgaccgactgcttcccaataacgagtttgcgatcgacggcgtgaagtgtgcaaccgacgatctcgggcagctttaccgcgttggcgacgacctcgttccgaacatgagctatgagatcaatgggtataaatacgttaccgatgcaatgggtagggtcgaatcggccgaaggcttcttacaactaaagacccacgaaggtcgtttgaccatcaaggacactatccagtcaatcggaaaagggtttgaagagctttttgatcaaagaggccatctgattgccgaccgattcaatggatcaaatggccttgagaatattgtcgccatgggcggcgaggttaaccaaaagcctatgcagcaatcgagcaaaaatgcgccgatgctttggctgatggcgctgaagtgtttttcaaggttgagccactttatgagggcgggtcattcaggcctagctcgtttgctatcacggacattattgacggcgaagagacggttacgtttcttcttaacactgcaaaggaaatgtaatgagtgaaaagaagatgctacaagggatagcttcaattcttgaggaaaccctccccgaagactggagcaaggtcgtgttttacgccgagtacgccgagggtgcgttctctattgagtattacgttgctggcagcggaaaagacgacttcgttaaatgctttgaccaaaaaggcgtttcgagggcatccttgatgaaaaactttatggctatcaacaagttcattgaacctgaaagggccgcgcttaagcccgaaaagagatggggatcgatgacgcttattctccattccaacggcaagttcaaagttgattacgactactccgacatgacagaaaacgcttacgcccgaaagaaggcctggaaaaagaaatatctcgcctagcaacgaacggtctgggaaatcaccgcaaagccacccgtgcatactcttcgagcgcacgcgtcgtcggcaacgtttcgaccagcgcgtttttgggagccatgcaaacccctgttcaacattcctcgggagtgattgctctctatgacgaatgggattccccatcggggaatcccattttttgttgccgacgacgtccggtataatttttccgtttacgacgtcgttcggaaagggatgccgacctctatgcgccagggattcgacaacgaaaaatacatcgagctgcaagccgccaacatcagaaagcgcatcgcgcaattcggcggcaaactctatctggaattcggaggcaagctcttcgacgactaccacgcctcgcgcgtgctgcccggctttgagccggacaccaagttccgcatgttggaaagtctggtggacgatgtggaaatcgtcatcgccatcaacgccaaccatatcgaaaaaggcaagacccgcggcgacctcggtatcccctacgacgaggacgtgctgcgactcatcgacgtgttccgttcccgcggcttcctcgtcggctccgtagtgctcacccaatacgccaatcagcccgccgccgacgcctaccgccaccgcctcgagcaactcggcgtcacctgccgcctgcactacccgatcgccggatacccgcacgacatcgaacgcatcgtttcagacgacggatacggcaagaacgagtacatcgagaccacccggccgctcgtcgtggtcaccgcgcccggccctggctccggcaaactcgccacgtgcctgagccagctctaccacgagcaccagcgcggcatcgacgccggctatgccaaatacgagacgttccccatctggaatcttccgctcaaccatccggtcaacatcgcgtacgaggctgccaccgtcgacctcgacgatgccaatatcatcgacccgttccatctggaggcgtacggcgagaccaccgtcaactacaaccgcgacgtcgaagcattccccgtgctcaaagccatgatggagcgcatcatgggcgaaagcccctatcagagccccaccgatatgggcgtcaacatggccggatacgccattgtggacgacgatgcctgccgcgatgccgcgcgtctggaaatcgtgcgccgctacttcgccgccgccgtgcacttgaagcgcaccggcactggcgaggaacaggtggagcggctgcgctccatcatgaaccgggccggcgtgacccccgatctttctcccgcccgcgccgtggcccttgagaaggaagccgccaccggtgccccggctggtgccatggtgctgcccgatggccatgtggtcaccggcaaaaccggcgacctgttgggcgcggccagcgcgctgctgatgcacgcgctcaaggccgtcaccggtgttgacgaaaccattccggtaatcgacgatgccgccatcgaacccatctgtcggctgaaaaccgagcatctcaacagcgtgaaccgacgcttgcactcggatgagacgctgattgcattgtcaatcaccagcgccaccagtcctgtggccgctcgcgtcatcgacgggctcaaacagttgcggggctgcgacgccttcttctccgttatcatctcatccacggacgaggcgctgtatcgcaaactcggcatcaacgtgtgctgcgaaccgaagtacgaacgggtgagtctgtatcaccggtaagcgccaccgataagcgcggtatgccgcgaatcgtcaagccggtaatcatgcagcatgcggcctgacgattcgctgctgtcgcattgtctctcccctcggccatgctgggcttgttttccgtttgttggagagaacggggaatgccatcagcactacggaaagagaaggattatccgtgaagcggttcgtgggtttagacggtattaaaggactagcgctgatagccattgtgctgtaccactgcatgcagcaacggctgccaggcggattctacggagtcgacgtgttcttcaccgtctctggattcctgattgccgtcagtttgattcgttctctggcggaaaccggatcgctgaatctcgtgcgatatattcccaagcgtgcagtacgtctctatccggcgctgtttctgctgattccggtcatcgtctccgtcggctggctgttcgatcacgacattctagtttccatccgcgaccaagtcatcaccgtgctgctgggctgctacaactggtacgccattgccggaggccaaagctatttcgaccaaatgaacccgcaggtgtttcgccatctgtggttcattggcgtgctcatgcagttctacgtcatcgtgccgttcatcgtctggctgatgtggaagctccgccagacgaaactgtcttcactcatcccactgggactcgcggcgttcagcagtatcgccatgtgggtgatgtatgtgcccaaaggcgaccccacccgcgtctacttcggcaccgatacccacagcatgggcctgatgctgggtgtggctctcgcctggtgggtcaccgctcctcagttgggccacgctcgccagagggctgtgccgatgccccgcaccattagctcgagcgcttcggcagccgcacatcgggctccgttacctcagattcccgtggagcatcgcatctggaatgcggcggcaccggtattggcgttcctcagcctgattgccttggtcaccatggcggttatcggcaaacaggatgcattcgccttccgcggtggcatcatattgtccagcttgttgtccgtgctgctgattgccggtaccatctccgacgattcctggatgcaaagcctcatggtgttcaagccattggcctccctcggcaagtattcgtacggcatctacctgtggcactggccgttgtggattctttccagcgcccttgccccgaagatcttcaaggcagtagggccttggcctctcatcatgaccgcgttgctcaccgccattgcggtgatgatttcctggctgatggtggagaaaccggcggcaacgcactcggcggtatccgtcgtggtgccccttcgcacgaacaagaagaatcatgtggcccgggttattgccgttgacgttatcctggtgctgtcgttggccggctgcgtgcagggcattgctcatgcacctgcgaaaaccgccatgcagatccagctggagcaacaggccgcacaactggaacgtatgcagaaaaccgaacacgtgctgctgcgccatgccgtgccggcaccgcccaagcccaagcatgagatgcccaccggcgatcagattaccgccataggcgattcggtgatgctggcctcatcacagggcctttcggaagtcttccccggcattcagaccgacgcgagcgtttcccgctccatcatggtcgcccccgaactcatcggcaacgctctgtccgccggcagtctgcagcagtgggtgttgatcggccttggcaccaattcggcaatcacccctgatcagttggaccagattcgtaatatgatcggccccgaccgcgtgctggtactggtcaatgcccacggagaccgtacgtggattccacctatcaaccaggtgcttgccgactatgcggccgcacatccggacaatgtggtgctggtggattgggatgccacagccaacgcgaacgcgcaggtgctcggctccgacggcatccacccgagcatggatagcgatatctatgcaaaggcggtcaaacaggccatcgaacaatggatcgcaagcggcaggtgaacggcaggcaacgctgagttgtccaaccagtcgtgaagaacggctatgctgaagactgcatcaacgagaccacacgttgggagacatggtgagcgcaatccttgaagggaagcccgataagaatcttattctcgttacgggaaggattcatccgaagttggctgaggatgtcgccgagcagctcggcatcgacgtccttgaaaccaccgcatacgatttcgccaacggcgagatgtacgtgcgctacaccgaatcggtgcgtggcgccgatgtgttcgtgctgcaaagccactacaagcccatcaacaaggcgatcatggagcagctcatcatgatcgacgcattgaagcgcgcctcggcccgttccattactgctgtctgcccgttgctcggctactcccggcaggacaagaagcaccgcggccgcgagcccatctcctgccgtctggtgttcgacctgctgaagaccgccggtgccgaccgcatcatgtcggtcgatctgcatgccgcgcagtcccaaggcttcttcgacggcccggtcgatcatctcgtggccatgccagtgctggtcgactacatccgtgatcgtttccagggccatctcgacaacgtcgccgtcgtctcccccgacgccggccgcattcgcgtagccgagcagtgggcgcagcgtctcggcggcggtcctctcgctttcgtgcacaagacgcgcgacatcacccgcccgaaccaggcggtcgccaaccgcgtggtcggcgacgtcgccggcaaggactgcgtgcttgtcgatgacctgatcgacaccgccggtaccatcgcgggcgcatgccacgtgctgcaggacgcgggagccaagtcggtgaccgtggtcgccacgcatggcgtgctctccggcccggccatcgagcgactcaagaactgcggtgcgcgcgaggtcgtgctgaccgacaccgtgccgattcccgaggaaaagcgctgggatggcttgaccgtcctgtcgatcgccccgctgctggccagcgccatccgcgccgtattcgaggacggctcggtcgccgaactgttcgacacctaccccgagcaccacggtcaaggcttcctgttcgcctgatcacgtgcgtgtttgttcgcggaaaacacacaatgcgagacgcgacatggcgtagcctttcggtaaataccgacagtatgatataaatgaacacttgtgggccgaaagcccacgactcccccatggtgtaatggcagcacacgggtctttggaaccctttgtcttggttcgagtccaggtgggggaacggctgacggccgctcgacatccgggcggccgtctattattttgaggtgtttccgccctcaatagacattccgatcgaagggaatacgtcagttatggcattatccgcagccatcgtcctcgccgccggcgagggtacccgcatgcgttccaacaagccgaaggtgctgcatacttttgcaggcaagaccttcctgaacagggtcatggattcggtggccgccctgaatcccgacacgctggccgtggtcgtgcacttccaggccgagcgcgtcgccgaagccgcccgctcctatgacgagcaggtcaccatcgtgaaccaggacgacatccccggcaccggccgcgccgtccagtgcgcgatggcccagctcaccgaatccggcaagatcgacggcccggtgctcatcgccgcctccgacatgccgctgctcgacagcgagacgctgcaccgcctggtcgaattccacaccgcctccggcaacggcgccaccgtgctcaccaccatcctcgacgacccgaccggctacggccgcatcatccgcgaccgcgaaggcaacgtgctgcgcatcgttgaacagaaagacgccaaccgcagcgaactcgccgtgcaggaagtgaacacctcagtctacgtgttcgaggcctccgtgctcgccgaggcgatcgccggattgaagtcgaacaacgcgcagggcgagttctacctgaccgacgcgctggaaaccgccaaggccgctggcaaggtcggcgcgttcgccgccccggacccgctcaccgtcgaaggcgtgaacgaccgcgtgcagctggccgccctgtccaagacctacaaccgccgcgtctgcgaacgctggatgcgcaatggcgtgaccattcttgacccggaaaccacctggatcgaggacgacgtccaaatcggccgcgacgccaccatcctgcccggctccttcctgcaaggccacacggtgatcggcgaggacgccgtcgtcggcccgtacaccacccttatcgacgcgaccgtggacgaaggtgcggtggtcgaacgttcccgcgtacaggaatcgcatatcggggcgcgcacgaacatcggaccgtggacctacctacgtgcgggcaacgagttcggcgaggacgccaaggccggcgcattcgtcgaaatgaagaaggcgcacatcggcaacggcaccaaggtgccgcacctgagctacgtgggcgacgcccggctcggcgaccacaccaacatcggcggcggcaccatcaccgccaactatgacggcgtgcacaagaaccgcaccaccatcggctccggctgccacgtgggtgccggcaacctgttcgtggccccggttgaagtgggcgacaacgtgaccaccggcgccggttccgtggtgcgccacgccgtgccgagcgacacgatggtctactccgagaatacgcaacacaacgtcgagggctggaagcccgcctgggagcgctgaaccatgcccgcacttcaggattccatcaacgccgtccgcgtggccgccgaggccgcggaccgtatcaaagccaccgacatcgtggccttcgacgtagccgacctgctcggcatcaccgacatcatgatgatcgccggcgcctccaacgagcgtcaggtactggccgtggccgaggaaatcgaaaaggacctgttccttaagtgctccggccgtcagccgcgctctcgcgagggcctgaccgagggccagtgggtgctgcttgactacggtgatttcgtgattcatgtcatgcacgaggaatcgcgcgaattctacgggctcgaacgactctggcgcgactgcccggccatcgatcttgaactcgcacacccggaaacggcggagcatgcggaagatgctgccgtcaccaccgcgtaacgtgcgaatcgcgtaacgctgatacttgctgatattcgctgatattcgctgatattcgcgtgtcgggctgcctgttgccgaacgtcattgacggcaccaggcagccctccctttttcctgtttcctcactggaaccgaaaggatcgtcactatgaccaatcatgttcgttccgttttccttatccgtcatggacgcacctcctacaacgccgctcacaagctccaaggccaggtcgacattccgctggacgccgtgggtgaatggcaggtcaagcagaccgccgcggccttgaaaaggctgtacgtcgatcgtcggcaggaaatcaaccaccggttcattgtctgctccgatttgaagcgtgcgcacgccaccgcgcaagctttcgccgacgtattgggtggaatcgagcccgtcgatgatcgtcgcgtccgtgaacgcagcttcggtgattgggatggccatgccgtggccgaactggccgaacgctaccccgaggacttccgttcctggatggagtctcggggcggcgagctgaagtatggtgccgagcccaaggaagctgtgggcaagcgcggcgtagaggctcttgaggactggtccacgcgtgccggagacgacacggacctgttcgtgttctcgcacggcgcatggattgcgcagacattgcagaccctgttgggcatttctgcaatcgatccgaccttttctacggtggtttcattgcgtaatgcgcactgggtgcgcttggtgccgatggacaatcccgatggcactgtgcgctggcgtctgctggactacaatcacggtccggccatcgccgacaccgacgagtgggaacgcgaacgctgatcgtgtcacggctcccctgctgagccaacaggttcagtgtattcgaaaaaccgttcaagcagtaattgaataacccaatgcctgaataatggcggaaacaagccaaaaagtgtcgccaaatcccacttttgccatttggcgacacgccggcttttgccagaatcgacatctcgtcgtaatgtatacgaggtccaaacaacgggccaacaattgaaaacggggctatagcgcagctggtagcgcatctccatggcatggagagggtcgggggttcgaatccccctagctccacgacgaagccatcaaatcaggcgatatggtggtttctccgctggttcatggcgggtcttgcgactcccatgaatcggatagcttcactcggggctatagcgcagctggtagcgcatctccatggcatggagagggtcgggggttcgaatccccctagctccacaatcaaggccggtgcttcatgcaccggtctttctcgttttctggcctatcggccgacttttgcgcaacattccccggaaagcgtcgccaaggggacgctcttccgattggcgcgacaccggcgtgagcgataacagtaatcgccactacaatgaggtgtggtccctatcgtgttgattatcaaaggagacaaaaacatcgtgaccgtcacccgtgtatatatcgccagccctgaaggcgccaatggccgcaacgtcgtcgcttacggcatgctcaacgcattgacttccaagtacaagaccatggtgttccgccctgctgtgtccaaccatgacgaattcaccccgatcctgctcgccgcctccaatgccggactcggcgtggccctgtccaccggcctcgatgtgcacaaggtgcgcgaggataaggacaccgcccgtggcgatatcgtcggcgcgttcaacgatgccatggacgtttcccgcgcggacgccgccctgatcgtgggcaccgacaagtcccacgtcaacgatccgaccagctatgaattcgacgcgaatgtcgccgctgatctgaaggccggcgtgttcctagccgtgtgcaccatcgaccgttggccgcacgagctcgacgagaccgtcaagctgtccatcgagggcatggaggccgctggcaacaaggtgctcggcatcttcgtgaccggatgcgagccgcgccacgctttctccgttaaggagaccctcgccaagtacggcctgccggtctggactctgccgcaggtgccgttcaccgatgaatccaccaaggatctggcgctggagaccttccgtaagaacgctcccaccgatgaagtgctcgccgcgctcgatgtggacgtcaccgcgcccatcaccccgtacgccttccagttcggcctgctcggcaaggccaagagcaacaagaagaccatcgtgctgcccgaaggcgaggaggaccgcatcatcaaggcggccgactacctgcttgagcgcgagatcgtgaacctcatcatcgtgggcaacaaggacgccattctggctcgcggcaaggaactgggcctgaactacttggagcgcgcccgcttccaggctatggacgacgagaacgtgttgaagcccatggtcgccaagctgtgcgagttgcgtgccaagaagggcatgaccgaggagcaggcccgcaagcagctggccgacgccagctacttcggcaccatgctcgtggtgctcggctacgccgacggcctggtctccggctccgtgaactccaccgccaacaccgtgcgcccggccctgcaggtcatcaagaccaagcccggccagaagctggtctccggcgcatttctcatgtgcttcaaggaccatgtggccgtgttctccgactgcgccatcaacctcaacccggatgccgagcagctttccgaaatcgcgttgcagtccgccgagaccgcacgtgccttcggcatcgacccgaaggtcggtatgctctcctactccaccctcggctccggcaagggaccggacgtggacatggtcgaggaagccaccaagctgctcaaggagaaggctccgtatctgccggtggtcggttccatccagttcgacgccgcctggtcccccaccgtagccgccaccaaggccaagggcaacgatgtggccggacacgtcaacgtgttcgtcttcccggacctgtgcgccggcaacatcggctacaaagccgtgcagcgctcctccggcgccttggccatcggcccggtgctgcagggcctcaacaagccggtaaacgacctgtcccgtggtgctctggtgcaggacatcatcaacaccatcgccctcaccgccatcgaagcgcagtgagcccggcttagctcccggtggctcccgccagcgggagccaccgtaatgcttattttgtagcaagcaacgagtaatctaatcaacggtaacccgtgtctcacgggaacattcaatcacaatggaggatgcccacaatggcgaaaaccgtccttgtcatcaattccggctccagctcgatcaagtaccagctggttgatctcgaatccggcgaaggcctcgcttccggcctcgtcgagaagatcggtgagccggtcgacggccactacaagcacgagtacaacggcgaaaagcacgagcttgaagagccgattcacgaccacgagcagggtctgaagcgcgtgctcggcttcttcgaggagtacggcccgaacctgtctgaggctggcattgtcgccgtcggccaccgtgtggtgcagggtggctccatcttcccgaagccggccctcgtgaccaacaagaccatcaaccaggtcaaggatctggctgtgctcgccccgctgcacaacggcccggaggccaagggcgccgaagtcatgcgctccctgctgccggacgttccgcagatcttcgtcttcgattcctccttcttcttccagctgccgaaggccgccagcacctacgcgctgaacaaggaaatcgccgatcagttaccacatccgccgctacggcgcccacggcacctcccacgagtacatctcctccgtggtgccggacgtcgtcggcaagccggctgaaggcctgaagcagatcgttttgcacatcggcaacggcgcttccgcttccgctgaggtctccggcaagccggttgagacctccatgggtctgaccccgcttgagggcctgatgatgggtggccgtaccggtgacatcgacccggctgtggtcttccacctgattcgcaacgcccacatgaacgtggacgagcttgacgccctgttcaacaagcgttccggcatgatgggcatgaccggctatggcgatttgcgtgaggttcaccgtctggtgtccgagggcaatgaggacgccaagctggctctggatgtctacgtgcaccgcatcgtcagctacatcggcaactacacctaccagatgggtggctgcgacgtgatcaccttcaccgctggcgtgggcgagaacgacgacgtggtccgcaagatggtgtgcgacaagctcgctccgttcggcgtcaagctggacgaggagaagaacgccacccgctccaaggaaccgcgcatcatctccactccggactcctccgtgatcatcgccgtgattccgacgaacgaagagctggccatcgcccgcaagtccgccgcaatcgccgaagccggcaccgacacctacggcaacaccttcgccaagtaagtaaccgccgttaggatctcaccaatctctagttgcaacactatgggggctgattccgattggaatcagcccccattcgtatatggtcatgagacccctacccctgcgtcatactccccctcagtcgcctccggcggactgagggggggtccaccagaacacaggaccccttactgcctcagcatgccgctccacataccgacgaaatcaggcaaggtcttgcgcgtggtggccacgttgatgacctcgatatcgggaatacgcagccccagcatcgcggcgaacgtggccatacggtgatcagcataggtttccatcacggcaccgtgcaacgtctccgccggcaccggttcgatacgcaatccatcaggcaattcctcagccgctcccccaacacgacgaatctcgttgaccaatgcctccagacgattcgtttcgtggccgcgcaagtgaccaataccaaccatgtctgtcgacttatcagcaaacaccagaatcgccgccaacgagggcgcaatctccccggccgccgtcaaatcgaacgtacccagcccacgcacggtgccgtcaccggtcacttcgcaatagcgcacgccatcgattgtcgggaacgatactttggcacccatctgttccagatagcccggcaacaaaccacccggctgggtggtggtctcaggccaatgaggcacccggaccgtgccgccggcgatcaatgccgcgccgaggaatggcgccgcgttcgacaggtcgggctcaacggtcaccttgctcggcagttgcattgcgcgcggttcaaccgtccatgtgcgggcggattcgtcggcctcaaccgcaccgccggcaccggtcacatcagccacagtcatgcgaatgtgcggcaggctcggggtcttctcccccgtgtgcgcgaggtgcagaccgccaggcagtttggaactaatcagcaacaggccggagatgaactgggaagaaccggacgaatcgatgctgacctgcgcctgggcagccggcaaggttgcaggcggcgtaatagtgaacggcagacggccaacctcgccgtggtaatcaaccgttgcacccagctgttccaaaccgtcaagcaccggcttcatcgggcgtgcataagcctgttcgtcgccatcaaaattcactgggccatctgcaaacagggcaaggccaggcacgaaacgcatcaccgtgccggccagtccgcagaacacattgacgttgccatggaatcggccggatacgggaggagtaaccgttacggtggtgtcggttgcggaatccacgtcgcagcggacaccgagggcttcgagggcgcccatcataaggtccgtgtcgcgcgaacgcagcaggccaatcagagtaacgggcttgctgccgagggcggcgagaatcaggtagcggttggatagggacttgctgcccggcaccgttaccgtagcgttcaacggctgtgtggcgagcggggcaggccagagattcgcgagttgttcagtcataaggccaaatctatcaaacaaattattcaccggtcggcagcgatgcgggattcgatctgctgatcaggtgcggaagacggctgctcaaaaccgccttcgatggcctgcgcgtgcaacaactgagcggccgcgcgatcggcctcgatggcggcgatctggcgcgagaacacgatgaaccagccgaggaacgccagaccagccaacgcctccacattggtgagggtgttgtgacccatcatcatattgacccagaatgcagcgcatacgagcgcggtcaggtcggaggccaccatcactgctttggacaggcgtggcgcaagccacggcaggagcacgaacagcagcagcatgacgaacggcaggcctttggcgcatatattgtgcaagagattgtgtggcgtgtaccgaaacacgccgatgccgatgaatgccaggccggccaccatcagcaggaaggacagaatggagatgcgcagcatgaaatgtgggatttcgtagccgcgattcggatctctgttggtgcggtcgtgccagaggcgctgtagccgttcggtggtcaccagttcggagatggcgaagtagctgacgatgatgatgcatgtgccggcaagaatcagcgtggagttgaacatacgggccgcaaacgtggttctgtcgccgagctgcgaaaagttgttgtgataccagtatgggtcgtcggtggtcatgccggcggtgaccacgccggagatgacgaagaacggcaacagactggcaatagttttggcgttcatcatctccgcctgtacaaaggtcatgtaccccaccacgccggcgaaggcggcgcagacgctggagatatagccggagaagatggcattgcccatcatgtcgttggccgcaccgatgagtgcaaaagacgacaggaaaatggtcgaggcatacaccaccgaaagggcgacgatttcgaaaatgcgacgaatcggtgcaaaccaaccatgtttgaggttcaatgaacgtgatttgcgcgcatagccaataatgaaggaaatgacgccgcatgccgccacgatgcccgaacataccatgaatcggcgttgcgtcagctgccagatggccggcgcgtattccatgtacaggttcatcgataccgcgccaacgacggcgcaaatcaagaaggagatgagtccggaggtttctgcacgctgatgacgtcccatgccgggcctcccctatctattcgatgccgcgttatctttcaacaacaaacaaaactccccccgaggacaacgctttactagcaagccagcgggatttggctgtcgccattctactgaaaatctgaaacactacaaaaaaacgattatgtacgggcttcttagcctttgcgactatcgttaccgccttgccgagtaccgttgttcatgcagaaagaaagcagtattggacacaatcgaatgagcgtgtcggtatcgttgaaaaagtaatgaatgacggttctatcggttcaacctttaagggacgaaccagccgcggcaccatggcgctgatgcatgactatgccgagctcatcaatgaattacgtccgacagcagagcaattcaccgagatcgagcaatactgggtcaaacgaattcaggcgttcttcaccagcaaaccattcaagctggagtccgacaactcgctttccgttgatgcggccgtggaacatctgctgcggcaggcagcgcagcggcgaagggagaatccgggcaccatgtacgtcggcaccgtcctgcagcatctcgtcacggcaaagctcaccatcgttgctccggaagtggaaatcaacggcgcgtccgttgctgatgatccgagtccgcggcttccaacggtgaggccgcggaccgtctcacaaaaccgtccgcggctccgccctcctgtttcgtcgcaactgactacaccgacgggttcgggcgcttcgtcacgaaaacgccattgcgatgcaccgtatacgcgccgccgtcactgccccgttccgcccggaacaggacgatcggctcccctgcgatgtcgcgcagttcgacatccgatctgccacgtgtcagatagaagtcgaatatggcgtcgtcggattgacgcatggtgtgcagaacgtcagaggtcacgccgctggcgggcgaccgcaggttggcttccggctgccggccatcctgcggctgcgcggcaagccagcctcccacgaatcgcgtcagatcgctcacgcccagatcgcagccgaggaaatacgcctccccttcgccgtacgtgttgcgggtgatcgcggccatgccgtcaagctcccactcatccgcttcttcgccggcatacgaggcaagcacctgcacatgcggtccggcgacggtcacgtcaccgagcttgtcgatgacgcgatcgagccagtcgaaatcccaatggtcttcgatgggctggaggcgatctcagctgaagatggcaagggccacggtgttgacgccggcctggcccatcaggcggatgtcgtcatcccagatttcctccggccattggtcgggactatagtcgccaccgaaagcgatgccgcgtccgtccgcggtcagcagttttggccatgcgaagtcacgtcatgcacgcacggttatctcctttggcaggcggcgcagggccacggcccatatcggataccagctgatactagctgatagacactcctggccgatagtcgacacgccgccggttccggccccactgccggaaccgacatgggtatgttcatgaccgccgaccgcaggaacgaacaggcccgtccgccacggaccgcatcttgcggttcaggcggacgggccttatgggagggatgggaacgggagatcagttcttaataactgcctgcgcctcatcgtcgacgatctcgccggaagcgagcttggcttcgagctcctcaacgatctgcgcatgcatcttctcatcgatcttgaccttgaaccagaacacgacgaggctgaggatgatgagaacaagcgggacgtagaaggcgaaggtcttgaacgtggcgatgttggacgcggtcatgtcggctgccgtggcatgaccggtcatgccagccgcgagggcaacggcaccgaccgcaccgttggacatcgcgccgccgatcttgtcgagcatgggacgcaccgacaaggtgaccgcctcgttgcgcttgccgttcttcagctggccgtactcgatggagtcggtcagcgacagaatcgcggtcatctggatgaactgcgcaggcacatagaagaagatcagggcgacgatgacgaccggcaggttgctggagaacagggcgagcatcgtgtagccgataatcatggagaccatgccgccggtgaacaggtagcgacggggaatccagcggttgagaatcgggtacagcggcgccatgatgaatccggcgatcagcgggatgatgccggtgatggagaaggcggcaggctcgtcaagcacgaacacgaagaggtagtacatcacaccggtcgtgatgacgtttgcgatggcgtacagcaggtaggacagggcgacccacagcagctggtcgttctggaacagcgccttgaacgcctcgaacgggttgccgttcttctgggccttggcacgcagcgcgctggtgctttccttggtgccaaaggcgacggtccaggcggtaatcaggccgaggagcgcgacgatgaagccgaaggaggtccatccggcctggccctggcccttggcgccggtgaacgtccaggtgaagtagctgacgatcgggatgacgatgacggtgatgccgttgtagccgatagagccggtgaaggtgccaagggcggtgtaggtggaacgttcgtgggagtcggaggacaacgccgggatcatgccccagtaggagatgtcacgcagggagtagaacacgtcaagcacgatgaacgtgatgacgaacagcacgatgaacagcgtggtgttcacgttgaccagtccgaacatgccggagaagatgagcatgatcaacacggaggagaccagtccgccgatgaactgccacgggcggaaacggccccacttggtggtggtgttatccacgaggttgcccagcagcggatcgatgaagatctcggcgatgcggataacgacgatcaggccggtgatgacggcgatcatttgggcggctagagccttgctgtagctgacgaacaggcagctggtgacgtacgtgacgaagtacgtgctcatcgcgttgtagaaggcagcctgccccaagttgccgcacgcgtaggcgatgcgctggcctaacccgcccttcctgcggacgtcaccgtccgcgacattttcgttgctcattaatcttctccttaagaacccagagcatggaatcactcattgattttgtaaagtatagcatacaagttttatcaccgtaagcatacaagttttatcaccgaaagtaaaaagcattagtaaacaaggagataaacagcgtgtcgcaaggatgggataacatgagctgaaccgagacattgcatggacgcggcgtagcgtcgacggcaagcagtgccagtgatttggaagcggtaaacaggatttgcgttttatataaaaactgtttatccttttcggtaaaggaggccccggcctcttccataatatcattcacaacgaggtaatgacagaaagcaggagagcatgacagacgtcacacatgtcgatcgcgcatcgcaggcttggctgaccgacccgacggtgttcgaggtgaaccggactccggcccattccagccacaagtggtacgcccgcgacccccagagcggacaatggtccgatctcaagcagagccttgacggcgagtggcgggtcgaggtcgttcaggccgccgacatcaacctcgaagaggaacccgcgacggccgagtcgttcgacgactcctcgttcgagcgtatccaggttccgggccacctacagacggccggtctgatgaaccacaagtacgtgaacgtccagtatccgtgggacggccacgagaacccgttggaaccgaacatcccggagaacaatcacgtcgcgctctaccgcaggaagttcaccgtctccgcccccgtggcaaacgccaagcaggccggcggatcggtgtcgatcgtgttccacggcatggccacggcgatctacgtgtgggtcaacggcgcgttcgtcggctatggcgaggacggcttcacgcccaatgagttcgacatcaccgaactgctgcacgacggggagaacgtcgtggccgtcgcctgctacgaatactccagcgcctcctggcttgaggatcaggacttctggcgtctgcacggcctgttccgctccgtcgaactcgccgcccgcccgcacgtgcacatcgagaacacgcagatcgaagccgattgggatcccgaggccggcaccgcttccctcgatgccgcgctgaccgtgctcaacgcggccgacgcggccacggtccgcgcgaccctgaaggacgccgacggcaacacggtgtggcagacgacgggcgacgcggaggcgcagaccgcgatctccagcggaccgctgcagggcatcgccccttggagcgccgaaagcccgacgctgtacgagcttgacgtcgacgtcatcgaccaggcgggagacgtcatcgaatgcacgtcccagaaggtcggtttccgccgcttccgcatcgaggacggcatcctgaccatcaacggcaagcgcatcgtgttcaagggcgccgaccgccacgagttcgacgccgaacgcggccgcgccatcaccgagcaggacatgatcgatgacgtggtcttctgcaagcgccacaacatcaactccatccgcacctcgcactacccgaaccaggaacgctggtacgaactgtgcgacgagtacggcatctacctgatcgacgagaccaacctcgaagcccacggcagctggtccctgcccggagacgtcctcaccgaggacaccatcgtgccgggcagcaagcgcgaatgggaaggcgcctgcgtcgaccgcgtcaacagcatgatgcgtcgcgactacaaccacccgagcgtgctgatctggtcactgggcaacgaatcctacgtgggcgacgtgttccgcgccatgtacaagcacgtgcacgacatcgacccgaaccgtccggtgcactacgagggcgtgacccacaaccgtgactacgatgacgtcaccgacatcgagacccgtatgtactcgcatgccgacgagatcgagaagtacctgaaggacgacccgaagaagccgtacctctcctgcgaatacatgcacgccatgggcaactccgtgggcaacatggacgaatacacggcgctcgaacgctacccgaagtatcagggcggcttcatctgggacttcatcgaccaggccatctacgccacccagcccgacggcaccaggagcctgcgctacggcggagacttcggcgaccgtccgtccgactacgagttctccggcgacggcctgctgttcgccgaccgcaagccttcccccaaggcccaggaagtcaagcagctgtactcgaacgtccacatcgacgtgacgaaggactcggtgtccgtcaagaacgacaacctgttcaccgccaccggcgactacgtgttcgtcctgagcattctcgccgacggcaagccggtctggcagtccacccggcgtttcgacgtgcccgccggtgagacccgcacgttcgatgtcgcatggccggtggcggcgtaccgcgccgacgcccgcgaactggtgctgcaggtttcgcagcgtctcgccaaggcaaccgattgggccgaaagcggctacgagctcgccttcggacaggccgtggtgcccgcggacgcgatcgcgacgcccgacacgaagccggccgatggaaccatcaccgtgggccgttggaacgccggcgtgcgaggcgccggacgcgaggtcctgctttcgcgcacccagggcggcatggtctcctacaccttcgccggcaacgagttcgtgctgcgccgtcccgcaatcaccaccttccgtccgctgaccgacaacgatcgcggtgccggtcatggcttcgagcgcgtccagtggctgggcgccggccgctacgcccgctgcgtggacaacgtgctcgagcagatcgacgacagcacgctcaagggcacgtacacgtatgagctcgccaccgcgcagcgcaccaaggtgaccgtctcctacacggcccacaccgatggccgcgtgaacctgcacgtcgaataccctggagagcagggtgacctgcccaccatcccggcgttcggcatcgaatggacgctgcctgtgcagtacacgaacctgaggttcttcggcaccggcccggaggagacgtacctggaccgcaagcacgccaagctcggcgtgtggagcaccaacgctttcgcggatcatgcgccgtacctcatgccgcaggagacgggcaaccatgaggatgtgcgttgggccgagattaccgacgatcacggccacggcatgcgcgtcagccgcgccgatggtgccgcgccgttcgcggtaagcctgttgccgtactccagcttcatgcttgaggaggctcagcaccaggacgagctgccgaagccgaagcacatgttcctgcgcgtccttgccgcacagatgggcgttggcggcgatgattcctggatgtcgccggtgcacccccagtaccatatcccggcggacaagccgatcagcctcgatgtcgacctcgagctgatctgatcagaattgatccgatagtccaccgtgcaaacgatgtggcccccgacttcctcgcaggaagtcgggggccacatcgtttgcacggtccttgttagtccagcggatgcgccggatatcgatgcagatccaaacctagtcgttgtagagcatcaatgaataaagatgtcgctcataagctatcaagagaatccagaacctttttgaattcatatgctcgacacgcaatgtatccagcgtcgtttataatgattcattgtgccttaatggcgcatcgggctatagcgcagtttggtagcgcgcctgctttgggagcaggatgttcccaaagcgttgcgcttgcgacacccgataagccctactcccgcttgggttttaggacttcaactaaaactgaaaaatgaccgccagtaacactcagtaacaatgaccgcagacctccgattttctcggcctatctgagtgtcaaaaatgagtcatctggaggcacagaccgtcttgaggtatgtgtagactaaaaaagttatgccaagtgacataattaccgggccgtagcgcagtttggtagcgcgcttgctttgggagcaagatgtcgcgggttcaaatcccgccggcccgaccacgaaagccctactcccgcttgggaattaaggctttttcttttgcttgaaaggccgtttcggaggctgaaaaagttttactgggttttactgagtctaccgacgcaaatctttccaccttatacttgttaaacaagtgattcatgcgctttcgacgtcgaagcgtaaggatttaaggagtcgatatggaagacgagccactgtaccgcctgataatgcctgacgggatgcatttggccaatcctcaagacgatcccagcgtctatctgggagccttcttcgatgatgaaaaccatttgaaaggacaagcacgttgggaacccgtcttcgacaataccgacgacggagacggcgcagaaatcggcaacgatgacggagacacacctgcagcggctatggctgccgccgcaattgcgattgccgcaatagtcggaaccgcatactatctagcgaacaatgagacattcagaagctggtgggataaaaccgtcgttcattggtgggaggattcagttaaacctacgatgggtaaactttggaacaaagtgactcgtcgttcaaaaaagaatgatgtcgaaacgcctcagccgattgcattactgacttccgctcctgaaacgacaaacgcattctccaaggaagtcgatgacgcgattgaagcatgccagttgcacatggacagcgaggaggcacaaaatcgtttgcttatcatcatgtacaaggcaatggatctcgcaaaggatattcgtgaactttcctcggccaacattcaagaatccgctttcgatgaaaagacgaaactggagttgcgtcagaccatggaaaagctgacaacgcagaacgtgacagatcttatcaacaaggccttggaacggaacattccgcttcttgagaagcaggagaaattcgacgcttggtctgcgcttttagggaagatgaccagtgatggcaaatttgtgcccctacgcagcgatgccttacgaacggcattgagtctagaaccctaccgagcaatgctggaagccccgtcacataaaggcgaataagtaaatgcggtgagtgatactgcgcaagcaacattactcaccgcatgcctatgcccgtcgcctatcaagcaacggcactagttcacttaagccgagtttcccatcattgccataatgcaattgccctcttttcacccatgagcggatagtgttggccggcagacggatccccgctttcgcgcattcagcactcagttgcttggctgtacctcgtacttcgctgacgaccagtttggcaagcagacggtcggctacggcacgacggttcaccttgttgccgcatccagcgcattcgccgtactgttcgtcgggttcgccccacaccacgcttccacaactggggcaagcgccgaacgctatacgcggcttggcggggttgaccgccgtgtggatccgtcgggcaagattggtgatgtcctgataccaagcgagcacgtccccgctcgacagcaagggaactggatccatgatcgcggcgttcgccagcgccttcacagtggcgcgcgggtccacggccttcgcgtagtcgaaacgcaaacccagttgtcgcagtagctgttccgtctcgcagtacagttcccacatgccgtcacgcaacggcgacggtgcctgcgccggcgtggaatgcctgttgccctgtatgctgacgctggcccgtttggtggcgaccaacagcagcggcatggcatcctcacctatcatggcgagggcttccatgagccgtcgctcgcactccttgcacagcagccttccagcaacagtgctggctccgtcattgttcacgcatggccctgtcatcgtcgttccctccgttcaagtgttgtcttaggtcttgcaggctgtcggtgtcatatccgcacgagcaccaccagcgcagtccgtggccggtagattcggtgatgaccagatgcggttcactcgtggttgtcatcgtcgtgtctttcgttcatggcgcggatgtgttcctgcatggcggtgagcgacgggtagttgcggccgcacgagcagacgtagatccgcccgtgcttcgcggtgtccacgagcctgtgcctgatggtgggtgtggggtcgtcaaggaatgccagtgggttgctcatgatggtttctccgatcttgtgttccagatggttggcgaaccggttggggtcgcgtgtgacgtatccgcattggcagacgcgcatgtatccggcggcggtgccgaacccgaccgtgagggccggtgtgcgcagcgtggccagtaccgccggcacgagtttggcgagccgatgcgtgtggatgcttggtggttgtggttggtgtgtgatggtcatggtttattcctctaggctgtctcgaaagcgcttatctcccctttgctgagttgcggtccgttccatttggacgctgccgtgcgtttgggtggtttgaatggcttcacgctgatcggcgtgcggaagcactcgtgggctgcgaggtacatgccgtcaggtttgatgccccgcgtgccgcatggtgtgcgcagtccaatcagcgtggtgccggcgatgggctggatgcgcgtgaacctgcggcccaggatgatggccacggccagatccgttgcgtccagtacgccggggtcgtaaatctcttcgatcggccctccggtgtccaccgccacccattcacggcatgtgccgcagcgtctggctgtcaggtgcgcggggttcgcgcccgacgggcacaggagtttgagccacggtggtttccgtctcggcatcatcggtcgcctcccagctggcggcggatggtctgccagatcgtctccaactcagattccttcagtccgctggtctgtccgcgctcgaacagatcacggcgaatggcctcggcattgtcggggtggttcagcagtcttccgtaggcccacgcgtgaaggtcgttgttccggcttccggccggtatcggcgtcatgtcgggtttcccgttcgctatggatccgaccgtgacgggccggcgcattagctcgctcaatgacgggatccgcgccgcatgctccggcttgggcgtggaagcttggccatcgggttcggtcacgtagccgtggtcgatcagccatcgcaccatcctgggcggcatcatcggcggctggccgtctggtaggtcaagcagcaggtagtcgccgccggatatatgactgcccgctccgaccacgtagcccttgccttcgcagcggatgtctaccggcatgcccttctcgtggacggcgttcttcagccggccttgcagttcgggcgggatcaggtagtaggcgtgtgcggagggcaagccgttcctgcggccggtgggtgtgcctacgaggtacgtcttcgggaagtcctcggagccgtattcgccgatttcgcggttgaagacgtcccagccggtcggagcgtctttgagcacttcgccggtggccggatccttggccacgtccagatcgatgaccgccatgcccgcaacgggaacgaccgcatacgcggccacgcccgtcggcggttgcttgccttccggcagcgtgcggtttttggcccagtcgtaggagcgtttcccctcgttgaccgtgccgaacgtgaccggatagccgcaatcgtccggcgtgaccacggtgcctccctcgatgggatccggcaacggtggcaccgtcttggctgcgtcttcttcctgcatggcttcggtcatgtccttggcggtgccgtcgcggtacacgctgaacacgcgttcgttcctgaccaccagcacgcgcacgacctcgccgttgatgcgcttgggcttcgatttcagaccgagcttcgtgacggtgttgcggtgcgccatgtcggtctcgtggtgcgggttgtcgcggctgacggcgtacccgttcgccacgatgcagtccacgatccactgctgcgcttcggtcaggtcgtcggcggatccgatgacgacatcgttccagggcttgtcgccacgcacctcccacaggcggcatgaggccatcaggaacggtgctatgccatgttcgtcgcggaatttcagcaggtcggcgaattcctcctcggctcggccgtccctcatgcgcacgaacacgcggcggcgttccaacgcctcggtcatgctcatgatgactggattgttcgatgcgatgatgaacgtggccttgttcttgaagctgaccgcgttctcctgcactcgacgggcgaccatcgtgtcgccggtgccgatcttcttcagcagggtagcctgttccagggtgatggtgtcggcatcctcgtcgtaggcccacagcgcgccgatcagcttcagagtctcctgatcggtggcgaagccgccgttgccgttgcgccctcccagcagggtcttcgacgtgaccgccgcagacagttcgggaaggctgcgatgcagtgtgtccagtaggatgcccttgccgttgccgccgccaccgtacagcacgtagaacagatgctcgtatggctccaacaaaggggttgcgaacatacgtcccagattctcggcgctgtggctgtcggcggtgacgaaatgcaggaatctgcctgcctgcgacaccagttcgtcggagtagtcaacgtccacgaacgcaccggcgtatggccgctggtctacgtgtccgccgcgttcattccccagatcccggccgatgtgcgtgccaactgcggtctgtgggtggctcagtacaccaacaacaatcccaccggctggcagtcccgaccgtggaactacggcaagtacggcgaggccatgcgccagtacaccagcaacgggcgcatcaacggctacaacggcccgttggatctgaactacttccgtggcacccgcgaacagtgggacaagtacgccaaccccggcaaagccaccaagccgactccgacgccggctccgcagcctgcgccgagtgtggactacgaggcgttggcaaccgcgacgatccgtggcgattatggcaacggcgaaacccgcagggccgcgttgggtgcgaactacgggccggtcatgcgcatcgtcaaccagaggctcaacggatccgcagcatacgcgcctgccgcttccacccggagcgtgagcgtgaccgtgcgtagcggtgacaccatgtccggcatcgccaagcgaaccgggctctggccgttgaacgcgtggagcgtgccctccggcaacatcaacctgatctatcccggcaacatcgtcacctaccgaggcacggcaaccgccgccagcggatccgcagcaacgggaggtcgcgtgcatgttgtcaagagtggcgaaacgttgagtggcatcttcggggccaatggctggcagcgcgtcgcccagttgaccccaatctgatttatcccggccagcggctccgctactagccaaaaccatcatggccttcggcaccgtgccggaggccactttcatcatcaatattaaggagaaacctatggatatttccaccgcgaccaccctcgcgtccgggctcgtggcgctgatcgtgcccgcgttcgcgcaggcgttcaagaagtacatccccagcggatacgtcggactagtatccctcgcagcatccatcctgttcggcaccatcgccatcgccgccacaggtggattcgacggcacctacacgtggggcatcgtgctcgcgggagtagtgggtgttgctcagactgtgtacacgctcgtcaatcaggcttttgatggcaagcttgccaagaacaagatggaatgataaattgccctgacttcacctacttggtgaggtcaaggtaatttatcaatttggaagctatagaaacccctagggctagtcgttttctagcatgctctagttttatagaacaaatgttcgatgatgttggtagaatgaagcacaacccaagagagagaaggtgctgcatgaatcctaccgtcatcgctgcaattatcgccgcagccgcttcgttgggaggtccagtactgtcatgctttctatcgagaaaagcagaggtcagggcgcaaaaagctgaagagcgagcggaagctgctgaaaaaagagcagcggcggcagaacaacgagcggccgacactgcgaaaaatcagcacatggaggatttcttaagcttttacacgccctatgtcaaagcttgcgaggagttgttgtccatcaacaaaagattgggcaattatattctcgaacagctgaaggatgtgtaccactgggaaacgctttcccccgaagagcaaaaacgtcccaatcccaagattcatgatcgaggaacgacgataaatactttatggaggcatcgggatcaactgttgagcaaagcagacaaacttcgcgataaaggcctaatcaagttcggaaaggcctctaaagagattagagaattgcgctctgcgtcggactttgttgggtgcatgttgccacatctatacgatccggatacaagcgaagaaaaggaagacgatgaggcgcgtttggagctcaaacgatattggaaccttgagtctggacagctgggcgctcgcgcagacgatctctttgaatttgcaagagctgccttgcgtgacacagaaacgagactgctgtttgattagcgacagattgtttctgaagagctcaggcgtgcaagaatctgcgatggaaagaatcagcagttgcgctctcaactagctcgcaatcacgtttgttatcggcgcccactaggtaaccaaacgcgcaccttaaggattgacgcctgagaaccttgctgccatttagtagtattgtactatagtagtataaatgtataagtgcgaggaaggctgaagatggacgtagtctcgaatgtcgccagagcgggcgctgacgatgacccctgggaagtcacgtctgtgaaaatgagacgaagcactaagcgtgcagtgaagctctatgccgtcgaacacgacaagacaatgcaaagcgtgctcgaagaggcgcttcaacgtcttcttgcggaaaagtccatgaaatagatgtggaaacgatatgatgtctcagcgtgtaagttcagataaaggagaagctaaagtgactcacggaaacgcccctacgttcatcgagctattcgcgggttgcggtggactcagtttgggtcttcggtcagctggcttccaagaagttctggcgaatgagctttcttccatgcccgctgaaacttttgctctgaacttaatgaatgtcgatatgcgttcacctgagtttcaggcaaccaaacctgaaaatcgtaaagtcttatggatcgacccatcttccgatgatgtatcagaacgtctggtggacaacccattcgagcgcccggaaaccgacatgccagaattgtccggcattgacgattttgaggggaagcttgttgtaggagacatccgtagactgaatactttcattgagaaacgtggaagcgctttgatacatggcgaggtggatctggtttccggaggtccgccgtgccagagtttttctttggccggtcggcgtgagctgggcaatcaacgcaaccagctaccttgggaatttgctaagttcgtcgattcgcagcgccctcgtatggtactactggagaacgttgaaggcattctacgtccgtttaagcaggatggcgaaacttattatgcgtggttcgaggtgtgcaaggcgtttgcaaatatcggctacgtaacgtgtccgatgcttgtgaatgctcgtctggctggcgttgcgcagaatcgccctcggttcattatgttggcaatacgcgaagatttggcggacaaccttcctgactctgtagcagcatggtttgcacaaggccatcgtttaatagacgcaattaaagccggcaatcctgttttcgacaaagaaaagtggcgctattggaatctaaccgatttcgatgcggacaaggcggaaggcacggttttcgatcctttggtcgcgttccgggattcaggaagacagcgcacggtttacgatgccattcgggatcttcaagatgagaacccgcctactcgcagcaagtacgttagggaaatcaactcgacgctcggtgcctatctggatggtggaagcaaaaagatgcagaacctcaagcatccaaatagcacgccgaaggttcaagctcgttttcgcatttatcaggtcatcgccaactcacccaaatcggttggggatgaaatcaaaaagattatgcgcaagcagaagactgatatttctgaagagacttatgagacactgttacgctctgaccttcttggatatgggaatggcatccctgagactccggaacaaatggttcactatttggagggcatggcaacacgcaagttctctcaaagggctctaatcagcacacttccggcacctgctgctttgtctattcccgatgatgtagcgcattattgtgagccacgcactctttcggtaagggagatggcgcgcattcaatcgttcccggactcttttgagtttcgaggtatagccactactggcggtgagcgtagacgctatcaggttccccaatacacgcaaatcggcaacgcggtaccgccgctgcttgggcgtgcattggggaaggttgtgtcttctatactggctttgctctagaagacgaattcctcgggatcagagaaaagaagcgggaaattcttcttgtccatcttgaacaggatgccgtgatctcgccatttgccgtccgcgtcgaaatgagcggcgagatccagcgtcactttatccgcctcgattagcggagccagcagcgatacgttcgggttcttcgtgtgcattacgcgcacgtaccggaaatattcaacaccgtcgattatttccgatgttgcgccaacccaaaaagtctcagggtgcttggtccgcaaccgatccctcaatagtttcatggtccaagacgcgacatagctgcgcttgtcaccatcctgatatttcatgtcaagccggtcagcgttttcattaacttcgagcaccaagccatacgcattcgggcgggagactcggaaagtctcataaagttggagccttgcttcagaggcaccacgaggaacctgcattttaccatatttttcaacaatctcccggtacggcataccgacatccggcacctgagagaacagggtcgaacgagtcggcgtgcgcaacttgccattccgactcaagcgagtagttttgagctcgatgcccatatagtcaggattcttggagttgttacgctgaatgcctagagcatgctccaaagtatctcctacaccgggatcgcctggagtgatggaacgctgcggaccggccgcgttgatttcacgaatcaatttaagcaaatgttgctcgataacactgctcttatctccggattgcagaatgctatacgcgtagtcctgatgcagaagcgagtcagcaacagcggggtctgaaagattgaaaacataaatagcttcatcgataaccgtcagagcaagtaaattgcaagggtgacagtgcttcttgaggtcgtagaaccaaatgcgcggatcacccttcttagtgatgggacgatacagggaagcctgtgtctcaatcagtccattcgattggacgaagaacgctgggacgacgtgtttgttgtcagagccctgaggctgcatctgaaagtcgtggacatgggaatcgtatagaagatcccgaaccggcgcaatggcgtccatgattgattttttgtatccagtgggcgtaggaaccagaaacgctacaggagtgttgagtctggcaaagaccggcgcaaacctttcaattggagtatcggacatgctaagcatagagacctcatttttcatcattgacgcggtacagccataatcatacgagcaaagaactcgtaaccttggaaaggcacagcgttgattcacagccttactaagaagaacagcccatttcgcgaggaggggaagatgtgcagttcatccattcctgattactttgatcccgtcgatccgaacttggatccagagaaagcattctgcctcgaaggagtcatggacgcccgcatgctgtggccggaagatgccgaagagcttatcgagctaaccaacgatacgccaaccttggaagagctgggcgacccgtattatttcgataagttgcgagaaaaggtgagccggctgggtttggagccgaacgacgggcatgatttggaaggtgcgttgggcgagttctaacagaccgattgagctggttggcgtttgaactgtgatccgtttgagtgcctgcggatccgtcatatggcacacaacatttctattgcctttgttcctactgataaggcaatgttctcaacactcttgcgattgactgtctaagcctgaaacattggaatacaaggtatatgaaagaatcaagtttccgcaagcaactgctttcatcagctctgcaagggcacatacattgactgcgatctctcgctggtcagggtcatagtcaggtttgggcaacagggctacggcgtctcctttgacaacgttgttcgcaagagcgcggtctacttcatgatcaatgtgttccattatccaatgatggcagatagaagacagctggattacgctactgtctcttttcctcacagattttctcttggtctttccctcggtaaaaatgtcgaaggaatggctccgtttgaggatcaatccaagcgaatctgagaagcgtttcgacacgccgaagaacttagcccgtgccacagactgacttgaatacaatccgttaacaatgatcgtcacggtgagccaatcccagtcggctcaacaaagacaaccaaaaaccagaaaccgccattttccaacgatattggccccagcaaaagccatttaatccagcaaagaaacaccccgcgaaaacagaatgtcgcaggttcaaatcctgtcagcccgaccggagcccttggaaacattaggttttcaagggttttgttttatccgcgtgaagccaatcgacacgatacgacacgacacgatggatgcgcagcatcctcgcctaggggttattggccaaatccctccccgctgtttttccagatcagctgtagacaagctggaatgcagatatcataatctcacctgtttgtgctgcgtgaatcttcttcttggcaataagttctggcaaatcgatggctctatccaagatcgccgcgagatcacttccatccatcaacaggacatttggacggtgcctgtgattattgttgattgcccgtttcgtgaaaccgctcatggaaataaaaacacccaaggtattgtctagtttgttatcaactttatccgaaaagatgactacttcaggagcgtcgatcggtttggattgccatttggcttcgagaagatagtccatgttgtccaatgtgaatgcgccgtcgatctgttcgtcattgatcttataggagccacgagtggtgatatcgaatgtttggaatagcttggttagaaatttctcaaaagcgtagccccgcgactgggcgtctgtcatctgagtaatcttgccaaattcactcttgagattgacaactgctgcagccatggcagcttccgtctgctggcgtttctcagcagcgatttttctcgtctcagcggctcgattcgcttcgtcattttcgataataggtttcatacgagcagcaaagtcccttactcgttcaactgcttcgtcatgaagctcttttccattaccttgaactttcagaagccacgtagggtccccaagtttggcaacagcaactgcaacctccagcagctcttccgaatacaattgcgggttcattgacatgccatcaataagctgtgaaataagagttcgtttatactcatgatcccaatccagttgccctataagcgtctggttaacaccgcagttaagaaggaatcgtcgtaaatcgttcttataccagaacgctgatctgagtgtttctttaagcgccgcaatcgttcccggggccagtactcgcaatgtcatatatcgagtataaagcttgcacaaaacccaaaaggaagcctgtgcctaagacagatggctatttggagctactccatcgaactctcaagaggctggagactgcggtgtttgacgaaggtacgccgccgcgtgatttggcgtcgttgactcggcggctgcttgcggtgagtcgggagattgagcgtcttgaatccgagaatggcggggtcaacgcatcgaccgcgacagaagtagaggctgaaccgtttgttccgagcgaggtctagcgtcggaaccgaccggcgcaggctatctgaagtggcctggtttttgttccgcctttatagtgaggcggcttgcgccgcttgattcgtataatactcggtttccaccgcttccggtgtcctgtagcccatggactggtgcagccgtttcgagttccaccacgagacccaccggaacgtcgccagctccaggcccttcagatcatggaagggcctgcgccgccagacgagcccggtcttgcacgcggcgtcggcggattcggccatggcgttgtcgtaggagtcgccgaccgtgccggtcgacggcagcatgccatattccatcaccctggtggtgtacaccgtgctggtgtactgcacgccatgatcggaattaaaccgacatcggtttaacagtgacaggggttgccattaccggtggccggaatggatccgcatctgcaccgagcacgggctgacccggtcgatgagcgcgaagggctgttcgccggacaatgcggccgcggaggggttcttcggccgtctcaagcaggagttcttccacaagaggagcttccggggcgtgacgatcgacgagttcaccgtgatgctcgacgagtacatggtctggtaccgcgacaagcgcatcaagaccgaatacggcatgagcatcatggacaaacgcatccagctcgggctcgtcgcctgaaaccatccggtacactgaccaacgaccatacagacaacgaagtccaacaaaacgtcaccacccccaaaccatcagcccacactgcggaaaaacactgccgaacctgtcgaacaaacattgaagcaaaacaaactcgacaccgcggccggcaaaccggccggcatacgcaagctcatccgcaaatacagcgcgtacacgctgctcgtattggacgaatggctcctagacaagcccgacgaacgcatgcgctccttcctcctcgaggtcatggaacaccgctacgacaccgccagcaccgtgttccgcacacaataccccgtcaaggaccggcacgggcggctcggaggaaacgtgaccgccgacgcgatcatggaccgcatcgtccacaacgccatcaccatcgacaccggcgactacaacatgcgccgacaccaggcgaagccggctgaaagcctgtgacaatcagctgactgcgcaccaccggtggccttcagacagaagaccacaggccctcaatcacaatacccatggccttcatccgcaataaccagcggccttcataccatcaaatactcaattacgatatacgaataatcttgtgtccaattagttccacaagctatcgacgtgctacagcataaccggaaataccgcaattcgggtttattagctactaagagaaaccccaatacttacgagaggaaattatgcggcggcgatgctctttctgaccatcgtacgccattggacgcggctaataggagaaacaatctggaattgtaaagacctcaggatcgtaagggcctctctgtccagggtcaacaaactacaaattctgcgatcctgtatcatacaatcaaagttaattcgttctaaaccataatgatcgaacaatctctgtaacaaaccgccccaccggctaagcatctctatcaggttgctcggcgacgccatattccacacagtcatatatcttttatccgaatacagaggtatgcactgtgaagctctgactatttccgccttctttatgcccgtttctttggaggcatccgctatatgccaaacatatgcgtatggcggatcatgcaggatacatcggattagctccaacatatcataaaggcgtttcttggaccctttatcgcattccagagccgcgctagcgaacccagatctttcaccaccttcacaatgtataatccgaagctcatgtctttcggtatccactttgggccagctccgattggctttcatcaaaaggtttagaccgtcaataatctcattgatacagaactcagacacatccttcgtcaaatcactgagcactcgtatatgaatatcgcaatccgtcttctccgtgaatatatgattcacccaacgcgcgccagttatcttatactcagagaaacgaagcatacaatcatctatatttcttcgtgcactactcaactgagcgagcatctttaattcatctaatccaatgcggcaatgagtgcttccacaactaaattgtattgtcgatatcccatatttaggaaatacataacacaagcggtcagaccaagattgaaagcgagcgaaagtgccaggaggcaatgacctagcaccaacgtcacctccaacttcaagaggacagcagccaacccctctcccattctcatcctgcagatcaagaccattactctcatttagatagctttgaaacgcatagcacaaagacatcaaaatggcgatggccgcacggtcataagcagattgaaaatcagcagtcgcctttccgttcacatcggcctgcaacacgcagcaatcagcaacatattcattcgcgctgtcagaaggacgaagattaaactgacatagggccacaccaaaatgctccatatatgtcaggtgctcaaaatacttctctattgcaacaccgatttcgccataaagcgttcgcgcaagctcaatgggaattcttttaccttcatcccggattacgttcatggtcacggacacggctaatcaactccttcattaggcaatcagcagctgcagaatcaaacactgtccgagcatcgaccgaatccgattactgtgacctctccgcccgaatcaatttggccatcgaacatcatgccccaaacaatcatggcatcaggttgaacgcaggcacgtatctcatccacagcacgcgttactttctggagtttttcatgagccgaacaagcgaaagagatgcagacggcgttcatcatcttcaacgaatcatttgagaatgatgccattgcgcgcttcgcggcctcaactattccatccgtaccttctgcttggccagcgccggaccaagccagatcgttgccgcccatcgccgctttgatatcggaccaatcaacatgtatgtacgaagaattcatatcagatatatcatccaatacccgaaaaccagcgtttaactttttcgccatctgcaactcttgcttgtccattttgactccttatcgagagctatcaatactcctcacaatatgcacgacaagcaatcaacagtagatatctaccggaatattgaagatgaacaagctactaacgtttagctgaaaacgagtcagttaccgaggccccggcattgatcacgaaatgtgaataatcctgtgtccaatgagccctacaagccatcgccgtactacagcatatccagaatagcgatgttctagggcctcggcgtagagagcttgttgttgagcgtattcggtgcggagacgctgagaccagtctttgactgtttcacccgggcgcattttgtcggttttgtagtcgaagagggtgatggtcttggcggttggatcaaggaaatagccgtctatgatacctcggaccacgattgtgtcgtcacattgctcagcaacgttgccgctgtcattcttcgtgttgggcacgccaccagccatgccgctaccgttcaccttggcattaagccggttacgttcaatcaacatcgagaatggctcttcccggaacagagtatcccgatgagctcgtatttgcgccgatagcgggcaattttctccagtgacaaaccagagcaagccttccagctcgcgagtcagcacaatatgagccacttgcggcgtgatgacatgattcgcttccagacggtcaacaatgtttctcagctcggcttcgcactgctcacggaacggctcagtaccccaatcaaagagttccagtacattgtggaccgcagtacccacctccgaagcagatggctcaacgtcggataccttcttcataaagtcaggaataaagaacccactatgcgcttcccgcctttgcttccaatcatctagattgtcttccagcatggcaattggcgcagccgcgtcatcagacggcaatacagccagcgaatcagtgtcatcagatatagattccgcatcatcaatcatccagctgcgagccttggaggaactcactaccactggcatgcgcggaggctcatcaggcaatcgcaaaccagtcacatcaatacgtttattgatatagccatacccgtccgttcgctcattcatagtggtcgtcggctcaggcgcagcactgcagaatcgaatcgtaatggccctgcccgtcgccgccatagccggcgctgtttcctgtagtcccgcagcaagattccacgcacggacctcattagggcgaagaatcgcagacgaatcatcatccgcatctccagacgccagcaatgatcctagaatccaatagagataattggggctaccactattcttgaccaccgttcgtggatctatggtgcgtccatcgccgcttagcgagatgccttgagccatcgtacgcaaattcagattgccatcatcgttctttcctggacggtacgatcccgcgataatcaacttgcgttcggcacgagtcatcgccacatagagcaaacgaagttcctctgccgcctccaactccttggcccgcgaatcaatcactgcgcgctggaaagtatccactcgaacatggttacgttggtcaaccaacgataaggcaccttcgccatattcggcaacagccccatcctcattccttgtctgatgagcaatcgtgcgaacgacagcggttctcgatccggtcagcagattattgctggcacccatgagtatcacgacgggccattgcaatcccttggatttatgaatcgtcatgatatgcacggcgtttttggtaggcactgttgaagcttcttcaccggagccactcgcggaccacattgttacggcatcaaggaatggttgcaatccacgctcctgagctacagcaaatgcatcagccttttctacaagcaagcgcaggttcgcctgccgtcgctcaccttcaggcatattgcctgcgaaatcgaacaagccagaaacggcatagagatgccacaacgaatcagacagagagtgaactcgcgcataatcgcatgcggcatcatagattcgcaggaatgccgatatctttgcaagcaacacatcagaagaaagaacagccgattcatcagcttctcccccactctcagcaatccgccgcataacgtcaaatagccagcctctgttatgcagacgaatccgcgccaaatcatcatccgtgaaccccatagtccgtagcaccgcaaccaacggcacatcctgatgacgattggcgataatacgcaaccaatccaaggcgatctgtatctccggctgacgatacaggtctccaacgccctgtacttcgactggaatgccgacacgatatagtcggtcagccaggtcggcaaaatgagtagcgccacgagccagcaccgcgatatccccatatgaatactgcgcgcgaggcccctcgcagagctcctggacacggcgcactatcatgtccacctgtaattcgtccttgccggcgcgaactgtcggtgcagtgtcagtgccgttttcatcagccacaacatcagcactcaagtcaggtgccgcgttactcaccaacaattcaatggcttctgcatcgaatggtttaccggcttgctttgccgagccgatttgcaactgttccttcaggtaatcggtcgcacccatattcggcgtcatcagtcgggcaaataccgtattcacaaaagtgatgatttccggcaccgatcgatagttcacccacaattcccggcgatggctcgcatccgtaacactattgcagatatcgccgaactcctccggcgaggcatcacggaacccataaatgctttgcttcacatcaccgaccatggtaagtttggctgcatttcggctgatttcgcgaatgaatcgattctgcagggcgttattatcctggcattcatccacataaatatatcgccactgagcaccgatacgcttggccacgtcaggctgctgcatggcatccaatgcccagaaagccacatcactgaactccgctacggactcctgctgtttcacaagcgcatactgctggtcgaacgtggtgatgagcgcaatcaatccttcgagtcttcgcgcagcgacctcatcaagcgagtccacttgttcagcggtaaaggccagtttcgattgcaaatcagaaacgatccctttaatgccccgcaccgtttccgccaagcgacggcccagttcactgtctttgggtacggcgattgccgcactcttaagaatggcagttttgccgacagtaatgcgcttgggcagtacgtccaatggattggcatcgataacacgagcacgaactgcattccatgattcgctacgcaagtactgaggcaaatcgcatatcatccgcaatgatttgactaccgtatcttgctgcgcggtgtgcgcatcgtggcagctggcgagcgcctcatcaagacacgatcgcaattcggcaagaggatgttctgccatatcaatccagcctcgaaaataacggtccaaatattcattgccgtattcaccaccaacgacctgattcagcgacgcaatgttgaaccggtatggttcggcgagccggctaagccaaccgatgcggttgggcttggtgagtgccttgtcatacaggctcatcatggtggcgcgcaagtcaccatcatgccggggcccttgcatgttgtccaacacatccatgaaccgcgcgtgcattgagttgcgctcgtcataccacgattcgaataacgcgtcgagtgtttggcctctcagccggttcttcatggcatcatcagcaagaatctggaatcctggagccaccggcaatgtatcggcattgcgatccacgattcttttggagagcgcatcaatagtgctgatttgcacggttggcagatcgttcaaggcaacggagaatacggtttgcgcatggtggcaatcgtgcagaatcgtacgcgccagttcgctgtcgtctccacctaattgatagtccgtatccaagagcacgagtgaacccggctggcatccatgattgcgccgcgcatacagaatggcgtactgcaggttctgttccaagcgccggcgaatttctgcggctgcggcaacggtgaaagtaataattaacgattcgcggatggatgaatgcgcttcgtctgcattacggttcagcaagtccagcagaatatcctgcaagagttgagtggttttgccggtgcctgcggatgcgctgatgacgtaaggcatggtgtttgtcggaaaatcgtccgagagattatccgcatcttccgacctaggtaatgcatcaacatgttctaccatgccttgcctccttcagatgtattattcatatgaagagccgcttctttgagctccagcaatgtcactgctgtctccacctcgaatatgttgccattcaacacatcccacgccatgatgtcggccacatcgctgtaggcaagaccatcacggccgtcaaccaaagaacgataagggcgcaccggcagtttgccgtccaatatgttctggcaggcacccactattttcccgtgcacataatccgctatgccacgaaattcttccgcactcagttgttcgataccgatgccggtttcgtcggattctcctataagcacgccactgttcggcatatcaaagcctcgccatacgtttctgatgcgcatgttctgagcacttgaatcgtcacttggctcatcgaacagactcgttgatccatcgtctgcgctcggcaacatgttgtattggttattcagcgcgatgcgttctcgaatggttgcgctgggtttaatcgggagaaagaacatgcctgctactggcattccggagttgtgctgggcggcagaagcatacgtaaacagctgaagttcatggccgtagtacacatttgaagcgcggccgccatcattgcgagacggtttgccgaacaacgtacgggcagaagacttatagtccagcacaacaatgccggcgctctctcgcgaaatattggtatcgcgaattaccgtatcaatgcggtcgaccttgccattgatacgcaatgcaaccgggatttccttgtccctcgccctaccgattaattgttcccctgaatatggcgactgccatgcaccggtcgttcctccaacgttgccaaatacttgctctacacacgtaggcgtaagcatcgtctgtgcggacgataatgcctcacgttgcgcagcagcatcgacggcaaaatccatcagcgtatcgaccagctgacgatgaatcatacgcatacgattactggaccgcagcacctccatacgcgggtcttcgttcagcaccgtccactgattgcagcctcgatccagtctggaatagtcggcgataagctcttgcatgtctgttgcagtgggctgaggtggtaagccgttcaaatctcgttcgttcttgtgtcgctcgatccaggcattgaccgcatgttccagcactgcatgatagaacgtgccttcaagcgcggcatcaaaagcgaacgcatttgccacgttaactttcaatccgtatttcaggaaatactcatacggattgcgatagtacgtttctattgccgaaaccgatgcattgaacacacgagtcgagatcgaaggatctgcaccatgagtgcgataaacgcgatgcacataatccggcctagtgaacaaccgatatgccagttcgcggtcaaggggacgatactctgtttcaacggtcggcacagcgcgtttgctcgctccgatgatttcgctcgtatccgatgtacccgtctcccattggctgatatatggcgagcatgcttgtgcagcgttacgcagactctttggataggtcatagacaactgctgcgttgcgctggcaacaacaccgttaaaccatagcggttcttgcccggacctacgttccaccgtaccggaaagtacattccacgcttccaaagtcttgccttgggaagtcaggaactgtgacaaatccagccgctcgccgtcatcgagcagaccggtctcatgcggaatcgcaggcaattgagattcactgcaacccagaacaatcacatatctgtatggatgtaaaggcgatgacatcggcaatacgtccacggcgctggcggagaccggacgcgaatcgattgactgcgcggcgagcgtcgaagctagatttctagcaaagattcctacatattcagcaaaataatcgttaccgagctgttgaaccatgtcgtcaaacgcattcatgatgacggtccaaactggcgcggatccttcaatggtttgggcgtattcggtaagaaaaccaaccatcccgcctagagcctcccgcacggttgcgctaggccgcggccgaaacacatcagcggcttgctgaatcagcgaacgaatcttctgcaaatgtgcagcgaacggtatgtctgtatcgatccataccgttgccggattgttggagttcagctgattttcaatgtcatcgattgccgttggagtcaagttcagataccggctgaagataccggaacgcagtatgcgcaggatggactggggttgaagttcgtaggtcgcggaatcaagcagtcccagaatcgcatcagcgaacggatggtcaagcatcgtactggacgcggcaatattaatcggtatcccctgatacgtgaattccgatgcaatttgggcttgatatgaaccaaggtctcgtgaggtgaccagcacatcaccgtatgaaatttctggattgtccgcgatgaacttcttgatggacgctgccgcatagcgcacttcggcagtagtatccggcatcgcacacactgatgtagaagcggatgaagcgaaaatactggacagcgtatttcggtttccatcatcgcgtctctgcaatgcttccagataatccggatcagaaccggcaccaaccatcaccgtcagatgcacgtattgcgcaagtgtatgaactatcctcatctccgaagcgttgaggtgtgcgaaaccgtacagatagaaccagcgattactcccatgccgctgtgcccatgcacatatggtttcatgggcggctccggggaatgtataccgtttacctaaccgttgctccaccagttgcagcaaagagccaagcaccgaaagtcgagcattcgactgatgagcggccagagcaagcacctcttcagcactgaccccatcattatgcaattcaacaatttgcttggtgaactggtcaatagcctcaaacgagtcaccaacctgattacgcaacgattcattatcattcagacacttcgctacgtaatttctcagcgacatcatgctgattgatgggcgaatgtaccttccataatcctggttgccgataatcgagctcatcatgcttgccagagaatggacacccacattcatccccggttccagacgttcgcggaattccggtcggaccatcgactgcagtacttgcttttccacatatgcgcgcaagcttgccggtgtcagaataacgaatcgcccacggcaactatccggaaaatctgcttccgtacatccggcaccatcagaaaggacatgatcaatcagggcatgaatgtcatcacaccctcgctcgggccgtatcaccatgacactcataccttaccctccccagtgagttgtatctgttctcagcatataactgacgcaacaaatatccgggacttcgcgcatgacactttgcactcttacgcaagcctagtgatttcgtagtatcacattgccgtctaagcacacacatattgttcaatcgcacgtcctattggccatttgaaagactcacactggagctgttgccgagtggtttgatcccaatccgaaccattagggacgacttcatctgtactcttttgcgcacaaggacttgcatccattacatcctgcaataaatcaccctgtccatgggattgtgctgctctgtattgcctttccgcctcgataaggtcattgccacattgggcaagagccttcctgcaggggttgacgcaatcaaaagcaccggctctaatgaggtaattgacattccctgcattgcaatgttccaatgaaacacgacgtataaaatcattaaaactgcgataggcactgcccttattacgggttgaaacgatttcttctgccaattgttccgaaatgccccgtatcgcattaaaaccgagctgaattccatatgccgatttctcatcgtcaccggtactggaatacgctgtcgcataatattgagattgattaatgtttggcattcttacatgaatacctaaacagtacatttcttcaaatatactttccagtttcgctctagcgccatcctcgttataactattcaacattgcggtcatgaattcgattgtgtataacgttttcacataggcgacacggtatgcgaacattgcacgagcaacagcatctgcgcggtcggcacctctgctatggcatatgtcaattagctccgcaaaagaggtaagcttctgctgcatcagttcgctcttcattccatccaagaatggaataccggccgtatagcccgcggacagtaagtcatacacacggctctcatccaacgaactgcaagaatcgtcccatacttgcggcacattgcaatccggtatgaatcgaagggcatcctgcaccacctgcaaaactctcgaacctgcaatacggagacgaggaagcccaagttcatcacagccttttgcatcaaacgcggtgctttctgcccccgaaggaaaacgaacaatggacgttacttcggcaaggggcttgttgcaaagagccaacacatcactgcgaacggaacagtcatatatacagtctttcaacccatccgcaatagacttcttggcgttatcctgcaaccaaacctcagccgaggatgcatcccagaaccgttgatatccgcatacatgcgacacatctttcactgccttggcatcgttaaaacggctgtatgcaattacagcagctgcataaccattcccatatcggtcacatagatattgcaatacccgcctggacagtccccgttccgtttgcaaaacagctgtaggaaagactgaatcttgaaaatcagtaaagggtaaatcgtattcgatgggatcaatctcactaatccccagcgcataggcgacaaggctgcgagccaatatccccttcccgggcccgaccaaatgcccctcttctcgcaatcgattcgtacaatatgcgacggccatcaagtattcttcagcatgggtttcacgaatcacagccatttcgtgttgagcacgattccacactgaatccggtatgcttccatacttcgtttgcagccatccttcaacttccccttgaagaatttcactcgacgctcggccatcagcaccaacatgctgcggcattaatgagccatcttccgctacacaaaatccggtatcgcaccgctctgctatgagcaacgtattgtcgcaggcttcaggcacatcggagaacagagaccgcataaccgcagatgaacgcaaataatactcctcgctttcaaacttgaaacgatgaggaccatccatcacatcacctgtttcaatgcatatacgcacatcatgttttagactgtcatcacgctttgcataatgcacatcactagttgcgactaacggcgcattaattcgtttcgccagttccactagatcattcctgatttggtgctcaatggacaaaccatgatccatgatttctataaagaaattatctcgaccgaaaatatcctgtagttcaccggccattcgcaacgcttcatcaaattgtccaagcaacaatcttgtcggaatggctccagacatgcagcccgacccacaaataagtccttttgcaaatgatgacaagacattgttatccatgcgaggataacgcgagaccagaccttcgagattcgccacggaagatgctttcatgagattgacaagaccttcatcggactctgcccatagcgtcaagtgagtaaacagcccaccaccgctgacatcataaggatcatgaggcacacaagtaacacttcttcgagtattcctctctttccacgaattatcccaagatacgcatctcgtatccgtgcggccagtttctggcgttacgtatgcttcaacacccaaaatcggcttaatgcctcgctgacgtcctgctttccagaactccatcaaaccgccgacactgccgtgatcagtcagaccaattgctggctgacctaatcgttgcgcttcactcatcagctcgctcacagtagagacaccatctgccagcgaatagtcactatgtacatgcaaattaacgaaatcccgcataagagcaccgcctccatagtcatggttgcttcgaattcgaatcggctgcatgttcagtttcctgccgcgctacaatcaacggtaattatctactggttcttgaagcagtctcgatactcagcgagaggaacatgatggccgtctcatcgcaacaagcaacaccttccactgcgcagattgtcatcgagattctcgaactgctggatgcgcatacagaccgcgagcacgggattactgccactgagatcagcaagcgcatcagcgtttcggaaaagaccgtacgagggcatctcaaggcgttgcgtgacatgcaaccattcggccgtcgggtggagcatctggagcgtcgagacctgctctctgctgaaagcgctgatccaaagccgggatggtacattgaaccggtgtttgatacggcccagatgcgtctgcttgcggacggcgcggtaatatcacggtctgacagcgaatatctgagcgaccttatcgccaaaatctatacgttcgcgggcaagtcgggccaattgcgcggtctgaggcagctcactacgccaaagaattacaacaccgagtttctcaacaatatcgaaatgctcaacgatgccatcgaacacgaacgagtaattcgattccgttactgcacctatgacattgatggcaatctggttcctcgccgcgacaatgcgggtgaaatcaaagaataccaagccgatccgtaccatctgatgtacaagaacaacaaatactatctgatttgccacatgcatcagcatgacagtctctcgtatctgcacgtagaacgtttccgcaacctttacgtcgaggagactgatcatgcgctcaatcgctcactggatagcttcagtccgattccgggaacgccgttcaacatcgaagagcatatggacgaacgcccttaccccatggacggcgcagcagtaccgattcacctgcgtattaccggcacgctggagcccttgtacgactggttcgacaacgccaaggtcactcaaatcagcgccaacgaatacgacgtgcatatcatggccaacgaattagcgaccttgtggtgggcattgcaatatgccgattcgcgcctcattgaagtccttgaaccacaatccttacgcattatgctgcgagatactggcgaatctttgctagaaaagtatcgagactagctagtcccgctatattctcaccaacgctcagctcttttgtcggcactcggcaatgagggcggcacagagcaaaatgacctgggcgacgaggttgaaccaaatgagcacgccgatcaacgcggcgaacggggcaagcatcggattccgggaggctccggctaatagtcgcgcaccgagaagctgcattgcggaaaccgtcagagatcccagtaacgcgccgagtatcgtgaatcgtccggctttgatgtgggagaccacgcgcagcagcaacatgaacaacgcgaaattcagcgcgacaccggtaccgaaaccggtcatctccaaaagcacgatgccgggcaacgaactgctggggatgccgccccattgcagcagtcggcgtacgatgccgccggacaccgtaccggccgcggtcgaaagaatgaacagtattgcgatggcgatggcggcaagcgtatcgcgtaaccttgcgacgacgatattgagctcgtcgccgcagtcgtcgaacatggcccgtacggcgtggcgcagcgagttcatccagccggtcactgtccaccagaatatggccaacgtggccagaccggtccacgtcaatgcgcttgacatggcgcctagcgcggaagacgtcagaaacgagtcggccacaccgggaatgacttcacgcaccgcgtcaatcagcatctgctgccaatcaatgttgccgaccatgataaggccgaacacgctcaccgcaatccagacgccggcaaaaaaggcgaacagcagaccatatgccagaccattcgccagcagggggccgctccgcgacacataccggtcgagcacgcgcccaggcagcgaacgtgcccacgcgtccgctcccctgtcaatcgcactcttcaacccatgcatagttcaactgtagctgttgccaccgttgttgaaacagcatggcgcgaaatcgcatttagccagctcaaacgatggcaaccatcaacgcccccactcaattgttcagaatcggataccatatgagtattcaattcatccgtcggagtgcaatgtcagcagtcctcaccaactgatgtcttgctaacccgctggccgccctagtatctactgtttcttgtggtcttcgttcaacagccagtcaagcgcgtatatctgtcggatgccttcgtgggagtagggccgttcgtcatccagcgtaatcagcgtcttgggatagttgtcacgcacggcgcgcagcgaggacggctcccgatccagcgtcgccgaatcgtgcaccgattcgctgacctggtagtaccgacgtccgcctggcccgttcgtgacgaagtcgatctcgctgccggagctctgtccgacatacacgtcgccctcgcggcgcatcagttcgaggaacaccacgttctcgaggaggcgtccgatgtcccgcacgttgttggagcacaggatacgtcgcatccccaagtccacggcatagtacttcttttcctgcttgagaatcctcttgcccttgatgtcgtatcggtgggccgggtagaggatgaacgcgtcgtaggccgcgatcgtcgtcggaacgggcacggtcaacgactaggaaacggtttttatcagcaggagattctgcaatccggatggcatataccgcccggcttcattactgctttggctcatttctgttcacttcacgctggagtaccgagacacgttgagcggaaataccggtaattcacgtacggttaccgaccattggactgaatggtactcagcatccgcagtcacttggggtatggtcatgacggagagccatcatgaccgatctctcgttattctgggatgaatccggcgaagccggaactgaatctaaatattaaaacgcatgatgcacacgttgcggaattagtccaccagaacttcggcatattcggcaggttcagcgggttcgatatgtcgggcacgcatggcatcgagggcggcagccaagtcggccgggtactgggaccggaccgtggtccagacgcgggtgcggggatgacggaattcgagcttcatggcgtgcagccactgccggtcaagtcccaaggcctcagacagcaccggattggcaccatacatggggtcaccgcacaggggatgcccaatcgaggagaaatgcacgcgaatctgatgagtacgtccggtctccagattcacggataccagagtggcctcatggccgaaacgctccagcacatcccagtgcgtaacggccggtttgccggccggagtcacgcagaagcggaaatcggacactttggcgcgcccgatcggtgcctcaatggttgctttgttctctttaagaccaccctgcacgagcgcatgataggttttctttacctcatgctcggcgaactgccgacgcatctcggtgtacgcaaggtcggacttgcacaccaacatcaagccggaagtgcctacatcaaggcgagaaacaatgccctcacgcccggccgcaccataggaagtgatatgcacgccgcggtcacgcagtgatccgagcacggttggaccggtccagccaaccgaggcatgcgccgccacgcctacaggcttatcgactacaacgacatcatcgtcttcgtagacaacggccatatcagttgcgataggctcaggctcggcctgttcctccgccaaatcaaattcgacggtctcccccgcctgcaatgtgctggaccgcgcaacttcacgtcctaaaacgcgcgcctgcccggagtcaaccagatcggcggctttagatcgtgaaatacccagcattttggccacggctacgtcgaaacgcttacccaccaatgcatcgggagcagggactattcgactcattacttggcgtccgcctccggctcagactgtagggattcgtcggattgctcgatgagatccttgtgtgagaacggctcccccataagaatcagaatcaccagggccacaccggcgactaccagatagatatccgccacattgccaacggaccagccatagttaaggaaatccaccactttgccgtcgaggaagccgtcagcgtacataacacggtcaatcaggttgcccagagcgcctgcaaacgcgaaagaaatcgccaccgaccatttcatggagacagtgcgcaccccagccacagcaagggccacgcaagccacaacggccaacagactgattacccaagtagcgcctgatcccatgcccaaggacgcgcccggattacgcaccaaggtgaaggacagcagtccgggaatcacgcgaatggtctgaccgttggataacgcggccatcgcccaagccttggtgagctgatcgacaatcagcgcagccgcggccacacatgcaaagacggccacgtgggtgcgcagccgtccctgttggttcgtcatacgacctgtacctgcctacgctcagttggtcttggacgaggtctggtcgacgtagttgttcgactcggaaacctgcgatgccagctggccgaggtactcggtgaggcgggcgcggtattcagtctcgaactgcttgaggctctggatgttgccctcgacgaccttggactgagcctgaaggttgtcgcgcacctgctcggcatacgtatcggctgcagagcgggtgttcttgtcgtacgcatcagccgcggaacgagtgttcttgtcatactcggcggcacgctgctgcacttccttctcgtagttgtcagcgtcatcgtgctgagacttggagtagttgtccgcatcctgacgagtcttgacggagtatgcgtcggcctcagaacgggtgttctgggagtaggtctcggcatccgcgtgagtctggtcacggtaagcgtcggcctcggagcgggtacgatccgaataggtgtcggcgtcggaacgagtacgagtggagtagtcgtcggcctcggaacgggtacgctcggagtagttgttggccttggtgaccagatcgttgtacttgttctggctggcctcggtgatttccttggccttgttcttgcccttctccacgtactgatcgtgcagctgcatagccagggtcagcatggcggtggcgcgctcgggctcggtgcccggcatggaagcggcgccagcgatcttctgcagagaaccggtctcggtgctcggctcgaccttagaaacctgagcacgaagctggttttcacgctgcttggcttcttcgagctgacgggacagctcagcgatctgagcggactgctgctgagcggcggaaccctgctgctgagcagcggcgagctgacgggacagctcctcgttggccgcgcggaactgatcacgttcctgctgaatggcggcgatctgctgaccgacagcctcctggtcaccggaggcctgagcagcctgagcggtgagctgatcgatttgagcgttcagctgatcgacctgacccttgagctgctcattctgggaggacagcgcgcggttggattcctcggcttcgctgagcttggcagagacaagctgtgctgcctgatcattgccagcctgaacggcctgctgggcctgagccacagcgttcttcaaaccagcattctccgactcgagttgctgcacctgaccggtaagatcggagatcttcgcattaaggttggtcacgtcaggacccagagtctgggtggcctgaccgccggctaccgcctgacgtccaagagcctcgacggtttccgtgacctgatcaaggaagtcatcgacctcgtcgacatcataaccttccttgaatcgaacagtctggaaggtatgctccctaatatccttcggcgtcaacagagccataaatcttgcacctcgctttggggcatcgcccgcacttacgttggtctcaagtcagaatgctatcacgaccccatcgtttcagaacattcgacgtgggtttttatgccagatatatgcctccggcgggtcaaaaacggcctcagaacactatcagaacaacactttccagtaccaccagcgcaaaatacagcacaatgaagctgacatcaagataaatcgaaccgagcggcaatgggcgaatatagcgacgtagccagcgcagagggggttcggtaatggaatacacaatattgatcagctgggccaccacaccacgtggataccagtttcgtgcgagaacggagacccagtccagaatcatgcgcacgaacagaaccgtgatatacgcgttaatgagccatgcaagaatgcggccgatcagagagaacactaaggaaagcatgctgacagactaacaaccgcgcatgaaaagtttgctcggagcacaataagaatcggccgactccttgctgggagtcggccgaataccgatataacgtcgaatgcgaaaactactgaaccggtcaatcagcgaacaaatcgtgtgccgaggctggttttgtcggctcttcgaccttgatgttcacctgcgccgggctcaacaggaacacgcgcggagtgacacgctcgagggaaccacgcacgccgaacaccacgccggcggagaagtccacgatgcgatatgccacggcttcggccacaccagtgagattcagtacgaccggaacaccgtcacgcaatgcgcggccgaccagttgagcatcctcatatgacttcggatggatggtggtgattctgttcacacggccaccggggaacggcttggtagtcgacgatgcggcaggcgcggtggttgacgccagcggcgtgaccgtatggtcggaatcaaatgcggacttcgaagccggcttctgctcctcgtcctcctcgatgtagtcgtcctcatcgtccacaacgtcactcatgcccagataggacatcgcgtttttcatgaacccagccatggatcaatcctttcagcgcaggaagtcagggatgtcgagatcgccagccggatcgttcacggcgatattcggatgagcggaagtcggatcatcaaaaggcaacgatgcggagtcaccgatagccggtgtgaatgccggttgggcagtggcagcgggctgtgcagccggtgccggtgctggagctggctgtgccacgggagtcgcaggatcggcggcggttggcacaaccggcgtcaccgtgctctgagtgtcgtcatcttgagcggcgacggggtcaaaaccagcagcaataacagtgacacgcacttcatcgccataagcatcgtccagagcaagaccccaaataatctgggcttcagggtgaatcgccttgcgcaccagttcggtggcagcagaggcctcctgcaacttcaggtcggtcggaccggcgatgttgatcagcgcaccgtgtgcgccttcgatgctttcctcaagcagcggagagctgatggcgatttcggcggcctgcgtggcacgatcctctccccgtgcggaaccgataccaaacagcgcagtaccagcaccacgaagaatggagttcacatcgttgaagtcgacgtgaatataggagttcatcgaaatcaggtcagtgatgccctgaacaccggcaagcagtgcggtatcagcggtcttgaaggcctcaatgatgccgatggaacggtcggaaagctcgagcaggcgatcgttcggaatgacgatcagcgcgtcgacttccttgcgcaggttgtcgatgccgtattcggcggaagcggaacgctgagggccttcgaagctgaacggacgagtaacaaccgcgatggtgagagcaccctgttgatgagccgcacgagcgacgatcgggctggcgccagtaccggtgccaccgccctcgccgcaggtgacgaacaccatgtcggcacccctaagcgcctcttcgatatccgactggtggtcctgggccgccttggctccacgctccgggtcggcaccagcaccgagaccacgactggacttatcggaaagggaaatcttgacatccgcatcagagcgcagaagatccttcgcatcggtatttaccgccacaaattcaacattctgtaatccctcggcaatcatgcgattgacggcattaccgccggcaccgccgacgccaacaaccttgatgttggtcttgtcgttgaactcattctgcgcgatctcgctcacgtttggctcctgtcacttcacggttacacccaagagtagcgcaaacaggctactcttggagggaaattcacgcgcagaatggcgcgtgttgcgtgtattttcagtattttctcagtaactggcgtccattgggtcgtcaccgaagagcgcctcacgctcttcgtgggtggtggtacgcgattccaaccagccatacggcaagtgcaccttcttggcgaaacgcacgcggccgcgcggtttgtcgaccacgcgtggcgggtattcgatagtcgggtcgagcttgccgatctcgcggtccacatcggccaggctctcgcattccataaaggccttgcgggtggagccgcccaccgggaatcctttcagataccaggcgatgtgcttgcgcagatcgtggacggccatcatctcatcgccctcataaaactcggtaagcagctcggcatgacggtgaatcacgcggcagacctcgcccagattcgggttgagccgttcgggattgccctcgaaggcgtttttgatgttggcgaacagccacggccggccctggcatccgcggccgatggccacaccgtcgcagccggtctcgcgcaccatttcgagcgcatcctcggcaccccagatatcgccattgccgaataccggaatgttgaggtgttccttgagctcgccgatgcgggaccagtcggaatgaccgccatagtattcggcggcggtacgggcatgcagggttacggccttgcagccctcctcctgcgcgatgtgtccggcttcgaggaaggtctcatggttatggtcgatgccgacgcggatcttcgcggtgacggggatgcccgccggctcgcatacggcgaccacgcgctgtaatagctcagtgaaaatgtcggttttccaaggcaaggccgaaccaccgcctcgacgagtgaccttgggcaccgggcaaccgaagttcagatccacatggtcggccatgttgccgtcgaccacgattttcgccgcctgttcggtgatggaggggttcacgccgtacaactgcagtgaacggattttttcgcttttggcgaaatgacagaggcgcagtgctttcgggttatgcgccacgagggctcgagcggtgatcatctcggccacgtagagtccatcgggaccatattcctcgcaaatcacgcggaagggccagttggtcactcccgccatcggcgagagcaccaccggggtcggcacggtgatgttgccgagttggaccggggcgatatgcaccggggtcccggggcgcgccggcgcgtccgtacgtgggtcgaggttgtcggtctcgtgatgctcggtgagcactgtttcggattcggattgtgccatgtgattcctaagaaaataagtaggggctcccctgagagaggagccccggcgtctatcgccgccacttcgcctacaaacagcccactgggatgtcttccttacggctcagcccacagaggggagcccaagttgtgcgactccggcttagtacaggccgccggcttcctgaacgccggactcaggccaaggctcaccgcccatttccacaggcttcaggggcacgcgggtgcgcttctcgccgatgcgggcggccacgtaatcggccaccttgtcaagagcgacgcgctcctgggccatggtgtcacgctcacggatggtcacagcgtggtcctcgagggtgtcgaagtccacggtgatgcacagcggggtgccgatctcgtcctgacgacggtaacgacgaccgatggcaccggactcgtcgtagtcgatcatccactcgttgaagcgcaggtcgtcggccaggttctgggccacggtctgcagttcaggcttcttgctcagcggcagcacggcggccttgaccggggccagacgcgggtcgagacgcagcacggtgcgcttgtcaacgccgcccttggtgttcggggcctcgtccacatcgtaggcgtccacgaggaagcacatcagggagcgggtcaggccggcggccggttcgatgacgtacggcacgtacttctcgccggtggcctggttgaagtagctcaggtcttcgccggagtgcttggagtgcgcgctcaaatcgtaatcggtacggttggcgatgccttcgagctcgccccagtcggaaccctggaagccgaacttgtattcgatgtccacggtgcgcttggagtagtgggagagcttctccttcggatgctcgtagtggcgcaggttctccggcttgacgccgaggtcgatgtaccagcgggtgcgggcgtcgatccagtactggtgccattcctcatcggtgccgggcgtgacgaagaactccatctccatctgctcgaactcacgggtgcggaagatgaagttacccggggtgatctcgttacggaaggacttacccatgttggcgatgccgaacggcggcctggaacgggaagaggtcatcacgttcttgaagtccacgaagatgccctgtgcagtctccggacgcaggtagtgcaggctgttctcgtcctcgaccgggccgaggtgggtgcgcagcatcatgttgaagtcgcgcggttcggtccactggccacgggtgccgcagttcgggcagacgatgtccttcatgccgttttccggcatcttgtcgccgtgcttctcggcgtaggattcctcgagcttgtcggcgcggttgcgcttgtggcagttgagacactcgacgagcggatcgttgaacacgctcacgtggccggacgccacccacacttcgggcggcagaatgatggaagtgtcgacaccgacgacatcaggacgggtgacgaccatggagcgccaccattcacgcttgatattgtccttgagagcgacgccgagagggccgtaatcccaagcggaacgggtgccgccgtaaatttcgccggcggggaacacgaagccgcgacgcttcgcaagggatacgacttcatcgagtttggactgagccacaatgcaccttctggtttgaacggtttggggtctaataacaaccgcttcaggatagccgtatatggtgacaggtcaggcggcattgtccggtatatgttccgcgtctcacgagcgaccgttcgcagcgattcctatatcgcaacacctccatattgttcctgttgttttacccttcccgaatttgtgccactgacatcgcgtcagcgtcacaaattcgggagatgttgctcggcggaggcgtctatgtatcacgaatggacggggacgcgccagacctgacgacacgtatcgaacaaatccgtcacgataatgtccatgttggcgcatagcgtcggcactgtaatgcaggggaactcgcatgtggttcgcgagttgagaaaggcctgagcctgacccttagaacctgttggttaagaccatcgtagggagcagtaaatgagcaatagtgcatcatcgtttaccggcgtgtccagcggttataccgccgggactccggttccagccgattcacccatccgtgacaatatcgccgatgccgttcgccgcgtacgcgagacgactccgttggcccagtcattcaccaattttgtgaccatcaatttggttgccaacgcgcaactggcggccggcggcactgcggccatgagtttcctgccggacgacgtgatcgaaaccgcgaaaatcgcgggcgcgaactacatcaacgtgggcacgctgctgccgttctataaggacgcactgcccgaaatcgcccagcgactcaactacttggacaagccgtgggtgctcgacccggtggccgccggcatcggccgcacccgtaccgccattcttcaggccttcaaggccgctcccccgaccatgattcgcgcgaatgcatccgaggtaatcgcgctggcgaacatgtgggggctcaataccgaaaccgtgggggacgcttccgagcaccgccccgccggagtggaatccgtcgacgacgtggagtccgcaaccggcgcggcggtggcgctggcacagtatctgaccgaacagcacgccaagcattcctcccatgacgcttccacccgctgcgccgtggccgtgtccggcatcgccgatctggtgaccgatggcgaaaccgtgtaccggctgccgggcggcagcgcgatgatgaccaagatcaccggtgccggctgctcgctgggcggcgtggctgccacgtatttggcggtctccgatccgttgaccgccgccctgtccgcgtctctgctgtacaaccgcgcgggagaggtggccgatacaacttcgcacggaccgggctcgttccaagttgcgttccttgacgcgctgtggaatgtgaccgccgaacaggtggcgaaatccgagattttggtgcagtagtttcagttccctctgatgagggagctcataacagttttttccaataagacttccacaagaaacaacaaaagcaggaataataatgagtaatgaatacccatacgcctccatgcgcgacagcttcgacctgtccgcgtacttcgtggtggggccggaggactgcaaaggccgtccgctgaccgacgtggtggatcaggctctgcacggcggcgcaaccttcatccaactgcgcgccaaggaggccgatgcctctgagctgaccgacatggctcgcgacatcgcgcagatcatcgaggacaatgagaagtccgattccgtggcctttgtgatcgacgaccgtgccgacgtggtgtggcaggcccgccgcaagggcatcaaggtggacggtgtgcacatcggccagaccgacatggagccgcgcgaagcccgcgccctgctcggcgacgaggccatcgtgggtctgtcggctgagaccgaaagcctcgttcggctcatcaacgagctgcccgacggctgcatcgactacattggcgccggtcctctgcacgtctccaccaccaagcccgaggcttccgtgggcggcaacgacggctccggcaagacgctggacgccgcccagatcaacaccatctgcgttgccagcgaattcccggtggtcgtgggcggcggcgtgaccgcagccgatatggccatgctcgccgataccaaggctgctggctggttcgtggtctccgccatcgcgggtgccgagaacccggaagaggccgcgcgcaccatggtcgaaggctggaaggccgtccgcggcgacaagaagcacggctacgctccgcgcgtcgtaacccacacccccgctactgacactcaggctgctcaggaaggggccgcgaagcccggttccgaggccactgagaagaagttcaccaacgccaaggacgccaaggatgcccagaagcttgccaagcagcagcgcgtggacatcgccgcccgtggttccaagcagcgcgacaaggcgcacatccgcaagaccaagtccgtaccgttcacctatcagtatggttcctacgacctggaagtgccgtacaccgaaatcaagctgagcgacacgcccggcgtgggcccgaacccgccgttccacgactacaacaccgaaggccccaagtgcgacccgaaggaaggcttgaagcccctgcgtctcgactggatccgcgaccgcggcgacatcgaagactacgagggccgccgccgcaaccttgaggacgatggcaagcgcgccatcaagcgcggccgcgccaccaaggaatggcgtggacgcaagcatgagccgatgcgtgccaaggaccacccgatcacccagatgtggtacgcccgccacggcatcatcaccccggagatgcagtacgtggccacccgcgagaactgcgatgtggagctcgtgcgctccgagctggccgccggccgcgcggtgatgccttgcaacatcaaccaccccgaggccgagccgatgattatcggatccgccttcctgaccaagctcaacgccaacatgggcaactcggccgtcacctcctccatcgatgaggaagtggagaagctgacgtgggccaccaagtggggcgccgataccgtgatggacctgtccaccggtaacgacatccataccacccgtgagtggattcttcgcaactcccccgtgccgatcggcaccgtgccgatgtaccaggccctcgaaaaggtcgaggatgatgcctccaagctgagctgggaactgttccgcgacaccgtaatcgaacagtgcgagcaaggtgtggattacatgaccatccacgccggcgtgctgctgcgttacgtgccgctgaccgccaaccgcgtgaccggcatcgtctcccgcggtggctccatcatggccgactggtgcctgcgccaccaccaggagagcttcctgtacacgcacttcgacgagctgtgcgacatcttcgccaagtacgacgtggcgttctctctgggcgatggcctgcgccccggctccctagccgacgcgaacgacgccgcgcagctttccgagctcatgactctgggcgagctgaccgagcgcgcctgggccaaggacgtgcaggtgatgatcgagggcccgggccacgtgccgttcgacaccgtacgcatgaacatcgagctggagaaggccgtgtgccacaacgccccgttctacaccctcggaccgctgaccaccgataccgctccgggttacgatcacatcacctccgctatcggcgccaccgagatcggtcgttacggcaccgctatgctgtgctacgtgaccccgaaggaacacctcggcctgccgaacaaggatgatgtgaagcagggcgtgattgcctacaagatcgcctgccacgccgcagacatcgccaagcaccacccgcacgcgatggatcgcgacaatgcgatttccaaggctcgcttcgagttccgttggctcgaccagttcaatctgtcctacgatccggacaccgccatcgccttccacgacgataccctgcccgccgagccggccaagatggcgcacttctgctcgatgtgcggcccgaagttctgctcgatggccatctcccagaacatccgcaaggcattcggtggcgaggccgctcagcagcaaatcgtgaaggaggctgctgcaggcatcgactccgaggcactggctacggccaaggccaatgtcgataacggcgtggtgtccgccaacgtgctcagccccgaagaaatcctcgccggcatggatgcgatgagcgaaaagtacaccgcccagggcggcaagctctactccaccgcccaggagtaaacctctctggctcccctctctgaggggagccaattattatgcccggtggtgtcttaattcgggacgacgctcgactcgctcgaaggcggtgccgaagtgtgcgccatctggaccgaggccgtcggaagtctccaggaccacgccttcgttgagcgcacggcgcacgatgcccacacggggcttcaacggccacacatcatgcggcactttgcgatagaaatccgtaccgacgagcaacacgtcgcccacatcgaacacttcctgacgcggaaatgtgagctgtgtggtgtgtccgttaggcattacgccaaaatatgcggtgagttccggtgatgcgcaccaagacgccgtcacggcgcagtacatcgttatcagccatgcctcctcccgaacatttcatgaatcaatcgcaatcagcaaaccttccccgtctcaccacaggagcggcaaaacatcaaggaaaaccgctccgaaaaacatcatgggccccacttagaatgaacactatggcacaaattgcaacatctacacttcccgctgttctcgcgatctccggctccgactcgtccggcggtgccggcatgcaggccgatctgaagaccatgctggcctgcggcgtgttcggcatgagcgccatcaccgcgctcaccgcacagaacaccaccggcgtgcgttccattcaggacaccaaaccggacattctcgccgaccagatcaacatggtgtttgaggatattccgccggtcgcggtgaaaatcggcatggtgtctgccactgacatcatcgacgtcatcgctgaacgactcaccttccatcacgccacgaacatcgtgctcgacccggttatggtggccacttccggtgccaatctcatcagtgacgatgccattgcggccttgaccggcaagctgttcccgatggccacggtcgtgactccgaacattcccgaggccgaagtgctgaccgatacgctgattcgcaatcaggaggatatggaggccgccgcccaccgcctcgtggagcgttatggctgtgccgcgctggtcaagggtggtcatggcaccgaggatgccaacgatgtgcttgccgagacggatggaaccgtgacctggtttgatggcgcgcgtatcaataatccgaacacgcacggcaccggatgcacgctgagctccgccatcgcctcgtatctggcgcttggcgacacattgcccaaggccatcaagcatgcgaagaagtatctgaccggtgcactgaaggcccagctgaatcttggccacggctccggcccgatggatcatttctggaagtatcgctgagtcctactggctctcctctctgaggggagccaagtaataaaaggagaattatgattattgaccgtaatgccgttactcaggaagtgccgatcgacccggaaaccggcaaaccgtacctcaataccgtggccgccattcaggtgtcggccaatggcgtgggctccgaggtttcgccatacgtggctcaggccgtcgaggtgattcgcgaatccggcctgccgcaggaaaccaacgccctgttcaccaacgtggaaggcgatctggacgacgtgctcaaggtggccggtgaggccgccaagaagctcgccgagcagggctaccgcacttctctggtgctgcacatggatatccgccccggcttcaccggccagctgaccgaaaagcccaagctggtggatgagatcctcgccgacaagcaggcgaagtagcaaagcatcgcttccaccagcaagggcatgctttgttattacacgtttcatggggcggtagctcacccatggggtggtaaaaccctcatggggcggtagtcgaaaacggctctattctgcggaaaggcataatccgctaaccgccccatgggccaaataccgccccatgagtgttttaccgccccatgggaatcacggttctgccttctttcgacggggtaagagcgtaagtggggcatatataggagcgtcacaacctctgttatcgttcacgatgtgaccgcaacgcggcgtgccacaaaatcgaacctatagttaagccccatgtagtgagctatctcacaacgattggctcgctacgtagaattcaagacttggatcgcaaacgtcgttcatcccacacaatgggagggcgaacggaacacacagtccaatcaagagttcgctcgccgcaacaccattgagcagttgcacgcgggcaggtttgcaagaagagggctcaaatatgactgctgctgaacagcagatttccggcaatcccgcggctatggaaaacgcacaagcacgtaccaccgtgacggatcaagccaaggttcaggatattatctcgcgcatggatcgcgcacatgaaaccccgatgttccatcgcatcgtgacgctggtcgccgctggcatgctgatggacagcatcgacgtatatattggcagcgccgtcgcctccagcacgttggctacccgctggtccaccgttgcgcaaaattccacctttatgtccgcgggcttcctgggtctgctggtcggttcgctgctggccggcttcgtcggtgacctgaagggccgccgcgtggcttaccaaatcaacctgctgctgtttggcggcttcaccttcctcggcgcattcgccccgaacatggctgtgctgtccctgtgccgtctgggtgccggcctgggcctcggcgctgaaatcgtcaccggcttcgccatggtcaacgagttcgcaccgatgaaccgccgtggccactggtgcgcgattgtctcgctcgtggccaactgcggtgtgccaatcgctatgctgctgtgtgcatggatcatcccccgctggtcctggcgtccgctgttcgtggccatcggcctggtggccgccatcatctggtggctgcgccgcgacatccccgaatccccgcgttggctcgccgtgcgcggccgttacgatgaggccgacgccatcgtcaagcagcttgaggccaacggttccgaaccgatcgacgcagccgccaaggccgacaccagcgacacccgcaacgccggaggccgttcgctcggcatctgcctgcttgtggctgtggttgctgtggccgccacgaacgtgtgctcctacgccttcacttcttgggttccgacgattctggtcaagcgtggtattaacctgtccagctcgctgctcacctccacggtgatgatgctcggtgccccggtcggctgcctgattggctctctgcttatcgaccgtatcggccgcaagcgcacgattgtgccggccttcctgttcactggcgtgttcggtttaatgtatgccttccagacctctaccgtgagcgcaattatcgttggcttcctgctcatgatgtgcctgtacgtgcttatggcttccgtggtggctgtgtacgctccggaactgttcgccaccaaggttcgcttccgttgcgtcggcttcgcgaacgccgtggccaagctgctcaatgtgttgatgccgatggtggtgggctggatgcttacctcgcttggtgccacgtccatctttgtggccatcagcgcgattgctattgcatcgatgctgattgtcggcttctttggcgcggagactgcgcagaagtcggttgggtgatcggtttcctcacagtggaataactgctgataatgtccattcggcgtcttgcgtggtgatatgcagggcgccgttttgttgttctagtaattgttggtaacggttgaggccggtgccggtggataggtctgcgtctccagcggacaatcagcgtctgtgatgtcacatgcaatgccaggagcggcatcaacggtcgaatcatgcggagtcactgcactgtgcgccgcttctcccctgccttcaatcacatcaatgacttgatgcgtgcgatccaatgcgcccatagacatatccgtaaccagcacgtcaggccgcttggtggggctcaggcatcggctgatggccacagcacccaaatcgcaggtctatatcacggcaaaatcgctggacatacgttcgattagcgcgccgaacactttcagcgcatatgggtcattgtccacaatgccgatgcgtatgttgcggttgcgcgcttcttccattacattcaccccttcagtgtgcccgacgccgaactactccgtcctgacacgtcatggtcactatgacaactatcattccacatttcctgcgtgatttacgatggaatcatcatcaatccttgacaaggcggtaaaggaggacggcaatgaaccgtgcacaagcactcagcaagctcaacaggagcgatatgcgcaatgccgccgccgagcgcgggatgcaacgactgttcacatggaaccgcgcgcattggattggcatggttgtactgatagcggtgttgctgctactgcagtggagctcatcaatgtatctcatgcccgacgaggttcttgacagggctgccaaaaacctgttcgtatggttccccggtatggttctgcactggccattggtgttgggaatcaccaacttgatactcggttcgacacgatccggcagtctgtctttcccgttggcgagcgcaatcatcggaccactggcattcggctggaccaatcttcgcttacggccggggttcccataccgttcctgggctcaagggaaagccgcaatataatgaaaacagcgatttcatgcaatgatgcacgagccgatccaagcaaaggggccaaccatgagcgagcaactgatggaacagtaccggttgcgcggacaacgcaaatgccgtaacgcttgtatcgccgccatcgtgacagtagtgcttgtccttgccgtcgccggcggcgtatggtggacggccggcgatggcagcgcattggttcgcaatatgttcaagccgaaggccacgcctgccacgcagccggtagtcaacagcaccgcaaccttcgcctaccgcaccgcaccggaattcctggcgatggaagccggcgaccgaggcaccggcaatgtgaactactctcctgcttcgatgtggatggcgttggccatcgccgcgcagggcgccaatggcacgacccgctcgcaactgaacgaactgctgggctccggttcgctgaccgatagcgactaccaatcgctgctaagttcgatcaacgggcaatattcgggggcgaaatccgagatgagcgccgcgaactcgctgtggattgatgacgactactctcttgccagcgattaccaatccaccgtcaagaagatgttcgaggccgaagtcaccacgttaccgttcgacgatcaggccgccgcaaagatgtccgattggatcgccaagcatacgaatggttcgctcaagccgaagatcacgctgcgtgaccgtgaagtcctgtccatcatcaacaccgtctatgcggatggccgttggaaggatccgttcgaagagcagtccaccggcaacggcaccttccacggcgaagccggagatgctcaggtgccgatgatgcaccggaccttcagccaaatggcttacggacatgatgagtacaacacttggcagcgggtggagattccgttcgacaacggcggcaatctggccatcgtgctgccggccgaagggcatttcgacgagttggccggcgatgccgagaagctcagttgggcgttcggtacatgctcgacggcttcccttggcgagggcgcaatgggttgcgccgcggacagtatgcccggatggggcgtctccgtcaactcggtcatggtgaacgtcacgctaccgcgattcaccatcgacagcatgttcgactcggaagccaccatcaaggcattcgaaaaactgggggtgaccgatgcgttcagtgcaggcgacgccgacttcaccaagatgatcgacaccggttcgcacggcgagaacctgtatatcggctcgattctgcaaggcacgcgcatcgaggtgaacgaagccggcgccaaggccatgtccttcaccaaggtcggcgcagactccgttagcgcgccggtggacaacgtcgagttcacggtggatcgcccatttctgtattcgtacgtcaccccggacggcataccattattcatcggtgcggtgcgcaacctcggcggagtcggtggagaaaactgatactttcctggcagtccgtcaattagggtgtatcgtttgacgcatggttacgatgaaggaaatcgcgaacaaggcgggggtttccgtctctacggtatcgctggtgctcaacggacgcgacgaggggcgcgtaaagtccaaaattgcggacaatgtgcgcgccatcgccaccaagctcggctaccagtcgaatccgctggccagttcgctgcgtacaggcaggacgcacatcctcggtttcatcagtgaggaggtggccaccaccccgtacgccggcggtatgattctgggcgcgcagaccgctgcaagccagttcggctatatgctcatcaccgtgagcaccgacggcgagaacagcgagagcgaggaaatcgccgcactcaagcgatacggcaccgacggctttctgtacgccaagatgtcgaaccgcatcacccatgtgccttcctcgctggccaagacgccactggtgttggtggatgccaccgactcgcttggcaaaatcccgagcgtggaaccggacgagttccaaatcggctacgacgccaccaccagattggttaaggccggatgcgcacgtatcgcctatgtgggttgcttggagccgctgattgcgcaggacgatcgtttggaaggctatcaggcggcgctcagggacgccggcctcgactatgacgatcatctggtcgtcaatgtgctcaacaacgggccggcactgaccgcagtcagcgatttgttcgatgccgagcatccggacggattcttctgcttcaacgatgcccgcgcctggtatgtgtacgaatgcgccgcacgccgaggactcacggtcggcaaggacatctccgtggtcggcgtggacaaccatcgcgtgttcgccgaaacgctggaaccgatgctcaccactgtggaactgccgcatttcgagatgggctactgggccgtggccaagctggtgtcgattatcgaaggacgctcgatggacgacgtctcatggccagcgaccaccgctcccctgccgccgatcgacgcgccgattccggcgaagatccactgcacgctgatcgaaaaggcctcggtgaagtaaccgagtcccacacgatttctcaaggcctccgttcagcacggaggccttttgcgtgtcgaacggatacgacacgccgatttacgtcaatcgattgacgtaaatcgattgacgtcgcataataattactacgcaacaacttctacaaaggcacggccgcccgagcagaagcgttacataaccaataaccaaccaagtagtaatcaaaggatgattatggcaagtgcaaccaaatctgcatggaagaatccttcctatctgcagagctctttcggcatcttcatgttcttctgctcctggggcatctggtggtccttcttccagcgctggctcatctcaggcgttggattgaccaatgctgaagtcggcaccatctactccatcaactcgctggccaccctggtcatcatgtttgtgtacggcgtgattcaggatcagctcggcatcaagcgcaagctcgtcatcgtagtctcggtaatcgccgcctgcgttggcccattcgtccaattcgtttacgccccgatgatcctcgccggtggcaccacccgctggatcggcgcactcatcggctccatcgttctgtctgccggcttcatgtccggctgctccctgttcgaggccgtcaccgaacgctactcccgtaaattcggtttcgaatatggccagtcccgtgcttggggctccttcggttacgccatcgtggcgctgtgcgccggcttcctgttcaacatcaacccgctgatcaacttctgggtcggctccgcattcggccttggcatgctcctcgtgtacgccttctgggtcccggccgagcagaaggaagagctcaagaaggaaaccgacccgaacgcagcccccaccaacccgtccctcaaggaaatggtcgccgttctcaagatgccgaccctgtgggtgctcatcgtcttcatgctgctgaccaacaccttctacaccgtgttcgatcagcagatgttcccgacctactacgccaacctcttccccactgaagaaatcggcaacgccacctacggcaccctgaacggtttccaggtcttccttgagtccgcaatgatgggcgtggtcccgatcatcatgaagaagatcggcgtgcgcaacgctctgctgctcggcgctaccgtgatgttcctgcgcatcggcttgtgcggcgtgttccacgacccgatcaccgtctccatcgtcaagctgttccactccatcgaagtgccgctgttctgcctgccggcattccgctacttcactctgcacttcgacaccaagctctctgccacgctgtacatggtgggcttccagatcgcttcccaagtgggtcaggtcatcttctcgacccctctgggtgccttccacgacaagatggctcagattctgccgaacaacgacatgggatcccgcgtgaccttctgggtcatctccggcatcgtgctgtgcgcgctgatctacggcttcttcgtcatcaagcgcgatgatcaggaagtcggcggcgacccgttctacaccgacaagcagctgcgccagatggaagcggccaaagcctgaaaggaccaccatgactgacttcactcccgaaacccctgttctcacccccatccgcgaccacgctgctgaactggcaaaagccgaagccggcgtggctgagatggccgccaagcgcaacaaccgctggtacccgaagtatcacatcgcctccaacggtggctggatcaacgacccgaacggcctgtgcttctacaagggcctctggcacgtgttctaccagctgcacccctacggcacccagtggggtccgatgcactggggccacgtctcctccaccgacatgctcagctggaagcgcgagcccatcatgttcgcaccgtctctagagcaggagaaggacggcgtgttctccggttccgccgtcatcgacgacaacggcgaccttcgcttctactacaccggccaccgttgggccaacggccacgacaacaccggcggcgactggcaggtgcagatgaccgcgctgccggacaatgacgagctcacctccgccaccaagcagggcatgatcatcgactgcccgaccgacaaggtcgaccaccactaccgcgacccgaaggtctggaagaccggcgacacctggtacatgaccttcggtgtctcctctgcggacaagcgcggccagatgtggctgttctcctccaaggacatggtccgctgggaatacgagcgcgtgctcttccagcacccggatccggatgtgttcatgctcgaatgccccgacttcttccccatcaaagacaaggacggcaacgagaagtgggtcattggcttctccgccatggggtccaagcccagcggcttcatgaaccgcaacgtcagcaacgccggctacatgattggcacgtgggagccgggcggcgaattcaagccggaaaccgagttccgcctgtgggattgcggccacaactactacgccccgcagtccttcaatgtggacggccgtcagatcgtctatggctggatgagcccgttcgtgcagccgattcccatggaggatgacggctggtgtggccagctcaccctgccgcgcgagatcactcttggtgatgacggcgacgtggtcaccgcgccggtcgccgaaatggaaggcctgcgcgaggataccctcgaccatggttcgatcacactcgacatggatggcgagcagatcatcgccgatgacgccgaggccgtggaaatcgaaatgaccatcgacttggctgcctccactgccgagcgtgcgggtctgaagattcacgccactgaggacggtgcctacacctacgtggcttatgacgaccagatcggccgcgtggtggtggatcgtcaggccatggccaacggcgatcgcggctaccgcgccgccccactgaccgacgccgaactggcctccggcaagctggacctgcgcgtgttcgtggatcgcggctccgtggaggtctacgtcaacggtggccaccaagtgctgagctcctactcctacgcctccgaaggcccgcgcgccatcaagctcgtcgccgagtccggtagtctcaaggtggattccctgaagctccaccacatgaagtccatcggactggagtagctctttcacctccctctgacgagggaggttttttgtgcgccctgtcgttcgccttcgcctatactgatggacggcatataacacgatccatcacacgaccggcaggcgcgcaggctcctcaccttactgttccacgccccggccgcaagcgccaccagcaaaccggactggcgcggaaagcaaggtgacatcccatgtccatcgccaagcgcctcaagcgccgcatgcccaccgtcatcgccgtcatcgtattgctggcagtctgggaaacgtgggtggatctaggacatgtctcccccacgatgatctccgcgccaagcgagattttcgccgccaccatcgaaacatggaacacgctcggcccggccgcggcaatcaccggctatgagggcgtggtcggcttcctgtttgccgtgttcttcggcattatgatcggcattgcactgtactgctcgcacacgttcaacgcggcgttctatccgctgcttgccgccgcacaaaccatgccgctgatttccatcgccccgttgttcctgatttggttcggttttgagatttccggcaaaatcgtaatcgtggcggtattcggcctcttccccatcgccgtgcagactgtgcgcggactagaagcagtgccccagttctattccgacgtcgcattgacctgcggcgcgaccccggtctggacgctctggcacgtgaagctgcgcgttgccgcacgtcagatctatggcggtatccgagtatctgccgcatacatcttcgccacggcatccaccgctgaataccttggcgcacgcaagggccttggcatctggctgcaggctgcctacaattcattccgcacgccgctgatcttctccgccaccatcgtcattatcctgatgacatgcgtactgatgctggcggtaaacgccagcgagcgcatcctgctcggcccgcccggcgacgacgaagaccccgacgcggaccagtagttctttttttaccgtcaaaggcacgagccggcggtcaggaccgactgaacgaagcggcttctcatgaggtctccaaccctgtctctataatggaacagctttaccagcgtgtggcaaaccggctttcccgagctttcatagggaatgtcgggggcgctggtcgaacggaaatcaaggccctccatatcgttttctgccgacttccgttcgaagcaatcccagagaacgatagagagacaacgaattagggaaccatcattatgaagaaaagccttgtatccaaggccgctgccctcgtgggcgcccttgccatgactttcggtttcgccgcatgtggccagaccaacaccgccgactcctccaactccaacacctccgacctcaagaaggtcactttcatgctttcctgggcacccgataccaaccacatcggcgtgtacgtggccaagaacaagggctacttcaaggacgccggccttgacgtggatatcgtggccgtggcccaggccggtgccgaacaggccgtgaacaacggtgtggccgacttcgccctgtccaacctgaccaacgtgggcgtctacacgctgaagggcgctcacatcaagcaggtgctgcaggtgcagcagaagccgagcgccatttggtgcgcactggcgtccaacaccgccatcaagtcccctaaggatttggatggcaagaccttcgccaccttcggctccaacgagtccgatgccgtggtgcgccgcatgatccaaaccgatggcggcaagggcgaattcgacaaggtgaccgtcggcacctccaccttccagaccatggaatccggcaaggccgatttcggcggcttctacgccacgtgggaaggcgtgcaagccgacatgtacggcccgaagctcaactgcttcaccgagcctgactatggcgtgcccggcaacgccgacaccatcggcatcatcaccaatgacaagaccatcaagaacaatcccgacctggtcaagaagttcactcaggccactcaaaagggttacgagtacgcgtacgccaacccggatgacgccgcgcagattctcgtggacgaagcccctgacgccaacctcaagcccgaattcgtcaagaagagcatgcaggttatcgtcgacggccagtactggggcgatccggccaagatcaaggacggctctttcgtgctcggcaccaacgacttcaagggcgctcaggaatacttcgacttcctggctgaagaagacgcatacaccgacagtcatgacaagataattcatgaggccccgcaggccaaggaccttgccaccgacgaattcatcggcaagtaatttccgatattccgagtttgaatctacgcaaaaatgcgtccttcccatgaggaaaggacgcatttttgcgtatcggccgataaggttattcatagcggattacgctaacaaggagacgattctatggtccaatgtcctgaccgcattattgccagcatagatacgggtgttgatgatgcgttggcgttggcgtatttgttggggtcgacggatgagtgcgagttgggtggcgtgattgccagttatggcaatgtggatgcgaacacggcttatgccaatacttgcgcggtgcttgatttgtttggtcgggcggatattccagtgtttttagggtctgagcatccttcttgggctgatgcgtttattcctgatgcagggtgtgcccagttccacggggatgatggactggggaatactcggctggcagggtccggggctctggctgatggagcttgtgtgcctggtgatgatatgtctgtggatgtgcccgatgaggttgtttctgttggcgggtatttggcgggggatgttcatgctcatccggcgttgggtgcttgttctcgtgtgaaccgctctcggtcggtgggccacccccagtcgactatgccgacagctctcgccagcgggggcaaaaggagatgctccgttgatgctgcggatgggattgagtatctgattgagcaggttcgcgagtttggccgagacgttaccgtgctggctaccgggccgttgacggatgtggatgcggctattactcgagcaccggatattgcatcgaaactcaggctggtgatgatgggcggtacgcttacccaacccggtaattgttgggatgcggtagctgagacgaatatcatccaagaccctgaggccgcgaatcgtgtatttcattccggcgcagacatcacaatggtgggacttgatgtgactcaccagtgtttgctaccgcaatcggcggccgaccggtggcgtgcgacggggaccaagcgcgggcggttcttggctgatctcgcggacttttccatcaaggcaaatttggaagccgaccccgcactgttctctggcggcatgccgttgcatgatccgttggcggcggcggttgcacttgattcttcactggtcgattgttttgatcttgcgttgcgcgcggagaccaataccggtgatttcaatggagtacgaggccggaccaccggagacccggttgggctggtgaatcattccatgccgcatgtgcatgtggcacttggtgtggattcgggacgttttttggatgagtttgtagagaggatggctgaggtgtgccggtaactcccctcagtccgctacacgggcagctcgaccgcaattacggacaagctgccgctcgcattcttctggctcgactctcgtctcgccttcgcctacaaacagtccaccgggcgtttgctttacggctcagcccgtcagagggggcctaacaaggactatttcacaccgccgaatcggcgatcgcggtggatgtaatggtcgatggagcgccatagcacgtcacggccgcagtccgggaagagttcgggcacgaagtcgagctcggcgtaggcggcctcccacggcaggaagttggaggtgcgctgttcgccggaagtacggatcaccaagtcgcaatcgggaatgtccggattgtacagatggtcggcaatcatcttctcagtcacacggtcgccggaaatcttgccatcgcgcacttcgcgagcgatggcggcgcaggcgtcggcgatttcagcacggccaccatagttgatgcagaacaccacatcgatgaccttgttgttcttggtgcgctcctcggcggcttcaagctcgtcgatcaccgacttccacagcttggggcgacggccggaccagcgcacgcgcacaccccactcgtccatctgttccacacgacggtggatgatttcacgcgagaaacccatgaggaagcgcacttcctgtggcgagcgcttccagttttcagtggagaacgtgtacaggctcaaataccgtacaccggcttcgatggcaccggcgatagtgtcgaacaccaccggttcggcggcctgatggccattggtgcggaccatgccgcgctgcttggcccaacgaccattaccgtccataatcacaccgatatggcggggtaccttgttcttggggaagtcgggaatacgagcggggtcgctgaacggagctgcgggaatgtccaacgacgtgtaatcaacgttctcaaaagccatactcatgaatctatcaagcgcagcgaacgaatcgggcgttcgaggtaatactccccccaatcttcaaccaactcctgcacaacccgctccacaggcgcggcatcaagcaccgaccaatcgccacgaatcagtgcatcgaactggtttaacacgaacggtgcgatacggcgcgcatcggtagtgtggtcggcttcgcacatcacaccgccggacgcgatggacaggtacgccggctccgccttgccgcataccacgcaagtgcccaatcgtggcgtccaaccggccaaggccaaggcgcgcatcacataggagtcgcctatggcttgcggggcgtgggattgtttggcgagcgcgttcaacgcgccgatgagcagccgatattggttcggcagctgctcatgttcggtgctggcgattttatcgatagtctcaacgatgacgttggcggcctcatacgccgcataatccgccgcgatcggagcaccataagcggcgaccgcttcagcttgggagaccacgtcaagcgagcggccttcagcgataagcacatcgactcgcatgaacggctcgagcctggcaccaaagcgtgatttggtgcgacgtacgcctttggcgaccgcccgaatcttgccatgcccacgcgtcaggatggtgatgatacgatcagcctcgcccagtttggaggtgcgcaacaccacaccttcgtctcggtacagcgacatctcatctcctttcccgcgacgcctggcagactctactcaatgaagtagtcagtaaataaacagaccccagaaggcgaacaccaacagtatgtacagcatggtgaaggccaccagccagaacaggattcggcccagacgggtggaggccagtaccgggtcagcaccggtgacgatgtctcgaacggattcgcgacgagggggtatctgaatcaggccgcggacggaagcgacttctatcagatgcataaagacgcgggaccaagcccatagcaccagcacggacaccacttggatgaccggccagctccaatacatgacacccggcgtctcggtaggtgcgctaccccatgcaagtttgaccacgcccatgatcacctgcccgagtccggcgaagaagatgagcaatgtggcaagagtggtgagggtcaaagtcagcagcgcattgccgaaaccatgtgcgaaaccgagtaccacaggccgttccggtatcagcatgcccgcatgtttggcctcgcgcttctctcgccgccatcgggcatccgccgcgattttgcgacccagcgccaccagtgccagcacgatggatgcgagcagcagcagtaccaccgtgacgtgcagaatcacaccatatatggtgccgacgcgtcttgccttcaaagcgcccggcagaccgattgattggtacagattggtgccagccaccttttcactggtctgcgtgagtccggcggaagtgccgacggcccagtcgatgagatcgtccacataggcgtccgcaaacggggtgcccgcttcggactcatctcccaaacgcagcacatggttggcgaccgggtagctgcgcacggtcacattccagttatcggctttgtgggcgttgtagagaatcgcacgcacaccgtcgacctgcgccgtcatcacgtctttcgaaccgtaagccacataggtgggtacggcgtaggcggcgggtttgagtgtggcgaggtcgaaattgttcagtccgaacaggccggtgtccgcgctgaacacacgttggacgatggattgatagccttcgttcgcgccaacaagggtgaagtcttgggtgacgaaaaatcccagcgattggcgtgggctgaacaccatcgggctcaggagaatctggaaggcgatgtccggatcgtcctcgagcagatacgaggagatccatgtcgattcggaggtggcatagatgccgaccttggcctcgtctacatcgctttggtctcgcaggtattcgatgacctgatcataagccttggctgaggccggataatcgcggttgatgtcggtggtgttccaaacgggtttgtcgagcactgcggtcacaaagccggccgaagccatatcagaggccacgtcgccaaaggagttgtcacaggtgccatatccggcaccgtgcatgaacaccacgccggggcgcttgcctgatgcgttctgaggttcccgaatcaataccttgatggcttggacgccgtccgcattggccttgccccgagcaccggactccttggtcagattgccgtcgccggtcatgttcagcgtgatgtatcgctcggtgacctcatacgtgccttttgccggcagcgtttctccggacgggttatcgaaggtgacttcggtatcgtcggtgagcgtggccatcgactggccggtgggttcgatgttccaaggcaccgtggtcagattggaaatggagaccagcacgccaatcaggataatgaagatgggcaggctgaccatcagccggtgggtgctggtccacggcttggatcgaacagtcaggcgatgctcttcttcttgcggcacgtgcgctattgtaatctgaccgcgatatttatgccgagggcctattcggccgaatcagtgaccggggtgctggattgggaccacgaccgggccggtggaattgacggggacttgaccgtcggcctccatttgggcggcgatatcgttcgctatggtgagcagcgtgtcgacgatctggtcttcgggcacggtcttgatgaccttgcccttgatgaagatctggcccttgccattgccggaggccacgccgaggtcggcttcgcgtgcctcgcccggaccgttgacgatgcagcccatgacggccactcggattggcgcggtcacgtccttcaggccttcggtgacggcggaggcgagctggatcacatccacttgggcgcggccgcagctcgggcaggagatgatgtcgaacttgcgggggcgcaatcccatgtattccaagagtttgcaacccaccttgacctcttcggccggcggcgcggagagagacacgcgaatcgtgtcgccaatgccctcggccaagagcgcaccgaacgccaggcaggatttgatggtgccttgccaagcggggccggcctcggtgacgccgaggtgcagcggccaatcgcccttggaagcgagcagtcggtacgtttcgaccatggtgatgacgtcatggtgtttgacggagatcttgaaatcgtggaagccgacgtcctcgaacatgtgcgcttccttcaaggcagaggccaccaatgcttccggagtcgggccaccgtatttggcgtagagttccttgtccagcgagccggcgttcacaccgatacgcagcgagatgcccgcgtcggtggcggccttgcagatgtccggaccgacttcgtcgaacttacggatgttgccggggttcacgcgcacggccgcgcagccggcgtcgatggcctggaacacgtatttggactggaagtggatatcggcgatgaccggaatcggcgatttgcggcagatttccggcagtgcgtcggcatcgtcctgactcggcacggccacgcgcacgatgtcgcagccggcggcggtcagttcggcgatctgctgcaacgtggcaggtacgttggccgtgagcgtgttggtcatcgactgcacggagatgggcgcgcccccgcccaccggcaccgggcccaccatgatgcggcgggacttgcggcgcgggtgcaagggcgattcgctggtcaggtcgaccggatcaccggttttgcggaacggcttttcgatgggattttccgtattcaaggtattcatcattgcttgtttatcaggtcgtcggcgcgtcggcgggcttcaagctcaagctggttcatttcctccacgtccgtgaacagcgggttaccacgaagctcggcgtccatctggtccagcacggctttgaccgtgtccacgatgccgaggtatggcagacgatgctcgaggaaggcatgcacggcctgttcattggctgcattgagcaccgccgtatgcttctcggaggcggccaggcagtggcgggccagttgcacggcagggaacgcctcatcgtccaacggttcaaaggtccaagttgcggcttgcgtccagtcgcacgcggcggccacattggtcatgcggtccggcgcggacaggcccagcgcgatgggcagacgcatgtctgggggcgaagcttggcaaatcgtggcgccatccacaaattcgaccatggaatggacgatggactgcgggtgcacggtcacgtcgatgcgttcaggcggcacgttgaacaagcgggacgcctcgatgacttcgaggcccttgttcatcagtgtggaggagttgatggtgacaaccggccccatgttccacgtcggatgatgcagcgcctgctcgggagtgatgttctccatgtcggcacgtttccagccgcggaacggtccgccggaggcggtgaccacaagcttggcgacttcggcgtgggttccggagcgcagggattgccagatggcggaatgctcggaatcgaccgggttgatttggttctcgcgcacttgcgcgctgaacagcagatgcccgcccgcgactacggactccttgttggccaatgccagctgggaaccggccttgagcgccgcgatcgacggttcgagtccgatggagccggtgatgccgttcaatacgacattcgcaccggagccggccatggcgatgaccgaatccggaccgccggtcacgcggacaccttgtgcgccggcctgtgcgagagctgcttgcagcgctggaaccttggtctcatcaaacaccgcgacttcggacacatggaactgtgcggcctgttgcgccagcagctcgatatgtgctccgcccgccgccagaccggtgacggtaaatcgttcaggatgacgcgagatgacgtcaagtccttgggtgccgatggatccggtggatccgagaatgatgacagtggagttggaggctatgctcactgttccttcttcgtatcgtcattgttcagtgtggggaacgacaggtcggggatatccgaatcgaagttaccgccaagcgggaacagcagcgggaacgaatcgctggaatcgtgcttatcctgtgacggctgagctgcttccgtgtcatgggaggcggcaacgtattcagatgattccgcagccggacgggagatcgtgctgtctgcaggctgactatcggatacgcgaaccggaatggagttcgtgttacgatccggcttgctggtgggagcaaaggagaccggcatagcagcggacgcagcctcgtcagcagtgctattcacaggctgtactgccggggcggagggtgccggggatgaaaccgaacccggtacctcattcaatttcagcgcattcggtgcatcaaggctgggcatcttaggagcgaaggacggtgcatccactgccggaagttcctgagaaaccgcagccatgtgggcgagagcggccaaagaggaatcgttctgcaccatatccacgggctgttccgcgaacaccgacggggtcgatgacggagctgcgggttcgtgagctgcctgtgccggagcaaacgaggggacgctgccagcggtcacaccggaaaccggcgcggacggggcactgacgggaggctcagccgcagcaactgcggtaggagccacggaaggcgtctcggagacgggcttcgccgcagactcgttggacgcatgcaccaggtatgctgcgggagcaaaggaaaccggctgttccgcattggtgctattggtgcttgtggaagcatcgaacgatgcaggagccggcgcataggagatcggcgccgccgcggccggcgttgcgggagcaaccggagccggagccgtgaacaagctctgctcggcctgatgcagggcatcgaatgattcgtcatgagcaacggcagccggagcaaaacgttcgtcagttgccgggcgctgcgttccggaagcgaacaacggtgagacgccgttcgcttgaacggtcacgttcgtggcggtctgggcaggagccgcaggctcgccggacacgaaatcggccacacgggcataggattccaagcgactcagcaactgtacgcaggcgttcaggaagtaatcgacctgtcgctcgtcatagcctttcttgcccttgcgctgggtgaagatcacattgttgaccgtattcgcattgagatcggccaaagaccgtacatcgtcttcggtaacgccgtcaacgcccaatgcggccgccgccttgtccacaatctggtcgaccagacgatccacctgcttcttatcgtacgaaggctgcttgggcgctccggacttgaagcgttcacgctcgttacgctccgcatggttctggacttcgtgatacagcttctcggtcttcgccttccacgtcacacgcccatgctgtgcgatctcccatgtggtctgcttatcgaccacggcacgttccagacgtccaagcgcggcgtcaacctgtgcgatcacatagccgttcttgcgcaaatcaaaggacacgttctgaatgtcatgctgggtgagattcatgccctcgctgtcatacaaagcatgggcgcgctccaggaaagcgtccacctgagcggggtcatacccccacttgcgcttgcccgcacgtgcgatgcccgacttgccgtccccttcacgaagttcctgcgccatcggctattcgacctcctgctggatataaacactctgccacaactttacgtgactattgagacgcatctgaccaagaaaaccgaaattcacgattttgtagcagtactgccggtttccttctgcacgcatctcattgagatttcagaacccttgccgaagactgtcagggaatatcgtcacagcctatatccgtggaatgaggggattccatgaagcgatgaaaaatgaaagtgggcaatgagggactcgaacccccgacatccaccgtgtaaaggtggcgctctaaccaactgagctaattgcccgcaaatgacaacaatagcgtatggccggcactgcgcgacacgtggtgtcgcatacgcgtgccgtagcgctcaatcgcgatgacattcagtcacgcccagcagcactacgtagcacacgacgccagtcaacacgcttaaagtcaagcgtattgattgaggcttatcagcgacccttgccgaatgcgcgcaggcggatgccgttccagtccgagctgacggtcagcggggtggcggcgttcataccggcggtctgtgcggcggactgcacggtggatgagctggtggcacccgggcggccgggcttgggagtcagtatccacagcgggccgtcattgcccagtaccgcgtaggcgtcaacgatcgtatcggacaattcgtcctcatcatcgccgtcacgccaccatacgatgacgccgtccacagcggagtcgtagtcctcgtccacgagatcctcgcccgtgagctcttcaatctgggcacgaatggaatcgtccacgtcgtcgtcccagagccactcctggacgatatcgccgggctcgaaaccaaattcttcagcgttctgtgatgccgtttgattcacaggggacacattagcaagtcttcgcgaacaaatgcgttaacgcggccgaaaatcgccgcattgtgggcagacccatgcgagtcgtctcatcagaaacaacgactggccgcgcatgtcaggcctcgcaatgaggcaaatcgtcggcctgccccttgccgatggccaccaacgcctgatacgcctcgtccagcgtggcgaccttgacgtcgcgcagaccatccggcacgcggccggccacatccgaacaattcgacgcgggggccaggaaccatgtggcgccatcgcgcttggagccaagcatcttcagctctatgccgccgattctgccgactttgccgtccttgtctatggtgccggtgccggcgatggtcttgccgccgctctcgttggcgggggtgagtttgtcgatgagaccgagcgtgtacatcatgcctgcggacggcccgccgatgctgtccacgtgcatcgtcaccttggcgtgttgcaatgcactggcgtcaatgcccagttcgtccgcatgggctttggcatacgccagaccgacggcactggccgaatcctgggaaccggccatgtcttgttcgactttcttctgatactggtccgcgctctggcccaccggtaccgtggcctcacgcggcatgacctccacctgcggattggaccaaccccagacggcctgcgcgttgatgatcgggtacccgggcacgccggacgcgttcaccgtggtcagcagcagcttgccggaatccttatacgtcgtcacgccggtaccagtgatgtcgataaccgcaccatcctcaactttgcccagcacatcctgggtgggtccgggcatctcgatgacgtacgggctgggcagcagcagaatcaccacaccaagcaacacggcgaatgcaccgacgaaatggcgtttcggacgagcggccgcataggcccgagcacggctgattccacgagataggcgcgaatcatgcttcacttcgaacgatggcatgtgctcatctcccgcttccgaatccgcagtcgggctctcctgctcctggacgaggtctggttcctgattcctgtggcgtgcaaacataccctacagtgtaagcggagggccgaaatcggccgaaaacgaacataaaccgaaaatattgctcggccacaagcgaacaggcccgggcagaccctacacttggggtaacacaccgcggcaaagaaggatacgcatggacgacaacgcgattcacgagtggctgatcaaatgcttcggccccattcagggtgagatggcctggcagcagatcagccagttgcctgaggagatccgtgaacagctgatgagtcaggaccccagccgactgcccaatccatccgaagtccagcagatgatggccgcgttcagcgccggcggactcaacacgatgggcgatatgcagcgcactgtcgaggaagggccgatcaacgtcaagctcgccaagtcgattgccttgcagcaggccaacgcctccggttctgcatccagcgtgtccgccgtggatggcgaggcggctcgccgcgcgatgagtgaggcgaacctgtggctggataccgcctgcgagttcaatcccgcgcccggcgatccggatgtgctgacccgcgccggctgggtggagggcaccatcgaccagtgggcgaagttcgcagctcctgtggccgagtcgatgaacgacgctttggcttcggtgatttcggagcgtcttggcggcgcgttcggcgatggcgagattgccggcatgttcgccggaccggtgccgattccgattcccgacggtatgaaagacccagcccaactgatgaagctgctgggcaacacgtcctttgccatgcagttggggcatgcggccggcaatctgagccatgaagtgcatggcagcttcgatcagggcatcgcgttgctgaagaacccggctggtggactgattgcccagaacgccaccgaatacgcgaagatgctgaacggtgaggcttctgcggccgaggccgacacggccggcacttcaaccgactcggtcaatccgttctccacatccaccgacgcttctgccaatcccattggcttcacttcggccggcaacagcgatactccggcaactgacggtaccgcccaagtctccggctctgatgcttccgccgatgccgccgacgccgccgcgttcgaggctgcgctctccggattcgagaccaccgagaaaatccccgaatctgaagtgctttccttcctggccctgcaggaaatggctcacgcccgcctgtacgcctcggtaccgtggctgatgccgcgtttcgaggcgctcatcggcaagtacgcacgcggcatctccatcgatctggatgcgatggaggaacagctgcgtgacgccacgtcgatggatccggagtcgatttccggcgcggtgaatctcaccaaggtcggcatccccgacactcccgaacagcgcgaggcgctggcttcgctggaatcgctgctggcgatggtcgagggctgggtggattgcgtggtgtggcgcgccggtatggcccatctgcctcatatcgaacagttgcgtgagatgatgcgccgcgagcgcgcgatgggtggccccgccgagcgtacgttcgaaagtctgctcggtttgcagctgcgtcccaagcgcatgcgcgaggccaccgggatatgggagatgatcaccgccgccgaaggccctgaaggccgtgacgccaagtggacgcatcccgatctgctgccttcgctgcctggcgacaagcccgcagatggcgcgtctccgtcatccgacgccccttcaggttcttcttccgatgccaacggttccgcttctcaccctgccgcagatggcaagaccggcgatatcgattgggatgccgaactgtccaagctgctcggcgaagatggcgaagacggtgaaaacggcaactcggaggatacgcaggcatagtcaaccggccttcagccaattcccgctcctgaacgttcaggagcattcagtatgcattacagacgcccgtcacaaaaatcgtgatgggcgtctgcgctgcgctccataaccatccttggtccgtgcatacgacaaatgcagcgaatcctcagctcgggtgatgcccacatacataagccggcgttcctcttccagcgcatcccccgtttccggcgaaccatacggcaagagcccttccgaacagccgatcagaaacacgtgcttgaattccagacccttggatgcgtggatcgtggaaatcgtaaccccgagatcgtcgtttgcggcaagtccggtggcgtccaaacccatcgcctccaatagtgcgcgtttggacgcggcatcgtcggcgagcgcggatgattgccatcccgaatccttgcggacgcgatatttcagtctcgcagcgcgcaaggcggcaccgaataccggctgttgggcgttgatgcgggtgaggatcgcgcaatcggacggcttggccccgttggcaaccaaccgggctatgcgtgccgccacgccctgtgcctcttccatatcgctctcataagcggttcgggtaacgcgcggaccggattcacgggcggaaaccagtttcaggtaatcctcacggttcggcgcggccgcaagcacccggttggcgaggttcacgacttccggcgtcgaacgatagtcggtgttgagattgacatcggcggcgagcggcccgaattcatcggcgaaacgcagcagatcccagctggaagcaccggcaaacgagtagatggtctgggccggatcgcccacgacgcatacgttgcggttcattgcgctcttgccgtcaggtcctcccccgcccagccacagggtcagtagcctgtgttgcaggggcgagacgtcctgatactcgtcgacggtgagccagccgatggtggaacgaatttgggcggcggcttcgggaaaaccatccatgatatggcatacgagcaacagaatatcgtcaaaatcgatttcgccacgcgaggtcttttcctgctcgtaggcgctgtagacgtcggcgaaccgagcggtgtcgagtccggcgggcggctgcctatgggcgatggcacatgcccgggcataatcttccaccgccaccaacgagattttggcccaattgatttcggcgagcacatcgcgaacggtcagcggatcggcatcggtacgtgcggtggcgcggatgatcgcgcgggagacgacgtcacgctgatcttcgatcacatgcggaaatggagcctcgcatatgtctgcccagacgctgttgagctgatgcaatgccgctgagtggaaggtcgcggccgtgactccggcagttcccgcacccgaaccggaacgtccagtacctccccctacgccgagctggcccaatcgtgcgcgcatttccgccgccgcttttaccgaaaaggtgacggcaagcacccgctccggcttccatgccccggtggcgcaggcataggcgattcgccgcgtgaccgtgcgtgttttaccggcacctgcgccggcgataatgcgcaccggcccttgcaacgtagtcgcggcggtacgctgccgctcatcgagcccctcaagaatcccctgcgcctgttccatgcgtccattgtggcacgattcgcgctcacggcacgactcatgcctatggctgaatcgggctcacgacaaaacatcgccagaatcatgcgttttgcgtgtcattctgcggtgcgaatcgccacggatgtattagtgtggaagggtgatgaaacgtagcgattatatgttggcggcactcgcctcagccgtcctgccgaatctgggggtggccggcgtacgcgagaacgtgcaggccagcgcaaccgacgaggccaaaggcatcgatcagaccgtgattcaagatgcctcaggcaagttgtacgacgtatacgccactgacaccaaggaagggcgtacgcgtctgattcgccgtgtgaaagcggcgcagacactggcagccgcgcgcgagcctggtggcctcggcttcgatatggaccgtgtggtcgcgttcgccccgggagacgtttcccgacccggccagacggccaccgcacaggccgtggggcagcagactcaggcggagtccacaccgctgaccccgcgcaagcccggtcccacaggcgagacgaccgtgatgattgccgtccaccgtgatggccaggcgcggcctctcgacctgttgacattggatgactgcgcggccgtcggcaccgccatcggagccattcatcgcctgccttcgacttttctggccaatgccaaatatccggtagttaccaccggtcagattcgttcgcagctgaccgcctggattcgccgcttacgctccgccggccatgttccccaagaaatcaccgacagctgggcgcgcatcatggacaccgagggattgtggtcgttctccacctgcacggttcacggcggattttccgacggcgacttcctgttctccggttccaccatcaccacggtgaccaactggcaggatatgcaggtcaacgatccggcacgagaccttgcctggattttcggcaagctcgacgaatcccatcgcaacgccgtgctttccgcatacggccgcatgatgggctctcgacttgacgatctcatcatgctcagggccaacctgtggctgcagatggaacaggtgggcgaattcattcaggcgttgaaccgtgcggacaacgatcacatcatgcagttcaaggcacaggtcgaacgactcgcacaccagttgggcgtgatcaagcacactccggcaccggccccagccgcagggtcggccgccgcctcgtcaacgaagcccggtttgccttccacaatcaccgtcggcacattgttgcaggacgaccgtcatcaggcacccgcacaaccgcagcagtccgacaccggtaccgcggcggccgaggtctcggacgacacgcccgatcccgatcgcaccggttccgctgacatcgtggccgctggcgacgtggatcttaccccggaagtcgaacccgatgctgaccggaccgccaatcacccgcaagcgaatgtctccggcatcgcaaccggtacgggatcgaccaaaccgcagccctcacatggcgcttcccattcttcggtgacgatcacgctgaaggagctcctcagtatgaacgggcatagcggcacgacgtcaaccgacgcttcccctgcgtctcaatccgccgccccgaccgacgatgcggtgaatgacgatactccggacagtctcgttcagtacggagcctcgagtgcccaaaccacggtgattccgctgttggagcgggaagaacgcgctctgcgcgatgcccgtgccgggttggacgggtatgacagcgagggcaatccgctggccgaatcgtccacatcatccaaataatgtcgtgtacggtgttccgcgccacgccgagcgcgtaacaccgcacatgacgacgcagacacgcggcacaatagagtacagaacctcggccggcgacggccacttaccatgatgttcgtcacaaagacggcagaacaaggagccttatatggatatcgaactgggcattcagaacgtggcacgaccggtgaacttcagcaccgacgaatcagccgacaatgtgagccaggccatcgcgcaggccgtggccgacaacacgacgatcgatctgaccgatgacaagggccgtcgcatcatcgtgcccgccaaggcactcggttacgcgatcatcggctccgaaaccaagcacgccgtcggcttcggcacgctgtgaccatgaatcgcgcataagcggccttgggcattatctcaaggccgcttttgtattgctgaatcaccgatatagcggaagcacgccgcgatgaacgatctcttcgacagtggcctcgtcggtgaggttctcccccagtttgttcggtttgcctttgccatgccagtcagacccaccggtgaccagcagctggtgccggcggcagatggtgagcagccgttctcgttgctccggtgaattgccacggtgccatacctccagcccgtccagtccttcgctgatcaatgcctcgatctggtcatcggacaacagtctgcggttacggctcacatcaccggcatgggcgatcagaatcacaccgcctgctcccttgacggcggccaccacttcatgagaggtcggcgaaggcgtgggaatatagtatttggatgaggcgctgaccgcatccgcaaacgcttccgaacgagtccgatatacgccggcactcaccaaagcatcagcgatgtgaggccggccaatggtggttttgccaccctccttgacttgggcgagcacggattgccaggtaatcggataatcacgagacaacaattcgaccatgcgctgcgtgcgttgcaaccgtgcggctcgagtattggcgaacaagtccgtgatgtgctgattcgtgggatcatactggtagccgagcatgtgcacggagacgttctcatccgtggcggtgatctcggtgccgcggagcaacggcaaaccgaccctatgagccgcggcttcggcctccggccagccggcggtggtgtcatgatcggaaatggccacgcccttgagtcccaatgccttggattgttcggccaacgtggccggcgtttccgtgccatccgagaaggcggtatggcagtggatgtcccacccgacggcgggcggttccaaaggcatcacatatccagtcataccttccatcgtaacctcatttcagcattcccacgcaaggcgcagacaggtcgtcaccttctgccaacggccgaaaccagacattcggcacccagctgacaaccgcagaggctaatctggagcgcagcgctatcgaaagggacatgatgactcgtaacaccgcaaccgacacatcatccagcaccacgaacaccacgccgcttggcttggcggaggcacgaccgttgattggatggcgccacagtgccacttggacatatctcatcatgctgattgcctcggcagtggcgttgggggcctcgctcattctgtccgctgagactttgcaattggctcggcatccggagtccgcgctcggctgcgatctgaactcggcggtgtcctgttcggcggtggcccagtcctggcaggcggaaatcgtgaaattcggcgggctgagctatccgaacgcgttcttcggcatcgccgccgaatcggtgttcgttaccatcgcggtgatcggtctggcgcgtgtgaaggtgccgcgttggttcgcgacctgcacgtggctgggcggactggccgctttggcttactcgtactggctgagcacgcagtcgctgttcgtgattcacgcgctgtgcccgtggtgcctgaccctgatgttctccaccaccatccagttcatggcgttgagccatgcgaccgtggccgtgcagggattgccgtcacgtaaagctgtggcggctgatgatagcgacggtgaggctgaggtcgcaatggtgccggccggactcaataagtattaccgcctcaacatcgacctcatggtcgatatactgtggatcgtggcgatcgtggtactcatcatcgtcaccgaaggcgcggccctgttcgctgcctgattcctttacaacaaatcgatatcggcgaccagcgtggctgctccggtcagctttacgtcgctgtcggtgacgtccacgcgcagggtaccgccacgtacggtgatgtcccagtggctgatgccggtcttggcccgcagcacaatgcctgtggcgcacaggccggtgccgcaggacagggtttcgccgcagccacgttcgttgacgcgcatcgtggcttcacccacgccggtgttctggtcgatgtcgtcgacccgcacgaattccacgttctggtcggattcgatgaccggagccaccactggtttggtgaccaaatccagtgattcaaccactggcagggacgcgaaggcatcctcgatcaccgcgaccacatgcgggttgcccatatccacgaacgtaccgcgcgccgagccctcagtgccggggatggtgacctcgtaggcgtcggtttcgccgatcttccactcccccatttcgacctggaacacgttggctccgtacggcctcatattgccgcgtggcgtcagaatcttgacgccggcacgggtgccgaggcggaacggctcggtggagtcggccacaccctcacgctgagcgaacaaggtgatggcgcgtgtaccgttgccgcacatctccgccaacgatccatccgcattgcgatagtccatgaaccatttcgtgcccccggccagtacgtccgaaagctgatcatcgcttaaatcagacacgaaatcaggccgtgtcaggcgaatcaggccgtcaccgccaatgccgaagtgacggtcgcacaggaatcggacctcatcggcggtaggctcgaatttgccggacttgtcgaggtataccacgaaatcattgccggttgcgtgtgtcttggttactcgttgcggaagactcatggctttcagagtactctagggagcgaaacaacaccgcaaaacaatcggctttgtgatcggtcgcggcaacatacggttgcaggcatggctatagggaggattcaggcatgagctcttcggctccaatcggcgtattcgattcgggtcttggcggtatttccgtggctcgccaaatcgccaaggatatgccggccgagcatgtgctgtattttggtgattcggccaacgcaccgtacggcatcaagacgcctgaacaagtgagggccctgagtttcgatattgtcgaacggttcgtgcgtcaaggcgtcaaggccgtggtcatcgcatgcaacaccgccacttccgccgcggtgaacgatttgcgcgaacactacgatattccgatcatcggcatggagccggccctgaaagtggcgtgcgaccgtggtgacgtgccttccgacccgcatcatattccccagagggtgattgtggcggccactcccctgaccttgcgtgagcggaagttcgccaaactgatggatcgattcgattccaacaacacgattttcaaggagccttgccccgacttggtggagatcgtggaatccgggcggctcggcgaccatgacctggtgatgcgcacgctgcacggctacttcgaccagtacgacatggagcatatcgactcggtggtgctgggctgcacgcatttcgtgttctaccgcgactacttccgcgagctgctgcccgaacgggctgctgtcatcgacggcaatgagggtaccgtgcgccatctgggcgtggtgttggagtccctgggcaaactggcacccgaagacgcgaccggcggcgtggagctcgccaattccgatccgtccgaacggattgccgagttgtcacgcaaattgctgaacgtatgagccgttcttggctcccctctctgagggaagccaaggaagaaccagacaaattcacagcacactgcccatatcgttgtccgtgcagcacgcgtaagctcataccagattcaagtgaacagggggttggtatgacaaagacggcgatgattgatgtcggcggcgggttccgcgcgattttcggctgtggtgttatggaccgcatgctggaggacggcatcgacgtggatatgtgctacggcgtttccgccggcgcggccaatatgacctcattcatcgcacgccagcacggccgcaaccacaccttctacaccaagtacgccttccgcaaggagtacgcgagtgcggaaagcttcttcaagaaccacaactttgccaacctcgactacatctacggcacgctgagcaatcacgatggcgagaatccgttggatttcgcggcgttcgaggccaatgagaccgggttcaccgtggtggcctgcaatgccgaggacggctcgaccaagtacttcgacaaatcgcgcgtgcgttttgatgatttcgacatcatcaaggcttcgtccgccgtgccggtggcctgcgagccgtatgtggtggatggcgtgccgtatttcgatggcggcatcgctgatccggtgccggtgcagaaggcgctggaggacggctacgatcgcgtgattctgattctgtcccgcttgcgtaacgaagtgcgcaagcagcagaaggatttggctccggcccgcatcctcgaacgctcccaccccgccgcggccgagaagctgcgcatgcgctacaagacctacaacgacgaactcgaactcgccaagcattacgaggcggaaggcaaagtgctgatcctcgcacccgaagacctgtatggtctcaacaccctgaagaagaacttcgagggcctggaaatgatgtatcgcaagggatacgcggcggccgaggccattccggcattccttcaggcatagcgatagtgaagtccctcgcttggaggggcttcactatcgatggatggggattcgcaaacggggtgattacttcgtctcggaagcggtgagcatggccttggtgacctgctcgtagagatcctgataaccgccgggcgtggaggcgggcagcaccacggtcttggtgttgttcgattcggacagcgagcgcatcacgtcgaggtactggttgaacagcaccacgttgttcacgtcgttgatgttcatgcccacagcctgcagactcttgatctggtcgacgataccgttggcgatctcgcggcggtaattggcctggccctcaccctgcaagcgagtcttctccgcatcggcggcggcttgggtctcgatctggatacgctgggcctcggcacgctgacgggtggcttccttttcacgctgggcggcattgatggagtccatcgcgttcttgacctgtgggctcgggtcgatggcggtgatcagcgtcttgaccacggtgaagccgaaacggctcatttcggcgcccacggtcttctgcacgtcgaacgccacatcgtccttgcgggcaaaggcatcgtccaaagacagtgcggggatagcggaacgcagcgcgtcctccatgtaggagcgcagctgaccggccgggtcacgcagctcgtagtaggcggtggccacatcgttcgggttcacgcggaactgggtggaggccaccacggtgacgaacacgttgtcgagcgtcttggtttccagctgcacgttaagctggttgacacgcatgttcgttttcatggcgatgcggtccacaaacggaatgcggatatggatgccggcgaactgcaccttaaggaacttgccgaagcgttcgatgatgtacgcctgctgctgcggcacgacgaagagtgcggcagacagcagaacaatgagtagcacgatgataatcagcggaccagcaaagaatacggccatgatgttttcccttcacccacgtcgaaaccgccctcggcctcgactcgtgatttccatcgtatcagcgttcaaaacaaagcggtagacatcgtacgcatatgtgtacaactgttcactatgtgtgcatgctggcttcttataaaaaagtgcggcatccaatcagtatgctgcggccatgcctgagccgacagccacggcgccgataccgtcctccagcgcggcaagccgcttttccagtgcatcgacagtgggattggccacacgggagtactcgaagccgtcgatgtcaccgcccgcgagcgcatcgccgcgcgccgcgtcacccaggtcgaatgcggccgaggcatagattggcggcacagcggcacggccgttatccagcggctcgtagccggcgtggatggcttgcgttcggaaatcaacgcccattaatccttcttcctcatgccgctctattgtggcgggctcgactctattcccgaacttagcaagtcatggtacgcgacaccggcacatcggtatcgcaattgtcaatgcgcgcttataagcaatggctatagaatatccgccgaatgccggaacacaccaagctgcctagccctctttcagcacctcggccgcaatattacgctgcctcaaataattcaaagccgcgtcaatccgtaccggttcatcatcgaaaatggccacgatgccctctaccggagtatccgcgacgatgtcgatatctccaaagattatgttgacatcgatgccgaaccctttagtaatttgcgacaccaacgcttcagaaacttccttggacacatattgcatccggaccaatcgttggccttcagacaatctcatcaaaagggagtcatggttctcttttcatatctggcgataacgcatatcaaatcagcaatcagcgcaaagacgctcggtcgctccatccggataacaactttgccgtttcgcctaaggtgtcgatgacatggtcaaccggtgcgtcagaaagagcttcagcatagttctcgatgcgatagtcgaaataacgatcggcgcccagcgcgctgctctccgaaagcaccgggacgaacgccgtcagcattcgtaacaccttgggagcgctcaaacgcgcggggctcatcaccgtggcacgcggaaccggcggcgccgaacttgcccacaccccccaaggaaatcactctgctcgatatccatcaggcagtggaatccacgaacctcgatgatgtgatcggcatccacgagagagggaatcacacatgccccgtggctcggaatatccacgacgttctcaaagatgcgtatgctccagtggccaaagccatgtcggattccatgagggaagttacgcttgccaatatgcttgccgactaccgaaatcgcattggggtcaaagcccggcaattggaacagtagtgggcaccgaagcgtaagccccccctactctctgatccgcataaacagataaggcgtgcgccatcaagaccgatcgatgacgcacgccttatgcagctcagaccacggattcctagtcagccagcagccccagctcctgcagcttgttcctgatatccactgcagagggttccacttggaacgagccgtcatcgtaccgcaccaccggaatgtgcatctggccgctgatcgccacggcacggtcggcggcaccttcctcttcctcgatgttgtgccaagtgtatgccgcgcccagtttgtcgagagtgttctttgcctggcggcagtcgccacaccatgtggcaccgtagacgtcgatggtcatatcgggtcctttctttgttccgccgcgcttgacttttacgcggtgcactatcaaaccgtattcatcgtaacggggatgctgtgatatcgcggttggcataatgcgggcggtccgcttaaccaccccagtcggctacgccgacagccctctgccagcggaggcggaaccagagcataaaaaagcggctccggtgtggcacaaccgacgccgctccccaggagtagaaaaataggcagaaaagaattagatcaggcaaacaccccccgaagtcagctgttggaacacgtcgaagtcggcatgccgatcgatgtaacgggcgtaagcgatatcgaacgcctggccgagatcttcgatcagatcgttggcgtcctcgatgccaacggcgagacgcaccaattcatcggtgatgccgatcttcagacgctcctcgcgaggcagttcgaaatgcgtcatacgacacggcagctcggcaagagactccaccgcacccaacgacacagcaagacggaacaggtgcaggttgttgagcacgtcagccggatcaacgccaggcacgacctcgaagctcaacacgccaccggcccccttgagacctttggcagccagacgctggtcgcctgcgccgggcagacccgggtaatgcaccgccttaaccagcggatgcaccagcaggtagcgggcgatggcattggcattctcctgctgacgatccatgcgaagggccagcgtctgaatgccgcggcgcaccgcgtcgcactcagcaggagccaacacaccacccaaacggttctgcgcgaagtacacgcggctcgccagatcctcaccggaaacgaccaccagaccggcgttcacatcagaatgaccggccagatacttggtggcggagtgaatcaccacatcggcacccaaagcaagcggcttctgcagatacggggtcacgaacgtgttatccacaatcgaaagcgccccgaaacggtgggccaccgtggagatggcgcgcacgtcgttcaccttgagtagaggattggtcagggtttcaaagtagacggcttgggcaggcacgatgccgttcgcgcggtcgcccttgacggcggcctccaatgctgcgatgtcctgagtgtcgacggcctcgacgaggattccccagcgagtgaagaactcattgagctgggaatacgatccgccataaatattgtcaccgaccacgatgcggtcgccgggcttgaaaatgctcagcaccgcgtgaatcgccgcgagaccggaggcgaacgcaaaaccacgcgttccctgctcgagctgggcgatctgctgttccaggaagtcacgtgtgggattgccgcttcgtgcgtagtcatagcggggcatcgcgtcaaccttctcgaaggcatatgtcgttgagttgtagatcggcgggttcacggctccggtgttgttgtctccaaccggcagtccgtggacgagctgagtgttgaacctggtcattgcgcacccccttaaagtgttgcgtcatctgcgcgaagccgttccccgcgcggcacgattacgaccttaacgcaaaacgccggcccgaaggccggcgttgctatatgtgttggttatggacgggtataatcagacctctccgtcctgcaagaatggacggcctgacgaccggcccaacacacctcgccgctgccgcggctcggcgtcgcctacggacagtccaccggactgtccgtcagacggctccgccttctaccacgatgtcatcggggttgacttcgttgccgtagaccggctccagagtctcctggtaatccttgtggaagaagttgtctttgccgagcttgacgatctcgtcgttcacgaagttcagcagttcggtgttgcccttctgcacggcgggcgcgatggtgtcgtcgtcaccaaggtgggtgatgccaaccttgaagcccttgttggacttggcccaggcgagcacctcggtgttgtcggtggagaaggcgtcaccacggccgtccagcagcgcgttgtaggcatcggcgtactggtcgtacttctgcagcttgacgttcggcgcgttcttctcgaaccaggtttcggcggtggtgcccttagcgatgatcagggtcttgccgtcgagctgactgacatcggtgatctgggcgctctccggggagaccacaccaagcgccaccttcatgtacggcttggcgaagtcgaccttctccttgcgctcatcggtgacggtgaaattggcgagcaccagatcgaccttgttggaggtgagcacgtccacacgggcagccgggtcaaccgacgtgtattccggctccacacccagatccttggccagctgttcggcgaagtagacgtcatagccctggtacttgccgtccttgtccacgtagccgaatggcgccttgtcggagaagacggcaatcttgatcttgccgctcttcttgatctcgtcgaggctgcgggccttggcattggcgctggagctggtgcccgtgtcagaggacttcgcttcgctcggggtgcctgccgacggaccgcatgcggccatggacgccgccattaccaatgccgcgcctgcggcaatcagtgctttgaatgatttcccaaccttgatactcattgggttctccttctcttgttgttattgatatttcttctcaaatacgtcgatatggcacaatcgaatcactcgaattcgaaggtgtgcaggaactgctgcgcacgttcggtttgcgggtgttcgaagaacgcctgcgcatcatacgattcctcgacgatgcgcccgccgtccagcaagatgatgtggtcggcgatggctcgcgcgaactgcatttcgtgggtgacgataagcatcgtctgcccggacttggccagttcgagcaccacgtcgagcacttcacgcaccatttcggggtcgagagccgccgtaatctcatcgagcagcagtacttccgggtgcagaatcagcgcacgacaaatggccacacgctggcgctgaccgccggacaattcgtgcggccaagagtccttgcgatcggcaagtcccacgcggccaagcaaccggatcgcttcagcctccacctcggacttatcgcgtttctgcacgagcaccggcgccatggtgatgttgccgagcaccgttttgttcgggaacaaatcgtagctttggaacaccatgccgatacgcgtgcgcagttcactggaccggtcggatcgtccggctcgttccgtgccaggcttgccggcatcgatcacctgatcgttgatggaaatcgtgccgccctgaatcggttccagaccggcgatggtgcgcagcagcgtcgacttgcccgagccggaaggacccagcaccacgagcaccgaaccatgctccaccttgaaggagatgtcatccagcaccggcttgtcggcattcgcatactgtttgaccagatgattcacctcgaaacccttgcaggtcgtttcgggttcagtcattcgaccacctcttttccagtcggcgggccacaatggacagcggccagcacacgatgaagtacataaagaaaatcacgccataaatccacaaggttccggtcgggaactggaatcggttcgcgtcgataatctgctggccgaccttgatgacctcgaccacaccgagcagcacggccaatgatgtcgttttgacgatacgtgtcgccaagtttacggatgccggcagcatacggcgaacagcctgcggcagaatcacccgggagaaggtctgccacgggctcaaccccagtacgtagctcgattcgtactgcactttgggaatcgactgcaatgcgccacgcaccagatcgcccagctcggcgcctccccacaggatgaacaccagcacgcaggcaccggtggcatcgagattccaatcgaaccatcgagcaaaaccgtagtaggcaaggaacagcaacgccagctgaggcataatgcggatgaagtcgaggtagatgcgcatcgcggcccggatcacgggattcttcagcgtcatcaaccagcccatcaacaggccgaccgggatggacgcgcctacggatacgccggctatccacacggtgacccacaggccttgcaacagacgtgggaatacgcctggctggagcagtatttcagcgccgctcataatcgaacctccgctccaaccatgtgccgaagatggaaatcggcagcagaatcaccagataggccacgaccagcatgaacaacgactcataggtgctgtaatacatgccgatcagatccttggccatgtacatcacgtcggcgagcgcaatggcggagacgacgctcgattccttaaacaggaagatcacattggccactacgccgggaatggcggtggacactgcttgcggcagaatgactcgggtgatggtttgcgtggaagtcagtcccagcacgtacgcggtttcgcgctgcacgttgggcaccgcttccaatccgccgcgcattgcctcggccatgtaggaaccgcccaagaatccaaggccgactatcgcgcaggtttcggcggaccatactacgccgagtttgggcaggccgaagtacagaaagtacagctgtaccagcaatggcgtattgcggctaagttcgatgtagattctcacgatttgccgggcgaccgggatacgcgcgatttccacgccagcgcagaccagacccaccgcgatggcaagcaatatgccaaacacggatatgaataaggtcatcaatgtgccgttgacgaagaaaggcgcgtaacgctgcacgaacgaccaatcgaatgtcattgggcgcgctccttcctttgcttctcgtttcttctcctgcgcataaacggtcttagccacccatgtacgatttcgggggccgaacatacctgtccccctgccgtgtcatcgtagagtatcagaacacgtggcacggccgctgcgctatacgcattacttatgggacgttactcgatgggcgaacatcagggcattattgtcgcccaaacggtggatacactgaggctatgaagatcaccaaagctctgacccgtttgaccggtcccgaaaccgctccggtgttcgtgctgttgcacggctggggttccaatgaatacgatttgcccgatctgctgaactattgcggtgccggttcggctgattatgccagtttgcaggcacccatcgcctatggcatgggatatacatggttcggtgcgtgggcgcatgaaggtgtgccggagggcgaatcattagacaagcaggcgactgaagccgcccaagccattgatgcatgggttgcggagcatattcccgccactcggccggtggttgccatgggattctcgcagggcggcctcttggccgcgcatcttttgcgatgcaatccgcaacggtatgcggcagcggtctcctgctccggctggttggctccggggccggtctctggagacaccgagctggctgcgttgaagccgccggtgttctacgggcatggtgctgcagacgacatcttcccgaaagccgatgtgacggcgatgggtgagttctggcacgagcacggcacgttgaccgaacaagtgtatccgggcatggcccattccattaatatgccggaaatgcgcgatattcaacggttcttggagaccaacggattcattcggccgcagatttggtagtcaccacctcacatggcgtagtcgacgtgggcgaattcagggaccttataccatttgacggggtagccggcaccgtgggcgcagaagaccgagtcgggggtgttgtccagatctgcttcgggatcgtaagcggcggctgcgatgatctgttcggcgtcatggcatggcttgtagccgccgaaagtggcggagaaacggccatggccgtgcgtgtactggttcacgtccatcgcatagtcgcgcatctcggacaccggcgcctcgccttcgatcacggcgtattcgccatcggtgaccggggattcgaaggtgccggccatgcgctggatgtcgctcatggcacggccgatcatgtctgctggcacttcgagccggaaccggtaccacggttccagcagtcggcagttgccctcccctgcggtgtccggacggctctcgaccggcgtctcgggccggccactgactccagctctggcttccataagcccctgacgaatcgcacgataggtggcttggcggaagtcgccgccttcggtatgcttcagatgcgcgcggccagccaccaaagtcatcttgatatcggtgagcggcgcgccaacgagcacaccgagatgctcacgctcggtcagatgggtcagaatcagccgttgccaattgcggtccaaatcgttttcggacagggccgaggccacagtgactccgctgcccggctcccctggttccagcaggatatgtgcttcggcataatgacggagcggctcgaaatgacctgcgccttcgattggcgcagtgatggtctcacggtacaggatggagccggggccaaacgacacatccagaccgaaccggtcgtgcagggtctgctggatgatctccagctggactgcgcccatcaattgcacatgaatctcggccagccgttccacccacaccacatgcaacaacgggtcttcgtcttccagctcacgcaatgcggtgatgaccttatgcaaggtcagatcatcgaactggggacgggccggcgagctattgtccgccgcggtctggcgagcggtgtcgttctcctcattgcggccggttcccgacttggcggcatcatgctcggcatcgtcctgattcacgctgttatggccggcgccaccgcgtttggccgctcccgaggtgccggccgtatcggattccgctccggcgggcaacaccgtgtaggtcaacacgggttgcagcgacggtgattcggcgtccggttccgctcccagcccttcgccggggaaggtccgcgtcagtccggtcaccgcacacaccgatccggcaggtatctcggtgaccgtctcgaatttggcgccattgtagacgcgcacctgatcgactttctcggaccataccgtgccatcatccccctgtaccggcgacggtgctgtcgacgccgcggcgcacgaggatgaagagacgatctccttggctttgagcgcaccgccggtgacgcgcagccacgtcatacggttgtgctggccgtcgtgggcgattttgaacacgcgtgcggcgaaggcggccggccattcacgttcgcgggtgaacgtctccagcccgtccaggaattcctcgactccttcgagtttcaatgccgagccgaaatatacggggaacagctcgcgcacggcgatcatcgatcgcaatctgtccacggacagcgcgccatgttccagatagtcgttcatcgcctcctcgtccagggtggcgatatcctcggcaagcgcgtccaacggtaccgcgctgccctcagtggactgctccattgccggcagcggatatatcgcatcgctcaggcgtttgcgcaactgtgccagaatggcctcgcggtcgaatccggcggcgtcgcacttgttgacgaagatgaacgtcggcacaccgtatctggccagcagacgccacagtgtctcggtatggccttgcacgccatccgtgccggagaccacaagaatcgcgtaatcaagcacacgcagcacccgttcggtttcggctgcgaagtccacgtgccccggcgtatccagcagggtcagtcgcaggtcgccgtgttcaaccaacgcttggtgcgcgaagatcgtgatgcctcgcgccttctccaaggaattggtgtccagaaacgcatcgccgtgatctactcgccccaatttgcggatctcaccggtacggtagagcagcgcctcggacagcgtggtcttgcccgcgtccacatgcgccacgatgcctgccactatctgtttcatcagctgtgctcccttcccgatgcgccgcgcaattgccggccgcctaaccaatatatccgagaaaaaccgggagggaataattttaccgtcagaccgggatgccggtacaataagtcaccgaacaccgactgatatgaggagcctccgtgaccacttccggcattaccgttttcggccaaccatcccagcccaatcatggtgccggcgggcgaatcgccatggacgatgccgtcttccccaccgattatgtggcgctggatttggagaccaccggcttttacccgaacagttgcgccatcacggaaatcggtgccgtgcgcgtgcgggaggggcatatcgtcgatcaattccagcagctggtgaatcccttgcggccgattccgcgtcagatcaccacgctgaccggcatcaccgatgcgatggtggccgacctcgatccgattgacgaggtgcttccccgattcatcgcatggctcgctaccccggctgccggtcccgccgtcgagccgattgtcggccataacgtcagcttcgatctgcgattcctggattacaacacccggcatatcgccggctgcggctttgcctgcgcggattatgacacgatgcagatcagccgcgccctgttccccgcgcagcggcatcaccgtctggccgacctgatcgtacgcttcggcatcgcggacaatgaggagcaccgcgcattaagcgatgccatccaaacccagcagtgcttcgaatggatgcggcattatgtcaccgagcatcacgaatccgaagcgatccgctggaagcaggcgccggccaaaaacagcgccgaaatcctccaccagcagttggtggtaaagcggtagtttacagcccgtattccttggcgatgacggaccagaggtcggcagcggcctgatcaacggtttcgttgacgatggtgacgtcgaattcgctttcggcggcgagctccaccttggcggtctccaagcgacgggcctgctgttcggcggtttcggtgccgcggccgatcaggcggcgctcgagctcttcgaagcttggcggcgcgatgaacacgtacaccacttcgaggtcgagctcggcggcgcgctgcttgacgcggcgggcaccctgcaggtcgatttccagaatcgtgggcacaccggcggccagatgttcctccacaggcttgagcaatgtaccgtagtgggccatgccgtgcaccacggcggtttccaggaactcaccggccgcttcgcgggccaggaactcgtcttcagtaaggaaccaatagttgacgccatcaacctcgcccgggcgcggagcgcgtgtggtggcggagacggacacccacacttcggggtggtcggcgcgcagcttggcttccacggtgcccttacctactgcggtggggccagtcaggacgattagacggccagcatgggtgttttcagtcatgggttcctccggagatgatgtggtgtgcagcgattatgaatccaacgtggtaacggctcaccggcgagatgaccggtaactgctacagccccgacgaacagggaagaatatgaatcgtgatgcgacgtacgcgatgagatagacacgtacgcatgccgcgacatctgattccgttctgattactggttttccgagccttcgacagtggcttccatcagcgcctgacgtacgtcaagcgcaatcgactcggtggcttggctcagtgcggcgatatccggcccatgcgaggcgataaagcgggacacggtgaccagcacgttgccgcgcgtaccgcggaacacggttttcagatccttggcctcggcaccctgccaaccgtaaccgggggaaagaatcggaccggtgaacttggaggggtccacgccggaatcctgcatccattggccgatggtggcaccgatgatcagacccaccgagcccatgccttcgatatccacgttatgcttctgcgcggtggaggcgatgccgtaggccacggtacgtcccttgtaatcgccgctctggcgcaacgcggtctgcagactcatgccttccgggttggaggtcagggaggcgatgaacacgccgcgtccgttttccagcgcttcggtaatcaggccgttcaacgaacgcgcgccatagtacggcagcagcgtgatggcgtcggccagcaacggtgcaccgggcttgaaataggcgtctgcgatggcggaaatcgtggtggacaggccgccgcgcaggcaatcgacgatggtgatgacgcccatttgtcgtgccgcgtagagcacgcgctcgagcgcttcgaaacctttggctccgtagcgctcgaacatcggcgtctggaatttgactgctgcggcgcgcccgttggcggcctgcagcatacgcatggagaagagttcggcgccttcggcgtcgacgttgtatccccagtcggtgaggagcttgcgatgcgggtcaatgcccacacacagcggcccgtatttggccattgaattgcttaatcgcagaccgaaatccgaacgttgtgcctgcaattcctcactgctgagtgtagtcatcagaactcccgtcgctccaattcgaacagctgcttcgaatgctcctgaatgctcatgatctgataatcattatgcttcacggcctcgatagcgagcagtgcggcctggaactcggtgatggtggtgaactgcggcagatcggcggcaatggcggcggcacggatggagtagccgtcggaacgggagccgcgcgagttcggcgtgttgaggatcatgtcgatcttgccttcctcaatgagctgaaccacgttcttgcccacggatccggcagcgtgatgcacctcgaccggggcttccggatcggtgtccacgcgggtgctgatcttgtccacgatgttcgactcgatgccgtaacggcgaagcacggaggcggtgccctcggtggcccagagcttgaatccaagctcctcgagacgaacggcgatcaacggcagctgacgcttgtcggtgtcgttcacggagatgaacacgttgccgtgggtcggcaggccaccgtcgtaggcggcgagctggctcttggcgaaggcgtgcgggaagtcacggtcgaagcccatgacctcaccggtggaacgcatctcaggtccgagcaggatgtcgacggtcttgcccaccggggtgcggaagcgcttgaacggcagcacggattccttgaccgcgacctgctggccggggtggatgtcgccgccgtcgcccttgggcagcagcagaccgttggcacgctgatcggcgatggtttcgccggccatgatgcgggcggcggccttggccagtgccacgccggtggccttggaggcgaacggcacggtacgggaggcgcgcgggttggcttcgatcacgtacagtgtgttggccatgaaggcgtactgcacgttgatcaggccctgcacatggcagcccttggcgatggcgtaggtgccttcacgcaggcgacgaatctggtcgtcggacagggtggacggaggcagggtgcaggcggcgtcaccggagtggacaccggcctcctcgacgtgctccataatgccgccgatgtatagttcctcgccgtcgaacagtgcgtcgacatcgatttcgatggcgtcttgcaggaacttgtcgatgagcagcggggagggcaggcgaccggagaccacggtatcggccttggcctcggtaagtgcgcggtccacgtacttgttgagctgcttgtcgtcgtagacgatttccatgccacggccgccgagcacgtagctcgggcgcacgagcaccgggtaaccgatgcggtgggcggcttccttggcctcttcgaggctcagggcggtgccgtaacgcggggcgttcatctccgccttcttgagcacttcgccgaacagctcacggttctcggccaagtcgatggattccggggtggtgccgagaatcggcacgccggcagccttcagacgcgcggccagggacagcggggtctggccgccgagctggacgatgacgcccttgaccgggcccatcttcttctcggcctcgtagatctcgagcacgtcctcgaaggtgagcggctcgaagtagaggcggtcggacatgtcgtaatcggtggacacggtctccgggttgcagttgaccatgatggtgtcatagtccttgccaagctcctgcacggcgtgcacgcacgtgtagtcgaactcgatgccctgaccgatgcggttcgggccggagccgaggatgatcacagcctcgcgttcgcgcgggcgcagctcggtttcgtcggcgtagcagctgtagtagtacggcgtggcggcgtcgaactcggcggcgcaggtgtcgacggtcttgtagaccgggcgcagaccgtaggtccagcgcagttcgcggatggtgttctcgccttcatcgcccaaaccacgcaggtgggccacctgcacgtcggacagaccggcgagcttggccttcttgagcagcttcggggtgagggtttcagcctcgcgcaccgtcatggcggtctcattgatgaggaagatctgcttcaggaaccacgggtcgatcttggtggccgcgaacacctgctccagcgtggcgccgccccagatggcgcgcatgagctgcaggtaacggtgttcggtcggggtgtggatggtctcaagcagttcggccacttcttcggcggacggcttctcgccatcccaattgaagcccatgtggcgcttgtcgatggagcgcatggccttgccgagggactcctggaagttgccggccagggccatggcctcgcccacggacttcatggaggtggtcagggtggggtcggcgcccgggaacttctcgaaagcgaagcgcggcaccttggtgaccacgtagtcgatggtcggctcgaaggaggccggcgtggactgggtgatgtcgttgcgaatctcgtcgagcgtgtagccgagggccagcttggtggcgatcttggcgatcgggaagccggtggccttggaggccagtgcggaggaacgggagacgcgcgggttcatctcgatgacgatgatgcggccggtgtccggatgaacagcgaactggatgttgcagccgccggtgtccacgcccacgccacggatgatggcgatgccgatgtcacgcagcttctggtattcgcggtcggtcagggtgaagcagggggccacggtgatggagtcaccggtgtgcacgccgaccgggtcgacgttctcgatcgggcagacgaccacgacgttgtcgttgcggtcgcgcatgagctcgagctcgaattccttccaaccctcgatgccctcttcgatcaggacttcgtcggtgggcgagtaatggatgccggcgccggcgatgcggtgcagctcctcctcgttgtgggcgatgccggagcccaggccgcccatggtgaagctcgggcgcacgaccagcgggtagccgaacttctcggcgatcttgtcgacttcctcgatgctgtgggcgatgtcggagcgggcggattcggcgccggcctcgtcaacgaccttcttgaacagttcacggtcctcgccacggtcgatggcttccagggaagcaccgatcagttcgacgttgtacttctccaggacgccggcctcgcccagcgccatggcggcgttgagtgcggtctggccgcccaaggtgggcaggagcgcgtcggggcgttccttggcgatgatctgctcgaggatcggggtggcgatcggctcgatgtaggtggcgtcagccatctccgggtcggtcatgatggtggccgggttggagttgacgaggatgacgcggatgccttcctcacgaaggacgcggcatgcctgggtgcccgagtaatcgaactccgcagcctgaccgatcacgatcgggccggagccgatgaccatcacggatttgatgtcggtgcgcttcggcatatcacttaccttccttggagttgttcttcataagttcgcagaaacggtcgaacaggtaggccgcatcgtgcgggcctgctgcggcctccgggtggtactgcacggagaatgcggggatgtccacgcactgcaggccttcgaccacgtcgtcgttcagatcgatgtgggagacgaacaccttgccgtacttgccgttttcaaacggcgcgtcgacctgcttgccgatcggggcgtcgaccgcgaagccgtggttgtgggcggtgacctcgaccttgccggtggtcagatccttgaccggctggttgatgccgcggtggccgaacttgagcttgtaggtgccgaagccgagtgcgcggccgagcagctggttgccaaagcagatgccgaagaacgggtagccggcgtcaagtacctggcgcagcagctcgatttcgggaccggcctgttccgggtcgcccgggccgttggagaagaagacgccgtccgggttcaggttctcgatttcggcgaaggtgatggtggagggcaccacgtgcacgcggcagccgcgttcggccatgcggtgcggggtcatgcccttgatgccgaggtccacagcggccacggtgtacagcggctccttgccttcgtactcgccgcacggttcgatggtgtaggtctccttggtggacacctcgtcgtacaggctcagaccctgcatctgcggggtgttcttgacgtcttcgagcagctgctcgatggtcttgagcgcgccggtggcctgatcggtcagggcgtcgccggagaagatgccggcgcgcatcacgcctgcggaacgcaggtggcgcaccagcttgcgggtgtcgatgtggctcaggccgacgatgccgttcttggcgaggtcgtcgtccaggctgccttcggcacgccagttgctcacgttcggagagggatcacgcacaatgtatccggcaacccagatgcgggaggactcagggtcttcgctgttgacgccggtatcgccgatgtgcgggaacgtctgcacaacgatctggcgatcgtagctcggatcggtgagcgtctcctggtatccggtcataccggtggcgaagacgatctcaccggtcgtctcgccgagggcaccgtatgactcccccacatatacctgtccgtcttccaaaacgaggactgcatcgtccttgtcatacatcggaattgcgatggtcccggactcgttctggctcaccaaaacccccttatgtttttcgggtattcgtaccaaggttaacggccagcgcagactcacacgccgttgggcgcaaagtctcaccccgctggcggggctgtcggcaaggtgccgacttgagaatgtacggcggcacaagtgtccgcccatgaaaaagcctcccgaatggggaggctgaacaacaaatgactaatcgaccgtcggctgaatctcagcggacggggcagcaggctcgtcggatgcaccggacgaatcgggcgaatcggaaacatcgccctcatcggtcggctcggatgcggcggcagcggaatcggacgattcctcatcggcctcttctgccacggactccggtgccggtgctgcgttcttggcggtgcacaccgcagacagcaggccatggatgaaagcgggcgaatcgtcatcgcacagggtcttggccaatgccagagcctcgtcgatggcgaccttgtccggcacatcatcggtgaacagaatctcccaagcggcgatacgcagaatgttgcgatcgaccacgcccatacggcggaccttccaacccgtggagtgttcgtccagggtcatgtcgatctgacgacggtgctcggccacgcccttgacgatttcaatggcatagtcgggaagcggggtctgggcaccgggatgtgcgatgcgctcgtcaagcagggagagaatatcctggcttttttcgtcggcttcgtacagggtgttcagagcccttttgcgcgcggtggaacgtgccatactgctgctgtcctagtcctttatacggtcggtcgtctgttgaggatgcggagatcagttgttctcgcggccggtgtaggaaccgtcctcggtgttgatcttgacgcggtcgccctcattgatgaacagcgggacctgaatctcggctccggtctcaacggtggccggcttggtgccggcgttggagcggttgccctgcaggcccggctcggtgtgggtgatggtcaggaccacggagcccggcagatcgacgctcagcggggtgccgtcgtggaaggagaccaggcagtcagtgccttcgagcaggaacttggccttgtcgcccacgagggtcttcggaaccatgatctgatcgtaggtggtcatgtccatgaacacgaagttgtcaccgtcctcgtaggagtactggagagtgcggttgtccacggtctcgaattccatcttcatgcccgcgttgaaggtcttgtcgacgatcttgccggagagcacgttcttgatggtggtgcgcacgaaggcggggcccttgcccggcttgacgtgctggaacttcatgacggtccacagctgcccgtcgaggttcaggacggatccgttcttgatgtcgttagtagtctgtgccacgttattcacctatttcaaattcaaactagcttaggcaaagcccaaaaattgcctcggctattatgccacaccgggtatacaggaagtgaacgctggggtttcccatgtgcccccggctagactggatgaatatgcgatccttcttcgaagccatatccgtgtcctgcgtcatccccgcgcaatcgccggcggacgacgaacgcacggtgttcgagaacctgtcctttgctgtggagcgcggcgagatcgtcgatctggtgggaccgtccggctccggcaagtcgagtctgttgaccgcgtgcgcccggctcaacccgcatgcgcacggcacgttcgcccttgaaggcaagggcagcggcgagttcacgccgcagcagtggcggcgggacgtctcctacctgccgcaaaaaccgatactgaccggcaaggacgtggccgaggcgatccgcctgccctggacgctcgcgattcgcggcaagggcggcaaggccgagcagctgctgcccgacgaacgcatccgcacgacgttggacgcgatgggatgcgaggacatcgacctggcgcgcgcgccacatgacctgtcgggcggtcaggcggcgcgcgtggcgttggcccgcacgctgctcaccgacccgaaggtgctgctggccgatgaggcggacgccggactcgacgacgacaacgcatccaaagtggccgcgatcatggcggacgcggccgcacacggcatggcgatcatccgcatccgacaccgtccgccggacggacgcgccacccgcacgctgatgctcgatgcgggacggctcaccgatctgacgcgggacaaggaggtgcgcccatgaacggcgcctacgacatcgacacctggggtcttgttctagcgctgggcatggtggccgtggcggccatcatcagcgaactcatgcatatgggcatcggcaagaccctgatgtggtcgtcgtgccgcgcattggtgcagctgtgcgccatgggcttcatcatcggctacgtgatccggtcgaacagcgtgtggatggtgttcgccctgatggcggtcatgctggtggcggccgtgcagatcgtgatgtcccgcgcacgcggcatccccaagggccttgccgggccgatcttcctgagcctggtcatcaccatgctgctgatgctggcgctggtcaccgagctcatcgtgcgcccgcacccgtggtacgcgccccagctggtggtgccgctgaccggcatgctgctgggcaacaccgtttccgcgcttgctgtcgggctgagccgattctatgaaagcatggaggaacgccgcgacgaggtggatatgatgctggccttgggggcgacggcatgggagtccgcccgtccatccgtcatctcgtcgattcggctgggactgttgcccaccaccgcttcgctggcctccagcggcatcgtgaccatcccgggcatgatggcgggccaggtgatagccggcggagatccactgaacgccgccaaataccagttcgtggtcttcggcgccatcgccgcgctgaccttgctggccgacggtctgatcatggccatggtctatcgcacctgcttcaccaccgacgaccaatatcagacgcctaaagcacgatagcctcagtatcgatctcaggccaagcctcaggcgatggtgaccggcgtgccttccggaatttggttgtagaaccattcggcatcggccacagtgagtcgcacgcaaccatgtgaggccggctgaccgagcttgttgccttcctcttccatatactcgccggagttcgtcccggtcggcaccgagtggaacagatacgggccgtagaattgcacccaataatcggctcccatgccttcagatgcattatagaaatgatctccgcgcgcactgatggtataggtgccgtgcggtgtgacgtcatccatgccagtgctggcgatcatcgtgtagatggtcttgccattggacttgacgtacacctcttgcttggcgaggctgacgtccacgctcaaattggaatactgcgataggttgggttgcttaccagtaggattgctccaccgtgcgcgttgtgcttctttgttccgctgttcttgaatcgcatggttgaagacaggcacctgctggcgctcaacaaatgaagttggttgcgtcacggattgcttagccgctgattgagatggcgttgcgttcccattgccgctgccggggcggggccaagcgcgcatggctcccatagtcgagaaaactgccagcacacagcacaccagcgcgcatacaaacactatgattcgtcgtatggtatagattcgtttgcgacgtttatctaccgctacagggcgcttttgagccatagattccttctcatcagaaaggtattgcctgattgattttaatcagacattgcgacgcggcatttcccgagataaagcaatcgtgatacaaacgagaatcgtctctactcagcttgcctcggggcggcttcgggcaatgaagtgcccatggtttcgagacgcatgaggaactcgttggcgttcatggcgttactcaacagcgtgccctccgcaaacgtgcctccgatggaacggatgaactcaacctgatccaaagtctccacgccatcgaacaccacatggaacgcatcattatcgcgcgaaatctcgagcgtgcgctgcatgatctgtttcgcgcgaggcgtacggaaatcgcgaaccaccgtcttgtcgaatcgtgcgaaatccaacggaagatgcgcgaacgcagcaacctccgaatacgtggtgccagcattggtcaaacccaactcgacgttcggcaaagcggcaagatcggcaacctcatcatcgacttcatcatgcgccacatgaatggcatgcgaacccaactgcaaaccgaaacgcagctgtggctgctcatgagtcaactgctccaaacgctcgtggaagatggacgcacctaattccggaccgttcaggcaaatgtccacaatatccaattcgggtgccaccttgcggaacgcggtcatgtcttttacgcaggtttccagcacgtcgagtgtcagctgcacgctcatgttgagacgatgcgcttcggccgttacgaaatacggtgccagcgtacggcccttctcgtcatgcacgcgcacaatcgtatccagcgaagtgatgtgcttcgtattcacatcgaaaatcggctggtagagcacggaaatcgtattgtcttcgatcgcatggcgaagcacatcggacgcgttgacgtaatcgtttgaatcattttgcgcggcaagcatggccgtcgtgccgtcgaccgccggcagattggaactttccgattcgtaaatatgcacgctcgcatcggcaagcagcacggcgaaaccgtccgtcgcattcgagaacgaaatactgctcgacacctccacggaaacctcgccctcttcggtgtataccggcatgacggcaagattgcgcatgcgtgtggccaactcctccacatcactggttgacgtcacatcggtcacgatcatggcgaattccgcgccgttcacacgcgaaagcgtggcgttttccggcagcagctggcctaaacgcatgcctacggatctcagcacggcattgccgattttgcgtccataatgttcgttgacggcgcgcaaatgctccactccgaaatgcaccacagcaaccagattatgcacattctcggtctgcaaactcttcaaatgcccgatgaacgcacgatacgtgagtgctccggtcagcgtatccgtttccgcttcggtgcgcagcagtgtcacttccttgttcacgcgcaacgattcggcaagcactccgccgcaagtgagcaatatcgtttcgtcggtcgacatgaacggacgattcaaaatgctgcgttccatcgcaagataatactgtcgcgagccggtggaaataggcgcggaatagcggtaggaatatcctcttttatcaagattgtttgcatcgctgacgaaacagcgcatgtgggcaaggccacgattgatgcgcctcaccacggtctcctccggcacttgattcggcaacggcagtgcgtcgctcacattcgcaatgcatttcagcgcgcttcgggatcgcgcgagccggctcatcgtatcggccgtcatcagcaacagcgagtaggcgatcagtgccagcatgaacacggaaagcacggtggcggtatccgaaccaatattggcgaactgcagaatttcaggaatccacacaatcgctatcaaatcagccaaagccatggcaagaatgcgagacagcgaatactcgtgcatggcttcacgaatcggaatttgcgtaaaaaagaacgttacaatatcgcaaatcaatcgaataatcggcactgcaacagtcataatcagcaatggcagcaaccaattctcaaattgataaggattaaatgcagcattgacagaatgctggttgatagtaatcgacagtacgtgagaagtattcgcaaataatattttgattaaagggattggcgcaagcgtggttccggcgtgaagaatgccgattttcagactgcgtgcggtgataatcgacgtgatgatggtgacgatgatcaggaacatggtcacgtcgggaaaatagccggttaccagcagtatgacggtcaacggtggcagcacggtgtgttcggcggcaacgcgatacgacgaacgctttttgtggtagatcaggcacagcagaaggcaggccgaccatatgcagatgtgtgcggggtcttccatgaaccgctgtacacccgcttgcgcatgcacggcgatcgcggccgcaatgcacaacgcatagatgatggccagaatggtgagtctgaccggctttctgatgccgtcttttgactgactgccggtggttgtctgatgtttcgattgcttcgatgccatgattgttttttcgttcccttgttgcgcgtcacttttgatggaaagtagcgactgccttgtgttaccgccttgtattgtgtctgtggttgcgcctcgctgcagcaagcgtttatagcaccggtccgatgatgcgccacggtgcgttggcgccttcctcggcgctgtctggctgcttgttttcgttgttgcccagcgattcgtagatattgccgttccagatcaccttggcgccttgcttgtacagtacgtctggcttccatgtggggtaggcctgctgcgaggaattccagcttgcgttgtcgaaatcgacgagcgtgcccggtgtgcctcggaatcctgatcctagggtggtggcgaattcgccgcccgtctgtttcatgccgctgcagaacgttttgagcgtgtttgtgttcgtatagttttcgccgcattgctggtcgcggttcaacgaccacatgcttaagtgacccaggcttgtttccagtgcgaacgtgttgatatcgcgcgcattgtcgagcgtgaaatactcgtttttggtgtcgttctggccgatgagcacggtggctcccagcagttcccagatctgatggtcgctgaagagtttgccgcgactgtacagcaaggttttgtattgcgcatgggccgcgttcaacgagcttttgatcagggtggattgtgtgatcgacgtggatgccacgttgaaatccatggtcatgagattcacggtggagagcgtcacgccggcgtccagaaacgcattcacggtttgcattccttgtattgtaagacctttcatgtcggctggaagcgtcaggctgatgatcagatcgtggctggtatcgtcttttcctttgtttttcgttttttcattggcgatgagttttgccacggcctgcgctcgtcgggttgtggtttcgctgtagccgtcgagattcgtgttttcgatatcgaagtcgagcgaggtgacatgatagcggtcgatcacctgctggtatgcgtcggcaagcgcgtcgacgtcagtgcatgcggcggccagttcggtaccgttctgcccgccgaagctgacggttatcgtgcggtcggttttgtaggtttgcgcgatgcggctgtcaagatcaagtgtggaggccgcttcgtcaagcgtgtaatagccgccccagcttggctggcagccgtcgccggcggtgatgaaaccgagggacatattctgatagacgttgcccaccttggattcaaacttgtatgagggtgttgcggtcacgtccacatagccgccgaaccagggttccggcaattccttagccgccgttcgcgtgaaggtgatccacgaccatgtgccggccgcaacgagcgcgatgcacagtatcgctatgaacaatcggaggaaggaaaatcgccttcccggaaacacgggtttcatcattccctttcaaaaatcgttcagtcgtcatgccgatggggttatcgggtggccgagcaggctgtgccccccccgcttggcttcagtgcgcaggcgggggattttacggggggttgggtgtgcctctcgtgcgctggctttcttatatctcgcttacatcaagggagcatagtatgtggctggtacgacgatttaggcaatgacgtatgtttttgcgccggtgaggcgttgttgacgatgcaaagggggtttgaggtggcaaaacaggggggaggtaataaaggcggcgatcgcaaacatcaatggggagcggaaacctccacgcaaccacttgcgattatgcatgacaagccttcgccgacgcgagttgtgctcggctatgttgcgattgcatgcacggttatttcatggcttatctacatgatcacgatgattctgtcattgttcgtcaacaatccctcactcacattgcgtttcgtggttgaaagcgtgctgtacatgacgattgtgaccacgctgattttcagtgcgctcgtctacttggccacacggcaaggagcgctataccgcttcatccggcatgaacgcgtacctcgagccatgctcgacaaccatttcgcacacaactacggcaaaggcattaccgtactcatcccatcgtatgcggaaacagccaaaagtcgtcgaaaaaacaatctggtcggcggcattgcaggaatttcccgaccttgccatcgtactgctgattgacgatcctccgcatccgaaaaatgatgaggcacgggcgattttaaaagcgagtcgcgaactcatgccgaaggtacttgccgaacttgcggcgccggccgaacgcttcacgaaagcgcgcgacgaaaccgctgcggcgctcgtcgatcagatggctgcgaggcgtagtgtggtcgcacgctgtgcggaagactatcgtgcggccgtgcaatggctggaacataaggccgatacttggctgatcgaagatcataccgacgatttcttctgcgatcaggtattgcgcggtcttgcacgcgacttgcgtttgacggaacaggcgttgaacgaatcaatcactttgcagcagcatgtcgacgcgaatcgcattctgcaactgtacgaacgtttggtgcgtatcttcaccgcaaaaggatggtctttcgaacgcaaactgtacgcatcgacttctcgcgaaggcaacaaggccatgaatctgaattcgttcatcgggttgatgggccactcgttgaagcgtgtggaaacgtcggatggcgtgattttgcgtgacgtgcgcaaggacgaatctccggatttcgtgatgcgcgattccgaatatgtgctgacattggatgccgattccatgctgctgcgcgattactgcctgcgtttggtgtaccagatggaacagccgggcaacgagcgtgtggccgtgatccaaaccccgtattcctcgtatcgtggtgcgccgacgcgaatcgaacgcatagcggccgccaccaccgacattcagcacatgctgcatcagggcatgacgtactatgacgccacgttctgggtgggtgcgaacgcggtgattcgcaaggccgcgcttgacgacatttgcgtggtctcaactgagggcacgcgcacggtgaaaacgtatattcaggatcgcacggtgattgaagacaccgaatccagcattgatttgggctatttcggctggcatttggttaattatccggagcggttgagttatagtgccacgcctccggatttcggctcgctggtggtgcagcggcgacgttgggcgaacggtggtctgctgatcatcggcaaattcttccgcattgtgcatgcccggcatcagcagggcaatgatgtgaagctgggcgagtgggcgttgcgcgtgaactacatggcgtccatcgcatggtcgagtttcggcttgatgttcctgttggcgtatccgttcgatcagcggttgctgagcccgtgggtggtgctcgcttcgttgccgtattttgccaccatgtcgagtgatttgaaacgtaacgggtataagcgttctgatattttccgtatttacggtttcaatatcgtgctgttgacggtgaatctttccggtacgctcaagtcgattcagcagggcatgacgaacacgaagattccgttcgcgcgtacgccgaaggtcaataatcgtactgcgtctccggcattgtatgtgacgatgccgtgggtgatcattatttattcgtgcatggtgttctatgccgatacgttttcgcataattggggtaacgcggtgttcgctggattcaatgcgatcgtgacgttctgggcgttgaccgcatatatcggcatctggcattccgtgcaagacatggtggttggtctgatccgttggtttttcgtaccgatcaaggagccgcagcaggaggcggtccgcaagaagtcctcctggcgtgatgccctctatttcggcgaccgccaaatgatctacgagtcccgcccgttatagcgtgctccccgcggctgtctgcacaatccgtgatttgcggtctttttttcgggttgtgcagacgggtttggatatcacggcgtctgccacgccgattatcgtgcgaacgttctgcgcatccactcaacagccggttgcttcgaaaagcagataattgcggatcatttcgtcgatatatccgctgacggtggttggagagatgcgccggccgcttgcggcggaattcgcattcgtgcatgtctgcttacatgtccgatacatttttcccagcgaattgacaggaacacgcatcattcctccatgacttgggcggttatatggaacatgtcagcggttacggcggctggcgaggttcctgatgaaccccataactgaacccttcttctctcttctctctcagccggtggcctttctctccgccggcttttctcttttctgaacaggattcatgcgattgcgattggtgtttttcgaggcttctgctgttttcgtgggttagctgactggttccggtagtcggatgtcgagtccgcggcatcgtccttcagggcacgcagcagggacttgttgcgggcttcgatgatgcgcttgccgtcctcgccctgccaggagaagaagccctgaccggtcttggcaccaaggttgccttccttgaccttctcggcgagcagcgggctcgggccagtgccgttgtccatgtcgtcgaacaggtaggtgctgatgttgtagaacacgtcgagtccgccgaggtcgatgctggcgatcgggccgaccaggttccagcggcggccgaggctgtacttcatcacgtcatccacggtggccgcgtccgcgatgccctgctggacgatgtggaacgcctcgcgcagcacggccagttgcagacgattgcccacaaagcccagcgattccttcttgatcttcgccggcttcttgccgatcttggccatgaggtcgaaggtgatgtccactaccttcgggtcggtcttctcacccggcaccacttcgaccagcggcatcaactgcgcggggttccagaagtgcgccaccacgaagcgctcggggtgccccatcaccgactgcagcgcggtggggctcaggccggaggtgttcgtggacagaatcgcgtccttgggggcggcgtgctccacttcggtccagacggacttcttgatgtcaaggttctcggccacggattcgatgacgaagtccacgtccgccacgccgcttgcatagtcggcgtaaccggtgatgcgggccagcaccgcgtccacggtgtcgccgtccttgagcagtccggcttcggcgaagtcctcggcatccgaacgaatcgccttcatcgccttctccagcgaggcctcgccgcggccgaccagatgcaccggatatccggccaacgcgaactgcaacgtgatcgcgtggcccatggttcccgtgccgacgttcgcaatcgtcttgatatcgtccactgtctcaatcacggagaccccttctttccggcggttcgtctggcgttggtgtacgcatgaacagcaccgtgccgttatgcgtttgttcgcattctatgccgatttcgctacgtgaacatttgctgaacatttcgcggattcgactagtacaaatccccatatcagcacaaaaacgtggtgccgcaacaccgaagtgttacagcaccacgctgaaatgttcatgtcgttacgctgccgtcgcgcacccacagcggaatcgataggaaacctcaccggagtaggtgaacacgggggcgaccagcatggacggaccgaacatatactgacggtccagcgtgcggcatgccgggtcatcggggaattccacgaacatggaacgcatgaccggagtaccgttcgcatgaggctgcaggccaagctggtagacatacggcatgagttcaagcttgagcttggtgaactcgcgcaccacatccacggcggtctggccgggcaccaatgcgacgccgttcttctcgtcttcctcgtcgaacagccacggcacacggtacacggtggaaccgtgcagtcgcgagtgggagccgagcatgccgaacgccacccaacgcttgtagacggccgggtccgggaacgcgccctcgaaaccgccgatgtcgtgactccagaagccgaagccggaggaggtcagcgacaggccggcacgcagggactgggccatgccattgaaggtggattcgcagtcaccgccccagtgcacgggctgctgctggccgccgaccgtcgcggagcgcgcatacaggcaggcgttgcccttgccgtaggtttcttcgatggcttcgaacacggcctggttgtacagctgggtgtaccagttgtgcatggagagcttcggagagccgtcataccagacgacgtcgcgcgggatgcgctcgccgaaatcggtcttgatggcgtccacgccctgattcagcagggccttgaccttgtccttgaaccattcacgggcggccgggttggtgaagtccaccaagcccatgccggcctgccagaagtcggtctgccagacttcgccattgggcttgcgcaccagatagcccttgtcttcgtgcaggcgcttcagcgtggattcgatgtcgccgaagaaacgcttgtcccactcgaaatcgcaccaatggaactcgcacatccagtagcagtcgtagtggaaggcggccagcggaatatcacgctcggccataccgtcgatgaaggagttgatggtggcctcggtgttctcggaaccgatctcaaaggagacatggccgcggttgttgaccagtacgccatacccattggaggtcatgtagaacgggatgtccttgtagccctgctcggaagcagtgccgccatcctcattccagatgtcgacgctctgaccattcttcacgtaagcgccgaagcgttcgcccaagccgtatacgtcttcgccaaccgacagatgcagctggatggcaatgaacacgtcggattcatcacgggcggaaccgtccatggtcacaccgaattcgctgaccggctgggcggtgacgttcgattcggcaccgagcttgaatcggcccagcgacttgcctgcggactcagtgagcaccttgccgtcctcgccgatgaaggtcaggttccagggggcgcccttgacgaccttcacggtaagtccgccagtggtcagcgtgacatccgcgccattgacgccaacttcgccgtcgccattgccgttcgcctgaacggtcacgtaatcacggttgccgggttcgtcggcattgagcgggaatccggggtattcggtggcgccttgccagtgttcggcacacacacgaatcacgccttccgcaggtgtggtgatgtccacattgaatgtgggcaggttcagggtatcgtatcggccgcgcaccacggaggtcggggcgaggacgttgaggctttcggtggtggcatccgccgccagttcgtaggcttcacgagcgtagagggcgtcgacgccgtcacgaatcatccagtagccgttggtgaacttcattgttgctgctccttggtggagaggtggtttcgaccgccagggaacaaggcagccgaaaccaaaatcaatatgtgctgcttgttgattgaattgcctgttgtgcgaatgaccttacttcaccgcgccggtggtgatgccgtaccagtcgccggagcccatcatgccttgctcatcgtacttgccggtgtcggccaaggaaccggtgataatcttgtcccagccatattcggacacgtaatcgttgaggttggtgagcaggccttggctggcgagcaggccggacgtggcgttgcccttgttgtattccgtaacgtccggagcgtcgtcggagttgaggacctgggaggcgttctggcgaatctgttcgaaggccttcttctcgaattcgaccttgacgccggtctcacacattttcatgctttatgcaaaaaatgtgaggcatacgcacatttcccatcaaacgcacaggtgcaagaatggcagcaattcgccatttttgaaatcaccatgtgcgtttgacggcgcgtaagcctcacattgttctcagcaggaccgaatttctgcgagccccccctatagcgctcccctacgcaatatgtccgcaaacgaccacaccacatgggcgatacgcgccaattcggcgtaacggccgatggacagccactgcacacggtaccgttcgaaccacaactccaaatcggcggcaagacgggcgcggcgcgaggcatccagcgcacggccggtcacatccttggtgtcacaggcgtcctcgccgccagccaataccagcagttcctcacccagtctattgaacaaccgctgcccatccagcatcacccacagcagctccgggttcaatcctcctcgtgccgagccatcgagcaccgcgacaaccgcactgccgcaatcaatcaacgcccggtcgcaatcccggcgtcgttcgagacgggcatggttccgcaggagcaatcggcggcgcgcgtcggcgcatcccagcgcacggtcaaacatgagctctcccccgcacgaccgttccacatacgatgccacatccgtattcagcatgccggtgccggaaccgtattccagttccagcacttgcacggcgaggtcccaggggaacgacactccatcggagtcgatgcgagcgagtgaatccataagccaaccggattcgtcgccatacgccagattagaaatccgatggttcatttcgcatgcgtcaattgcaaccgggttccacgcgttttgcgcaccgtagcacagtcccggcacgctcaaccgcggatcattgacatgcccatagtcaccccaatcggtgaccaccatgccttccgcaccatatttgagcccagccaccgccatgcggtacgtgttcagccaggcaccgtcatagtcggggaagaaccggctccacgcacgcacggcagggcacacgaattggcggcggccttgtgatgcgatggtctggatcttgctttcgtcgatatccggctcatacatccagttgagcatcgtgatgtcgccgggcagcaagtccatggtgtgcggattctcgagcgcgatatccgcccacagcatcggttgtagaccacgatgggcaagcgtgctgcataggtctttgacgaaatcggcatacagctcatcgcgactggcgcccggcgagtcctgtacggaccggccacggcccaagtcgaaagtctcatcgccaccaatattgaaggaccgcgagcggaacagcggcgcgtattcctcgattaggcgcgaggcgaaatcgtgcgacttggggttggctgcgttcagtgtgtggtgttccattcgttcgatgaaactgaacggacggtcggcgtcttcggggaactctcccagtccacgatgttcacgggtgcgcaggttcatatacatgtgcccgaaagtggccaaggacggcaccagttcgatgccgtggtgtgcgcagtattcgtccaggaacatgatgtcgtcggccgtgagcgggtcagtgccgcgccacgcttcgctgagctcgccgaaagcgaaggcatgttccacgtacagctggaattggttgtacttatacaacgccagctggtcgatgaaccaggtgaggaacgccatcgtcggcacacgcccgcgcgtcacgtcaagactgtaggcgcgcaccgcgaacgcaggcttgtcttggatatgcaggcagggcaaggtccgcgaggtttgcctgatcatctgccgcagtgtctgcatgccgtaccgcaatccgctttcgctgccaccacgcacggcgatggtatctgaggcgaacacatccagcgtgtattcgtcatgcgccaatcgcgcatccacacacaacaatatgacggtgccgttcatcgctgccggcgcacccgcgcccgcacccgcacccacgcccgcatctcgcgctttttcggcggcattggcaccggcgtcggcttcatctgtggctgtgagtactcggcgcgtacggacggcgacgccgcagtaacgctcgagttcgctggacagctgctcgattggcagcgtttcccaggtctcatcggcatcttcggtgacggcatattcgggaattcgtttctcgatcgtcaccaaggacccgatcatagccgtgccatgcgtgtattccaatgtcaccggagcgggaatcagggtgagacacggcgttgcggcatcagccttatattcgaatgtgggcacagctgttcctttcatactgtttttattatcgttcatccgctgacggcaggcgacacgcggtcacgccgccatcagcggacgaatcgtttggtgaggtacggcggcatacgctatttcacggcaccggtcgtcacacccttcatgatgttgcgctggatgagcatgaagaacaccaccaccggcaacgagaaggtcaccgaagcggccatctgcccgccgaaatcggtgcccatggtgggtgtcgagaaggacgacagccataccggcagcgtgtacttcgactggtccttcatgaacgtataggcgatcatgtagtcgttccaggcgttgatgaacgcgaacaccgaggtcgagacgatgccgggcgcggccagcgggaaggtgatcttccacaggatctgccagtcgttcgcgccttccacggccgcggattcgaagatgtccttcgggatgttcaggaagaacccgcgcatgttccagatcgcgaacggcagcaccatggcgatgtacgccaggatcaggccgctgtatttgttgagcaggccgagctggttgtagatgatgatctgcgggatgatgccgccagaggtcatctggatggccagcacgaacaccatgatcggcttgcgcccgcggaagcggtacagggtcagggccgtgcacgcgaagaacgcgacaataatcgacaggacgatcgagagatgcatgggccagaacacgggggtcgtggtcatgatctcatcgcgcggctttacggcggtgataatcatccagtagaccgggaagaaccatacgacgcagaacagcagggcgaggatagtggtgccggcgcggcgcgcgatcttgccggggttggttcggcggcggggcggtgcagactgcgctgcgccatgcgatacggcccgtggattctcaacacatttcataaggacgacccgctatttcagggattcgccaatatcagcgtgccagtcgccatttccggcgtcggctatggcagcgccaccccttccccaccgtcgacatcgacaaccgactcgcttcacgcaagctcaccgagcatatgttggggcgcgggtatcgacgaatcgcctatatcatcggaccgtcgtacttgccgacgtcgacgccgacgccagcgtgcccgcagctgaccaccgtgcgccagccaatggacgcattcggcgtcagcttggctaccctagtgcttgaccagatcgaggaccggccgttccagcgcacggggctcctgcccaccgaggtcgtagccagataggcgcgcagagaacggttctcaataatgtctgtgcacacttctctacgcccgaagcacacatggaatatgccctaatcactgccatgtcgccatttgcgatgatgtgagattgttatgttcttgttcatttgagcgcacagatactactgagaaccgttctctgcgcaaatagacaatgtggataactccataagctggaaccacattgccctgcctggcttgcattcaagtccaaatcagctttacggtcgcaccatgagctcttttatgcatgaggatattgtcggccgacgccgagcagaacgtgaacgctgcaatgatgctgcgcgccgttcgaaaggtccattgctggtgggatacatcaatgcggccaactactacggcgcgcccatcccccgacattgcacgctatctgttgatgccgtgcacgcctgtgtttccagtgccaacaaacgcagacgaatcaaaggcgtggtcttccatgtgtttaagggaaaactggatatccgcaaaaaggattatgaacagttctggattgcctcgccggtcatgatgtgggctcagatggcccaatactctacattggaggaacttgcggccattggagcctctttgatgagccgcgataaacggcgcagaatggccactcgcaaggatttcgatacttacttggaaatcagtccgcggttcataggtcgtaacaaatgccacgaggcactgccctacatgacagagaacacggattctccgccggaaaacacgctgtttgggatgctgaaggattcaggcttgggatgccccaccgccaactatcgcgtgaatatcggcaactcatacgtcatattggatatggcatatccggactgccgcgtcgcgttcgaatatcagggagcctatcacgccgatccggcacaaatgcgaatcgacgcggcaaagcgaaacgcattgcaactgctcggctggatcgtcattctcgtcactgcggatgacctgagaacagccgacacgcggcatcgttttatcgagatggcccatgtcgtggtgtcccggcaacgcaatctcgccgattggaaccgctcatgggccattacctcttagcatcgcaccgacaatgcgctatgccgttatttactgcgaggcacccgccagatatcgggctcaacgtagatctcccattcataccaaggcagcgcggcacggcgtcctcgtccatgtgaatggcctgcaggttaatgagcctatccacgccgacagtgcgctccattgcctcgaccaccaggtcgcgggtgctgtggtcaagcgattcgcccaccagcagcgaaccggacttaaacgccaacgccgcctacaaaagtgtgaggctgcgcaggctcacactgccaacagccgttcagccaaccctcggaaggtctggccaatgccatccgtacgcaaagcgccgtcggcgtccagcaccgccggccggccggcctcgccggtctcgcgcacttcgggttccagcggcagctgggccatcagcggcacgtcatagcccagcgcctgagtgagctgttcagacacgcgctgaccgccgccggcaccgaaaatctccagcttctcgcccttgtgctcgtagtagctcatgttctccaccacgccacgcaccttcatcggcacctgcagggccacgagtccggagcgcacggcgatgtcagaagcggagggctgcggggtggtgaccaccacgagttcggcgttgggcagcgcctgggccacggaaatcgccatgtcgccggtgccgggagccaagtcgagcaagaggacgtccggctcgccccaccatacgtcagacaggaactgttccaaggagcgctgcagtcgcggcccacgccacagaatcgcccggtcagcaccggcgaacatgccgatggagatcagtttcacgccccacgcggtgaccggcatgagcatgccattcagattggtgggctgtgtatgcacgccgaacaggcgcggcagtgagaagccataaatgtccgcgtcgatggcggccgtgtcgaagccgagggccgcaaacgtggcggccaggttcgcggtaaccgaggacttgccgacgccgcccttaccggaggcgatggcgaagatgcgggtcttgacacccggtttgctgaaggggttctgcttgcgttcggccttgaggtcggcgaccagatcggccagcttgtcacggctcatcgaaccgacttcgatatgaggcagcagctgtgcgcccggataggagctgaccgcgccattgatctggctggtgatggtctcgctcagtgggcatccgggaaccgtcagctcaacgtgcacggtgacgtcgtaagtgccggcgtccgacgatgcgggcgcggcttcgatggcggcaatcatgccgaggtcggtgaccgaacgaccgagctcggggtcgatgaccttgctcaggcgttcgtagatgtcggcttcgatctgacgtgcgtcgctcataaatccgtatcctcctttagggcctgttctaccctagcgtgtgatgcggcggcatgccagagggagtggagtaagtcacactggggcgggattcgctttttctctcccccagtcagcctaaaggctgacagccccctcatcagaggggggttaatgaagcgtctgagggggctattttagatggtgccggtggctaggagctgggcgaattgggtttcgctcagcatggggatgccgagttcctcggccttggcggccttggagccggcgtttgcgccaatcaccacgtaatcggtcttcttgctcaccgaaccggccgccttgccgccgcgctcgataatcgcctctttggcggaatcacgcgaatagccctccaatgaaccggtgaccaccacggttttgccggccagcgtctgcggcaacgaactggtctcggcctcgtcgacgcccacgccggcggcctgccaagcacgcaaagtcgcgccgcgccagtcgccgggttcgcgggtggcggcgaaccagttcaccaccgattcggcgatttccgggcccaccccgtcgatggccgtcagatcttcaatcgtggcgttttcgatggctgccagcgagcccatcgccgaggcaatcaggcgtgcggtaggcggaccgagccggcgaatcgacaacgcgaccagcacacgccacaggtcggcgtgacgggccttgtccatttcgtcgaacatcttgcgcgtgttttcgccgggccgaatgatcaccggtacatccgtgacgccagtgcgcgtggtcttgtgatccacgcgcacgataaccgcgtcggccggcacgtcatactcaggataggaggctgcggcaaagcccggcatagtaccaagtggcgcctcagccccggtaggtgcgccggtcgtctcgctggcggtacctccctgtgtttcggcagattcgattgcggcctccccttgcgcgcgttcggccagctgcttggccgtgagctttttggccggcgtgggcgcggtccagaaagcaggcacctgatgccacaggccagagccgccgacacgcttacgcacctttttcttcttaccgttcgcaccgaccgtctcatgcacctcgacgattgcggcctcacgccacacgcgcacgtcgcgcagatcggcggcggtcaggttgaacaacccggattcgttggacaacaccggcttctgcgcgaccggcaattccagcccttccaccggctcgtacgggtcaggctcttcgccgggggcgaccagaacctcggtgatgttcggcgcgtaggtcgccaccgaatcaggccggttctcctccgggttggtcagagcgatggccgattgttcgcccaagtgctcgatgtcgaacgccttgcgtgaggccagcgaaatcacgcgctcggtcaactgggccgggcagctctccacattcgggcagcgaatgtccttgtccccctccttggcgggtgacagtttcgcgccgcatgaagggcagaactcgggcatgacgaattcgcgcagctggtcctcacgccctttgcgccgttcaagcaccgggccgaccagttcgggaatcacatcgccggccttgcgcaccaccacggtgtcgccgatcagaatgcccttgcgtttgacttcaaatccattgtgcagcgtggtacgagccacggtggagccggccacgtagacaggtttgagcacggcgaccggcgtcacgcggccagtacgccccacctgcacggtgatgttgagcagttcggtgttgacctcttcgggcgggtatttgtaggcgatggcccagcgcggcgcgcgcgaagtggcgccgagggtacgctgcaggcccaggtcatcgaccttgacgacgatgccgtcaagtgcatgctcgatgtcgccacgatgctcgccgtagtactcgatcatgtccaggatctcctggaatgaggtcaccgcacgattgtgcggggagaccggcacgccccacttggtgtatagatcgtaggcctgcgactggtcggcgaccacatcatgggtgccgcgcggatggtccggcccccaagtgagctgccccagaccatgcgcatagaagctcaggcgacgggtggcggtgatgcgagggtctttttgacgcagcgagccggcggcggcgttgcgtgggttggcgaagggcgctcgtccggcgtcctcctgctcgttgttcagggtgtggaaatcatcccaacgcatgaacacttcgcctcggatttccacgaagtccggaacgtcttccttggggccgccgaggtttgcgggaatggagccgatggttcgcacattcagggtgatgtcttcgcctgtaacgccgtcgccgcgcgtcagtccctgttcaagcacgccgttgcgatagatgaggttcagggcgaggccgtcgattttgacctcgcaactcatgggcaggggcttggattcaggccaatcgaggtcgcgaatcaccgagtcgtaccaatccttgagttcttcgatggagaagacgtcgtcaaggctcatcatgcggctggggtggcgcacggaggcgaagtcgttggagaaggagccgccgacgcgatgggtgggcgactgcggattgtccagtgaggggaacgccgcttcgagtcgttcgaggcaacgcatgcgcgcgtcgtaggcggcgtcggagctgacgggtgagtcgtcgatgtagtaggcgatctgatcggattccacccatgcggccacgcgagcccacaggcgggcggcggcctcagcggtcatcgtgttcacgtcgaaacggtcgaggcgtatcgcgtcgtcgtcagtgggctgcagtgcggctatccattgttcggagccaggggcaaaacgtgcaataccggtatcaggccggacctcggccacatccccatcgtcgaaatcccatgccagttgttcgttcgtgctcatggttgtctatcctagcgggctcggctcccctcggccggctataccgtcaactcccctcaggcggctacgcggatagcgagcgcaggaactgggcttggatgatgtcgatgttatcgccttcgccgtcattcatgcgggccacagccaccgagagcgtgcgggccggcacgaacatgtcctcatccacgcacacgcgagcggcgtcacgcacgatgtcagccacttcgatatgcggccagaccggcagatcatgcgtggcaagcacatgggcggcggcctccaccgattcaggcaccggtatgcactgcgagtccgcacgggaaaccagttcctgcagttcgctttccagcgaaccaatggccccgggagcgatgtgatcgctcataatgtaggctgcggcggctgtgtcgaaccggtcaagcatccattcggcgtacgcgaaccggtaataggcgaacgcggcatcgtcgcggtccaaggccacgcgcagagcattcaggcaggcggcgcgtgccgaatcccaatcctcattgcgggccagttgaatggcgagcttcagatgtgagagcgggtaggcgggcgcgtacgccaccatacggttgagatgcgggatggccgcctcggcacccttgatctgactcaacacgtcagccagctccatgtgcgcgtagaacagattgtccgggataagcaccgtacgctcgtccaatgtggcgaacagccggttgtagaccacgcgctcggcataggagttgaagtatcgaggtacgccatggcctgccgcatacacctggtccaaatgggccacggccgcttcggccgcttcgatggcctgatcggcttggcccgagaacagcatatctcgggcgcgcagacgctccttgtcaagatcgtcggcaagcgtgaacgtgaagtccggcgtgtccttgccatcgatcaacgcactggtgacctgagaggccaaaccggtcagttcgggatcgcatatcgattcgatgacctgcatggctcgctgggccttttccacggagccgagcgacgtgttcctggcgatatcgtggaattcgttgacgccatgctgcagcaggtccactcgctggatagccagtccggcactattctgtgcgcccagcacgtgagcggtcgccggactgaattgacggtcggccagttcgggctcctcctgggatccggtgggagagaaccggctgtccgccaagtcgaagtcggcgctgatgggtttcagaccaccttcgccgtccacgtccatcacggcaccgaacatgcggtaggtttcctcgggattgtcaagcccagcggtgtccagtcgcttgaggaaggcatcacgggtgaaggtgacggtgaccatattgcgcacggtgggattgcggcgcagcacactcatcggatcatcgtccatgccggcggccccatcagcaccgtcagtgccgacgccctcgccgccgataccgcccaggtcgtcgcctgcgccagtatcgtccggcatgccgaacgccatttcgtcgatatcgatgcccttcatcaggtcttcgaactgcgaatcgatggacgcagcgccatcggcgtcagcagattcggccgcggcctgatccgtagcatccgcagacggtccggtaccgttgcctgctcccccggccgtgccgcgttcgtcaccggacgccgtctgcccgaacgtctcctcatgggtgatggggcgggtcgggtcgccatggaaatcaccatctttggggtcggctttggaacccacacgccccaaatcgccactgcgtagatgttcgaaggcgcttagggcctcgctcatcatcgcctcgatggcggaatcctgttcggcaatcgcctcttcaagaccaatggaatcgatgtgcaacgacacctggcgcacggattcgctggtgccgaaactcagcgctgccatcatcaggccgacacgcaggttgtaggcggcgctcatcgacgcgcgttcggcgctgctcagcgcacgccacgtacggcgagtggtgtcataccggctatcgggcatcatcgaggtgccggcagtggtgaagccaatggccacttcacccgaatccaagcgcgaccggaactccacatcaaaccgatacggcaaccgtaaccggcgcaacagtgaggagagggtctgacgatacacccattcgtcgctcctcgccggcgaacacgaaggccgagcggcttgagtgttggtgtcgctcttattggtccgctctacagcgccctcaacactctcagtactttcagcgcccgcagcattcgtcacacccgaatccggcacgttctgctgggtcagcacatctcgaggatcagggaattcactgcgaatctgcccagccgtgcgtgcggcgatatcgaccaggctcagcacggcccgacgctcctgctcgccatcatacgggtcaagcgccataatcgcagggttctcaatgagtttcatgtcgatttgcgcggcctcggcacgggtcaccgtatcttccgtagggttgcgccccaaggaagcgttgcgctccagccaagcgctcaccgcagcgaatcggttgaggttgccttcgatcttcaaggatttcagcgcctgcccgaatgccaaggacttatcccacgtaaagaaatagccgctcgaatacgtcgaggtgtacaggtgcaacggttcggcgccatgcaccgcttccagtcccggcgtggtgtcgagggcgccggcttcgcgcatcagattggcgaagtgatcctccagaccggaggcccgcatgccgtgggctcgtgccgccaaagtgtcacgcaccgaacggcgaatcgcaccgattggcgcctcacggttgagacggcggaagatattgccggaaccgaatccgatgagcagaccattgatctgcggcaacatatacgtggcgaagaacgcgatggtaatggcatcgcggtattccaaatcatgacgcatcacaggcggcagattggcacgcatctgctcaagcgtgtaccggttgccggccttgagccatgaggcgagccacgtcatgcgtccggtgtcgtcacgccccaccacgccaccggtaatggccttcacgccgtcagcaccatgaccaaggccacgccccaaaccacgcccatgatgcagcgcacttcccaggccatggcctgtacgggagaaaccggaacgtgaacgcggctcgtcgctttcgcccagccgctcaccgtccggcagagtcacttccttttccttgccgaacatgaatcgcgcctgcatatcctgcacgtccatgttggggtcggtgcccacgaatacgcggccatgcgtatcggcgaacgccacctgcgcaaaatgatcgcggtcggggaaaatgccaagcgaaaagccacggcctctggtggagggcagctgcgcccatccaagcaccagcccttccggcacgttctccaattcggggaaggtgcgccgcttgattacaggactcagcgccactgcatggcgagtcagttcgtcgataatgccgcctttacgctcactgatctcccgcaaggcatcgccgaacggattcgtatcgtgcttcttcggcttggacagtcccagatcggccgcgagcgcgttcatcgaatccttcagcccgcccagcagtggcgtgcggttgtgcttcccatggtccgatgtacgttttggcatgattcacattgtctcttgtttgcccgacatcaagcccgaataaagcctatagaataaatgcgtgcattccatagaccacactcgcgcagaccgtccgatgccgtcgaatcatgaacggcacctgcccagccgcccggatacccggcaccggctgcgtttggtgcgcctgctgatcgccttgctggccgccgtcgccgccatcgccgccatggagtgcatcgtgttcaacctgccgttctggcgtacgctcggagcgagcacggatacgaacgccgtgcataacacgctgggttcgggtctcacgcgccggaatgatggcatgttgaccgtcaccgatccgaccaaggcctatcttgaactgaccgcggacggcacgtcggattacctacgcatcgataccgagagcagcaaggtcatcgataaggcccgcgagcaggccgaggccgaatccaaagcgaacgacgataaggaagtcttcaaaccgctggcgaccattcatgtgcgcgcggatgtcgatggcatcaccggcaaggcccagtcgatgaatcccgacgctattcgcagccattatgtcaaggcgccgggtgccggcatcgtgcgtatttggattcaggaagagcgcggcgcgatcgtaccggtcaccgacgcccgcgccaacgtgcgcgtaccgttcgtcatcaattggatgcgcgtgctcgccatggccttggtgttgctgatgattgccgtctggaggccgggatcgcgcctgtggcgtatcacgcttgacccgtccagcactcggcaacgacttgctttcgtggggcttctggcgattcctaccctgcttatcggcgtatccatcatccacgaactgtggtacacgtcttcgctcgtcttccacgtttccggcgattacacctatgatttcgaccagtatgggcatgtggccgatgcgctggtcgccggccggccctggctcgacttgccggttcccgaacagctggccgccaccgagcacccctatgacgtagccacacgtgcccagctactcgccaatggagccagtccgctctactgggattacgcgtattatgacggtcactggtattcctattttggcgtgttgcccgcagtgctgctgttcgtcccctatcgtctgctggccggtcataatctgccgacatccgccgccgagtatattctcgtgctgctgttcatcatcttcttctccttgctggtgctgcgcgtcatccatcgtgtgatgccgaagacttcggtggcggccgcgtcgttagtagtggtctcatcgttggtgagcgcgcaaatggggtatttgctgtatcgcacgaacttctatcagataccgttcgccgcatcgctgacgttgacgtcgctgggactatggctatggctcggcgcggacacgtcccgccgtccgctgagaccatcggaccgatggcaggcgggcgatgccaagcctctctccctgccacgactggccttgggcgccttgtgcattgcggcgaatttcggatgccgaccgacgttcaccttggccgcattgcttgcgttccccctgttctggccgcagattcgcgcgctgggcaccggtctgcgcacacgccgcatcaagccgttgcaggcgttgcgcgcgccgctggcggtaatcattcccgccattctcgtcgtgacgcctctgatggcgtggaacatggttcggttcgattccccgttcaatttcggcaatgcgtatcagttctccatatccgatatgacccggtataccaccccgtccgcggatatgcccgccaacatctggtattacctgttcctgccgctgcgcttcatggatcgtttcccgtggctggcgggctctcccgccccgatgccgcaatggggttattacgaggtgatggtcggcgcgattttcacggccacgccactgaccttgatggctttggcgctgcccctgctgcgcagattggaaacacacggcatgcggccatggctgatgtcttgcttggccgtggcggcggtgctggtcgtattcgacagccgcgtcggcggtttgggatggcggtattccgccgatttcggctggctgatctcgctggcgtccataccggggctactgtggctggtcaatgggcgcgaaccgagccgctcattggcgggggccaacgacgccgcttcaggcgatggcatcgcccgcgtcactccgtggcgttggctgatgcgctgggtcgtgatgctggccgtattgtgggcgctgggcatagccatactaagttgcttcgtgcagtcgcgcagcgattcgatgatcgccaacaatccgacgctctggcatcaggttcagtcttggttcaccctgctataggaccggaccgctcggcgacccgccaagcttcagtattctcccagcattccggccggtgttttccaagacctgcggcataatgtatgtgacgtaattcactaatcgtttacccatactgtcgtgagggtttccccgtgtccactgccgtccgtagtcgcgtcttcaaaatatccgcagcagccgtcaccgcagccatcgccattggtctgtgcctgttctcacaggacgacgtcagcgcctccatcaaggaacgccgcgtggagcggctcaacgcccagatcgagaacgtctataccgacgaataccagcagatgatggacaccgagatcgccgacgagcgcgacgccaaagaacgcacagtcgacagcatctacaccaaggtgaacccgtacggcaccaacaccacgtccatgtacgtgtacttcaccaccgatcaggcctccaccgtcagctacaccgtttccgctgaggggtacccggattacacggccaacgccatcaccagcgatgaggcggccgccgcataccgtgaggccgccgccggcgacgccgacggttccggcaatgtcggcggtaccagcacggcgagtcagacgaccacggtatcgagcaatgacatcgcctccaccgagcacgagtttctggtgttgggactgatccccaaggtcaagaacaccattaccctgaccatcaccgacaccgacggcaacgccaccacgcgcaccatcgagcagaccggcccgaaactgctcggcgaggaggaagtacggctcgaacaggccgtcgcccccgacgaatccacggtcaccacgctcggcaatggcctgtacgcgattctcggcaatgattccaacgagcaggatttcatgtactactatgacgcgaacggtgtgattcgcggcgaaatcccggtgctctactaccgctcgcaccgtctgctgttcgacaatgacggcatcatgtggttctccgcctccaccaagcatttcgtcggcatgaaccgcctaggcaagctggtcaagatcatcaatctgggcgaccagtacatcctgcaccatgattacgcgctggattccgacggcaatatcgtctctctggccaccgatctgaaacattcggaccatgccgtgcaggatcaggtcatcaaggtggacaccgactccggcgaggtgagcctgctggtggatttcggcgacctgttccccgattacaagcaatccaccgatcattccggcatcgacgaatccgatccgaccgccacgaaccgttgggactggatccacttcaacaccatccagctcatggatgatggctccgcgttgctgtccgcacgtgagacctccacgatgatcaagatcaatgacatcgaaggcacgccgtcgctcgactacatgattggcgagccgagcgtatggaatggcatggatgcgcagccctccttcctgaccaaggtgggtgattccggcgacaccggcggccagcactcaatcactgtgcagtacgattcctcgctggaggacggccagtactacatctacatgttcgataacgacttcggttatgccatgacccgtcctgatttcgattggaccatgatcgatggcatttcgaccgcgcagagctccaaggatgagaactcgaactcccagttccgcaagtacctggtcgacgagaacgccggaacctacaccgaagtgcaggacttcgatgtgccgtattcgccgtatgtctcctccgcacaggaactgtccgatgacctgaacctggtggacatcggcatgcagggcctgttcggcgtctacgatgacgacggcaacctcaaggcacagtacaagatggtgctcagttcgggatacatctaccgcgtctaccagtacggcttccgcggcttctacttcgcgtgaggattggcatcgacctcacggccgatgccaatcctccaacggccgattcctatctgctaccgcttcgcagcctcatacttgcggcgaatcagatcctcataaaacgccacagcctcagccggcgctccgtcaaacgcgaccgcgtgctcgtccagcaccagtacgcggtcgatggcgtattcgggccggcggatcatatccgtgtcatgcgtggcgaaaatcacctgcttgttgtagctgaacaacgccttggccacatgcgcggcgccaatctcatccaatcccttgctcggctcatccgccacaatcgcactcggctcaaagctcagcgcggccgcaatagccagcaggtgccgtttctcggagtccagttcgctggccttggccttggagacctgcgccaaatcaaaatgcgcgaacagattgccgatgcgcgcatgacgttctgactcgggcaccttgtgctttttcagcgcttcggaaacagcctcggaaatattcgccgcttggtaaaagctgttcggaatctcctcgcggcgaactttgccgaccagattatcgatgcgcttcgcgtccttcttcacagccgggtcaagacgttcctcaccgcccgcaatggtcaccgtgccggcgttggccttcaacgaaccgtccagcagacccagcaatgtggatttgcctgcgccgttcagtccgatcacagccacccgcagctcgctgatggtgatgtccgtgggagcaagtcccacgtgcccatcatcatacgtatgcccggcctgatccaaagtgaacgtcagcgacgccgggcgtggcagttctttcggtctaaacaagaatcccatgccgctattgtacgtggagtacaggcgtggtgccggcaaacaccggcctatcgcagcaaagcggcgacggtattgagcacggcgcggatgccacgctcgaattcgtccggttcgggtagcagggaaacggccaggtatccattggaagtcatgtcgaagaagtagccgggctgtccggtcagtttgtgctcgtcaatcaaccgcagcaccagctcgttctcatcgatgactgaaggcactcgtagcagcacgttccagccgccttcggcccgtagcacgctgaccagcccgttgggatcggcgtcaagcaactcgtgcaacttggccaggttattgcgcacgcgctcccccacccgtctggtctgtgcgggcgcggcgttcaataatgcgggaatccgttcggcgatgatgtcactcatcggcagataatcatcggcgatgacgtccagtcgacgctgtgcctcggcaacgtcctcggcaggtccggacacctgaatccacccgactttggcgtgcggcgcggccagcattttggagaatccgtctagggcgaaggtgagcacgccgcgctcccctgcgagccgtgcgttgccggggaaaggttcgagagagtaatcgaagaacacttcatcggcgataagggcgatgccatgctcacggcacaatgtcacgatacgtgcacgctcggttggttttacgtacgaaccggtcggattgttcgggttgatgagcaccaatgctctgatgcgttcgccaccgggctcgctgagcagccgctcgagttcggcgatgtcgatgaaccaggagccgtcgaattgcaactggtattcgaccgtgtcaacgcattcaagccgtgcaatcgactcaatcagcggatagccgggtttgggtgccagcaccgcgtcgccggcatcgcaaagtaacttaatcagccacgaatacgcctcggacgtggagctcagcaagtacagggcgtccgggtcaacgccctcgatggcggtattcgcattgttgaaagcggcatggcgctcgttcccgccctcgctggcggcgggcgaagtcgactgagggctgcttgcgtctaccgcctttgccgtattgaggaatgcggccaatgcttctcgcgccgcacgcggtccacgcgggtcggccgtatacacgctcggcaccaattcaggtgccagcccgtggcgggtcggattggaatcgttgagtttgctgagtgcgatgccgtttgccttggctgccgcctcggccgccgcaatgggattcggcgcagaaatatccacacgagaagagaaatgcacgctcataccctcccacgatagagcgtggtgccccctgccccgctctcaaacgcgcaacattcccggaaatgcgtcgctctggacccgaatcacaccctcaaacgcgcaacattcccgggaacgcgtcgccacagacctccatacacacgcccactttgcgcaacattcccgggaacgcgtcgcatacctttcctatgcaatgcaaaaggccgcccgactagtcggacggcctgaagcatattcgcgggtcagcgctgcacacccacgctcactggctcactgctgcttggtgctggcatagtaggcggcaccgacgatgccggcctggttacgcagcttggcgggcacgatcggggtcttgatatccacgtacggcaggaacttttcgctctgacggctcacgccgccgccgacggtgaacaggtccgggttgaagtacttctccataaggccgtagtacttggtcagacgcttggcccacttcttgtagcccagttcctcattctcgcgaatcgcggaggaggcatacttctcggcgtccagatgcttggcgctcaggatgatgtgtccgagttcggtgttcgggatgagcacgccgttgtaaatcaaggcggtgccgatgccggtgcccagtgtggtggcgatgaccagaccatcctggcccttggcggcaccgaactggacttcggccaggccggcggcgtcggcgtcgtttaccacgacgaccgggcggccgcaggcttcggagaacacttcagtaacgtccacgccaatccaagactggtcaaggttggccatgaagtcgagcttctggccgggcttgatcggcgcggggaaagcgatgccaacgggtgcggattcaggcacttcgaagtggtcgagctgctgcttgacgattttggccacggcctgaggagtggagacctcgggagtgagaatcttcaatcgtggctcggcgaaatcgcccttggtcagatcgacaggtgcggccttgatgccggaaccgccaatgtcaacaccgaaagcctgtgcagtttcaatcatcgttgaccttcctttccatacgttttcatcagttcgtaaggttgcgcccagtttaacgcgaattacgctcaacacgaaaccattacacatcaattgtgcaaacgtgtgcatcgtcgccggtcactacgtaccctattcgtatcgtttttcaagcctgacaatgggcaatgcatgcgatttcgcatactaggaaaaatcggcgtctatggtggcctgactctgtgtcgcgcgcgataatgggaggtatggcagaacatacccaacttattgatgcaattaacatccgcaccgccgtacgcgcctacgatgatgagccgatcgacgacgatacggcccgccagctcgagatggcgcttcagccgatcaacttactcggcgatctcaacattcagctggtgcgcgaccagcccaaggtgttcgccgaagccaatgcttcaggtcatctgaccaatgcggcgaattatctggccatcgtcggccccgcgaacgatgaggaagccaaagagcgtgccggcttctatgccgaacgcatggtgctcacggccacgttgcgcggcctcggcaccttatgggtcgccggctcatgggacaaggcggaggcggccaagcattgccgcgtcacctctggccaggagctgtatctcggtgtggtgatcgggcatccgaagaatcatctggattatcaggcgaaatcctatgaggagctatgcgaagcgcaacgcacgcaccgcgccaccaagacctatgagcagttcaccgccacaatgagcgatgaggggcgcgaggccgctccggattggttcaagtccggcgtcgaggctgcgatgaaggcgccgagcgcgatgaaccgtcagccaatcaccttctcgtataatccggccgacgataccgccgccgcgcatatcgatcagagtgcggaagatgagcatcacgcgttcaatgacatgggcatcgccaagctgcacttccagatcggtgccggccaaggccagtgggcttggggcgacggtggcctgttcatccataagtaacctgtagtgacccccctcatagaggggagccactactacggctacttcagcgacggcatgggcttccaggtggggtcgtgcatcagcttgcgcgagtcccaccagcccttggcaatctgtaccaaaccggtcttgaggtgctcgcgatccaccatcaccaggcgaatgacttccttggccgcggtgagcacggtacccagtccaaacaccagcggacggaagtcaccataggtcatgaagtaccgggccatgtatccgcggttgcgcatgatgtgataccggttcatgtcggatgtggagttgagctggcgcacgccggcgatatcccaattgccgatttcgcgcgtacggcgcaggatcacgtcgggcaccacaatcgggttggtgaccttgctggcgcggtagccatacatcgtgtcatcccagtagatgaagaagcgcgggtccggcagaccgatttccgtaaccacacggcggttgaacaggccgccttcgaagcacagcgtgtccatcactcggtatccggccgggccgaatgcggcgggcgcaatcgggttcgggatgcccagcggcacaatgaagtcgtactgccagtagaacgggccgccatcgtagtcgaatcgggagccctgaatcacctcgtgcttgtcggtccacttggacagcttggcaatggcgtccggcagcacggccacatcgtcatccatcacccagaaccatgcggcacccagctcgtaggctttggccacgccggcggagaaaccgcccgcaccacccaggttctcggtctgcggcgcatagaccacacgttcttcgttaccggactggtcggccacggtggtgccccattggccggtcaccttgccggcaaacgcagcgaccatgtccgccgtctgatcggactgctcattgtccacgatgacaatgcgccacggtgcctgttcaagcgccagaatcgaatcgaacagtgtctcaagcaactgctgacgtttgtaggtggtgacgatcagggcaagcttgtcgatggtgttgttgggtttcttcacttcagccatggctcccattgttgcacttgaccggcacaagacgaatttctgcacagtgaaacgcgggttgcatacgtccggcgcatggcgtatgaataagcctgtcagtttcagggaaggtgcaattccttactggcggtaacctgcaccccgggtttcataacggggatggcaggaagcccgcgacccgcgcaagcggctgatccggtgagattccggagccaacggtatagtccggatggaagaaacgagggctcattatgagtgtatcttcgcgtattcgcatgcaagttgttcgttctgtggcacccgaggccgagggttcggccagcacgtccaccgccagcaccagcgccaaacttggctcacacaccactggtgtggccgattctggccgctggtccacgcgccgtatcgccatgtatgcactgttcgtggcgctggcgatggtcaccagcttcattgaattcccgattacgccggtcacttggctgaagtacgacccgtccggcatcgtctgcctgattgccggctttgcgtatggcccggccgccgccgcaatcgtgtctgtgctcggctttgtgccgcacatgttcgccaatccgtggggttcgctgatggctgtgctggtggcgctgttcctgtctgtgccggccgcgttcatctaccgtaagatccgtacgcgcaagggtgccgccatcggcattctggtgggtgcggtgctggccatcgtggtggcgctggtgagcaacctgattgtcacgccgatttacgcgcacatgacctaccaagctgtggccgcgatgattctgccgattctgctgccgttcaacgtggctaagatggcgattcacgccgtgatcaccttcctgatctacaagccgatctccaacctgctgtccaagcagcagtgactggcctgagacgggccgatgcccgccacgactaacgaccactcaaagaccactcaaagaaccagaacgcagaatcccggcacgggccgggattctgcgttttcgcctatcagttacggattgctgtttcatgaccgttgcaccccattccttcgacgccgacgagttccacgattctgccgaacctcacgcttccgccgagcctgcctcccccgccgccgtgctcaaggacattcgtttcagctatgaccgcggcacctcatgggctttggatggcgtttcactcacggtccatgccggcgagcgcctatgcttggtcggtccgaacgggtcgggcaaatccacgttagcccgtctgattgcgggattgaccgcgccggacggtggtgaagtgacgttactggggcaacgcgtgtacgcagccggcccgaatgccgatgcctatcgtgctgcccgccacggcatcggtatggtgttccagaatcccgaggatcagctggtcaccaccgtgttggaggatgacgtggcctttggcccggagaatctcgggctggagcgcgagctcatcggcgagcgtatcgttgattcattgcaggccgtggggttggcgaacttacgccagtccgacccgacccgtatgagcggcgggcagcagcaacgcgcctccatcgccggcatgctggccatgaacccggcaatgctggtattggatgagccgaccgccatgctggacgaatccgcacgcgccgaagttatgcgcattttggatgatttgcaggcgcgcggcaccactattgtgcatgtcacgcatcatccagatgaaaccgttcatgccgatcgcatcgtgcacatggaggccgggcgaatcattggtatcactgcagccgtcgataatcgatccccgctagcggaggctgtctcgcaaagcgagactgagggtagtatcggcacagaagccgcccccagtcgccctacgaacgacagcccccgccagcgggagcgcgaagacggctccgaactgccgctgctctccgatggcatcggtgatatgacgaaccccattattcgcgtctcgcatctgacctatcgctatccttcggccaaacgggcggttatcgatgacctgtcgttcaccatcgcgcgcggtgaaaccgtggcactgatgggcgtgaatggttcgggcaagtcgacgctggtgcgcatgttgtgcgcactgactgcgccgaccgccggcagcatcgaagtggccggtgttccggtggcctcgaccggcaagcgcggtcgcaacgtgcgcccgaagtcggcgaatcgcaagcaattagcgcaattgcgccggcatgtgggttacgtgatgcagcatccagagcatcagctgttcgctgacacggtagccgaggacgtggcgtacggcccacgcaaccaagggcttggcgagaccgaggtagccgaccgcgtgcgcgaatcactggaactgctgcatatcgggcatcttgccgaccgctcccccttcgacctgtccggcgggcaacaacgattggcagccattgccggcatgctggcttgcaatcctgacgtgctcatcatggacgagccgaccgcgagtctggacgcccaagccaagaagcgtatccatgagctgttgcgcacgctcaaatcgcgtggcgtgaccgtgctcatcatcacccatgaccgggaggaggccgagcaaatcgccgaccgcgtggtccgtatgccgattgccgcccccgcatccggcggccccgtcacggccaccgtcaccgagccggccgtatcctccaacggccctgcgcactcagtgatacaccgacttgacccgcgcgtgaagatggtgggcttcctggccgccatgttcacgatgttcgcggtgaacacgccaacccagctcgcgctgggcatcgccatcaccctggccgttatcgcggcggcacgcctgaacccgttacgggtgcttgaatccattcatccgattctgatcctgctggtgctgatgggcgtggtcaatctgtttgtggtacgcaccggcacgccggtggtggcgcttggcccgctaagcatcaccgatcagggcgtgaccatagccgtgctgtacgcctgccgtttcgcattggtaatcattctgggcgcggtgttcctcactaccaccacgcctaccgccatgaccgacgccttcgccaccttgatcagtccgctcaaccggctcggtatccatgcccaagaaatcgcgctggtcatgagtctggcattgcgattcattccaacgctgaccgacgaaacccgcgccatcgtcgacgcccaatccgcgcgtggcggttccatcgaaaccggttcactggcccagcgcatcaaggcgatgagcgcgattatcgtgccgattttcgccggcacgttgcgtcacgcggacaacctgagcctcgcacttgacgcccgctgctacgaggagggcatccgccgcacccactggcgtgccctgaccatcgccgcgcgagatctcatattcgccgctgccgtcatcatctacatcgcggccatcatcgcgctgtagggcggcaaacagcgcagacagcaccggttgctatgctggtgtggttatacgaaagatgtaaggaaattcccatggcattgaccaagaagcaaatcaagcagctgcgcgcgatggcgaactcgctgaagcccctgttctatgtgggcaagaacgatttgaccgagtcggccgtcaatcaggccgatgagaccattgagaagcacgagctcatcaagtgcgccgtgcaggacggttctggcctgaccgccaaggaagccgccgccgagcttgccgagcagctgaacgccgaagtggtgcagtccatcggcaatcgtttcgtgctgttccgtcgctcccggcgcgacgatgtggagcatatccgcttggtgcgcgagtaatgttcgccccgctcgatcccgtagcttgatatgagtaatggcggttggaatcagtccgattccaaccgccattactcatattcgcccagcgagcaccgtcactgatccaagatggacccgacgattcccgcaacaatggtcaggaccaaggaccccagtaccgaccaccagaaaccgtgtacgaagacgcccacgccgaacagactgaccgccagccagctggcgagtcgcatgaacagccaattgataatcaaggtgaccagcccgagagacagaatcgcaaacggcagtgcgatcagatgcacaatcggcttgattgacgcattaatcagcgccatgaacaaagcgaacgcggcgatgccgagaatcggaggctcccccaccggggtcatgccgggagtcaccgcgaccatgacggcggcggcgatagtcataatcaaccagctggtcaggaaacttctcatggcccaatcgtagcgcggcaggttttactattgggcaaaacatgagatgatgttgtgcagaaacggtaagaaggtattgccgttcccgattgagaggggactgacccgcatgactgataatcaacaacaaccgtacggttcggacagtgttccgcagccggcacagcccgcacagccggcacaaccgtcttacggccaagatgccgcacagcagccgcagggctatggcgccccacagcccgccgcatacgctcaacccgccgccggaagctacggccagcagcaaccgcaatacggccagcccgccggcgcatacgctcagcctcagtacggccagccgcagtacggccagcccgcacagcccgcagcgggctacggccagcagcccggctatggacaggcttaccagcagccgaacgcctacgcgcagccgcaatacaccgccgctccgtatgccgccgccccggtggggcaatcgtccaagtccaagctggctgccggcctgttgggcatcttcctcggcggacttggtgtgcacaacttctatctcggcaacaccggcaaggccgtggcccagctgctgctgacgcttgtcggctggattctgctcggacttggcccaatcgcagccgccatctggggctttgttgaaggcatcatcattctgtgcagcaagcccggctcaccgtggcataaagacgccaacggctacgaactatcagactgaaactaacctcgggccacgttcattgggcccctgattaaccacgcctctgcaggtatcatctcgatgccgcagtcgcagcgggatgcgacacgccggccgtgtacatgagttcatgtacacggccgttttctttgttgctttcaccctcaaaacaaacatttatcatgttcacttttgcaagatatgaacatcagacatcacagactaccataacttcccaattgcattaccaatagattaataaccggcaaaacggcttatatccgccatttttcatgctaggctttgaaaccagcacatcaacaaagtgcacaatccttttctacagagaaggtaacatgttgttcaattcatatgtgaatcgaacaatgccagtacttccctaggtgcttgcttggggaacgccatgctgaaaggaacacattatggcggagggaaaagtcatcattgtcaacccggatatgttcggcaaggacccggattcgaaaacaaccaaggccaatgaagtggccaagagcttcggcctgagcgacgcggcgttggccgaggtcgaggacttcaaggcacaactcaccaaacacaacgcctgggatctgccgttcatgggatacgtcaacgaggatggctacggttacgcctacgtgcccggtgccgccgtggtgtacgacccgtactgggacgcccaccaagcattcctggcgctgcctaaggacgtgcagaccgcattcgccattcgtatgctgttcacgcaccgtccggtcgaccgctatggcgccagcatgttcctgcattaccagcgtggcttcaacgtgaagttcgagggtatcggcgcgaaccagtactgattggtactgactatcaaccatctttttcggattgcccgataaggggcgtataacaacggtgttatacgccccttatctgtattcagtgtcaggcgatggccgcccgccgcccgacacaggcgaatcagtatcgcacgagattcaacagttcctgctgtttggcatagcgggaaacgttggtcagggcgatgcggatgatgtgttcggaagtcttttccaaatgattgccgccggccacatgcggggtgatcaggcaatgcggctcatcccacaacggactttccgccggcaacggctcaggctcggtgacgtccaatccggcaccgtggagccgtccattgtgcaaggcgtcagccaaggcctcgggatcgatggcgtcgccacgcccggcattaatcacgatggctgtggatttcagacgacccagacgatccgcattcagcagatgatgggtctgcggcgagcgcggcaccgccatcgccaccacgtctgccaatggcaacagcgtctccagccgctcgaagccatacatcttttcaatgcccttggccggcacgtccgcatgacggcgcacgccgaaagtacgcatacctacggattgggcaagctgagcgaaatgcgacccgatgtcaccgacgccgataatcagcgcgatgccaccttccgggctcaataccggtccttcatcctgccactgatgatcacgctgattggaggcataccggttgaggttcttcatcaatgcccacatggtggcgaacatgtgttccgacacgctttggccatacgcgccgctcgcattggtgaccatggtgccgcgaggcagcacacccgggcagatgtacgcatccacaccggcgctgaaggtctgcaaccattcaagacgggtgtattgggaagcctgcgagaccggaaagttgccgatgactgcggtagctcgggagcgaagctcctcgggaacagcggccgaccagaccatgtcgccgcggtgcgcttcgtcgcccacgaattcctgcggcacatcgcgagccgccttggcgaaagcccgccgttctccttcgttgagtggcaggcagttgacaatcagcttatgcgtgttctcaatacccatggttcaccaaactaggcggcagggcagatattatcgcggtttcctcatgctgaaccaatgccgaactgctaccggaccaatgccgaatccgccccatcaaaccccaccaaaccaagggacaacccattgcgcatcgaccgtagcgtccgccccgaaccgtacactcacaggtggttttgtgattccatagcgtgcagccaaggcagtacgattgccggtttatccgcacgcacaggtacctacgccggttggtaaaccttacattccataccttgcaaccgaacgtttaggagcatgtatgcctgagcagcatattgataacgagaagattcccacacgtcttatcggcgcgattgtggctgtcggctcacttgccttcattggcattctgaccgaaaccgtgatgaccgtgcttttccccgcactgatgcgcgaattccatgtcgacacggccactgtgcaatggattaccacgatttatctgttggcggtggccgctaccatgcccatcagctcgtttttgaagcgccgattcgcgctgaaaaccatttttcttgcggctgtgattctggccatcgttggctcgctgatcatgatcgtcgcccaagccttcccgctgctgattgtcgcccgcattattcagggcattggctcaggcgtggccacgccgttgatgatcaacatcatcctggagcagtctcctcgttcgaaaatcggccgattgatgggcgtaggatcgctggtcattaccgtggctccggccatcggcccgaccgtcggcggcgcggtgaccacagtgctgccgtggcgcgcgattttcgtcatcgccattccgctggtgctaatcgcagcatgcatcggcatgaagtgcattgagcagaagacaccgaccgaggctgcctatcttgacccgattcagcttgggtccattgttgtcgcgctggtcggtctggtgctggcgctcaaccaaggtggcgtggccatcagtgcggcggtgtccggcaagtcagccacacgctccggcattatcgccattgtcagtctgattgcgggcctcgccttgttgatcgtgttcgccatgagttccaagcgtgccttctccccgctgctgcgccttggcattctcaaggatcccgccgtactgttacacgcctgcgcatatctgctgctgccattggtcgccatcggctacggctatgtcatcaccaatgtggcacagctctcgctcggtaccacggcatttgtggccggctctctggtactgcccggagcactggtcggcgctgtctgtgccccgcttggcggctggttctacgataagttcggcgcggtcaagccgattctgattccgatcggcatcgctattttgggcccagtgcttatgctggtgttctcgatgcagcttacgcccttgctgctcgccggattctatttcattttcggtctgttctattccatcggcaatgcgaatgtgatgaccagtggcctgtcggaggtctctcccgagttcaagccggacggcaacgccattttcaacacgtgtcttcagtttggcggcgctgccggtaccgcactgttctccacgattctttccgtggctcaggccggcgcaggagaagaaggcaccgctgagtttgctcacgccactgccgtcggcggcacatggacgtttgccacgatgacggttatctgcctgattggctggtgctgtctggccaccgcgttccgcattcgcgcggcacgtaagcgtgcataaatccgatcatcaatagagtcccagctttccaaacacgtgtggggcgtgccccgggagaaccccggggcacgcccacacgctaatgaaaggaagaaaaggagaaagaaagctttggcgggcagtgccggctgctgtgaccttgccatcacagcagccgggctgatcccgcctattcagttatggtgtgtgtcgtattcggtgcggagaccgagcgggcaagcccgctattttttatctccgccgaccgccatcaccgcgcgctgaagcacaacgaagacgaggatcatgagaccgataacgatggtggtccattcggccggcacaccgaagtcagaggtgagcggatcgaggatggagcggaccagagagccgagcacggagccgagcacgtagccgaagccaccggtgatgatcgtaccgccgatgaccacggaggcaacggcgtcgagctcccagccaacacccacagtgttcttggcagagccgatgtttgcggtgtacacgatcgaggccagggcggcgagagtcgcagaggtcaagtagatgatgtactgcgtgcgcttgaccggcagacccatgagttccgcggaggaacgggagccgccgatggcgtagatggtgcgtccggtgcgggtatggtgcaggaagacgtagccgaagaccacaaccaccagtgcgatgatcacgccgacgttgaaggacagatcgttggagatcttcggattgtcgatgatcttgatcacgttggagatgaacgagaagtcattgccctgcgggaaggtcagcgagtcggtggagatgatggaggcaagaccacgggccaggaacatcgtcgacagggtcgcgatgaacggctgcatgttgaattcctcgatcaaggtgccggccagcaggccgaacacagcgccgatgagcagcatgatgatcatgaccaggaaggcgggcacgccggcgttcgccagcttcaggccgacgactgcggtgatggccacgatagcaccgacagacaaatcgataccaccggtcagaatcggcagggtcatggccacagccagaataatcaggtaggcgtggtcaatgaacagggaggagatgaagcccagtcgaatgtaggtgccgaacaacgcctgacccatgatgatcatcaggatgaagatcaccacggccgcgagggtcgggatcatctgacgatcgagcttgaagcccttcttgggagccttcactttgtttgccgtagctgttgtcatgctgccaccgccttagcttgagccttgagcgcgcgcttgcgtttcatattcgcgctcaggttgtgaatcttcggagcctgcatcacgcagatcacaatcacaacgacggcgaagaaggccggagttgcctcggcgttgacgcccagggtgatgatggtcttgcggatcatggcgataattacagcaccgacagcagagccggcgagggagaacttaccacccagcagtgaagtaccgccgatgacgactgccagaatggcgtacatttcgaggtcctgaccggtcttaaccacgtcgacacgcatcacggatgcggtggcgaacagaccagcgatggccgcgaggaagccggaaatcgcgtagacgaggaagaggatcttcttcggcttgataccggtcatacgggaggcttcctggttgatgcccacggcctcaatcatcatgcccatagcggtcttgcggcacagcaggccaacgagaatcacaatgataacggcgatgacgaagttggcgggaatgcccagaatgaagccgttggcgaaccacttcagcggttcgttgccagcaactgcggaggcgtcggtgttctcaccggaggtgatgaccttggccataccacggccggcgagcatcataatcagggtggtgatgaacggctgtaggcccaggaaggaaaccagagcgccgttgacgcagccaatggccagaccaacagccaaggcgatgaggatggagagccacacgttcatgccattggacagggtctgcatggcggcggcacctgccactgccataacggaaccgaccgaaaggtcgataccggcggtggagataaccaaggtcataccggttgcaatcatcaggtatcgggcagattcctggagcatggtgatcagcgggccggccagaccaccggtgttgctgttccagctcaaagccaggaagtcatgctggaagatggtgcagatgatgaccagaagaatgaatgcgacgatcgaccaggtcaggttgctgctcagcagcttcttgacaaagttgttgccctcggcttttgccttttcagccatctcatgcctcctttccggtgtttacgttggtgttagcgatggtttcgacgatggtcgcctgagagacggtgtcgtcgttttcgatttctgcgatcttgtggcggtccttgagaacctcgatgtcgtcggacagacgcacgacctcttcaagctcggaggagatgaagacaacgcccatgccctgagaagccaggtcaagcacgacctgctgaatttcagccttggcaccgatatcgataccacgggtcggctcgtccagaatcagcagctcggggtgcgtggccagccaacggccaatgagcaccttctgctggttgccgccggagagattcttgaccgggcgatccgggtcggcgggacgaacgttgagttccttcatgtacttgtcaacgatggcgtccgcttccttcttgggaatcggcttgaacataccgcgcgttgcctgcagggcgataaggatgttctggcggacggtcaggtcgccgatgatgccctcatcacgacggttttcggtggagtacgcgattttgttcttcaaagccgtgtacggatcggagatgttgaccttcttgccgttgagcgtgtaggtacccgaatccggcttgtcggcaccatacaggagtcgaccaagctcggtacgaccggagcccagcaggccagcgaagccaacgacctcacccttgtagatgtcaacatcaaccgggttgatggtgcccttcttgccgaggcccttgacatcgacgatcggcttctcgccaggggtgatttcacggcgagccttcttggcaccaatctgggacagctcggcggcggacttaccaatcatcatgccgatgagttcgtcgcgcggggtgtccttggtcatgacctccttgatgaactggccgttacgcagaatggtcagacgatcggtaatctcataaatctgatcgaggaagtgggagacgaagaggatggccacgcccgagtcacgcaccttgcgcatgatcgcgaacaggtccctgacctcgttggcatccagcgaagaggtcggctcatcgagaatcagcaccttggcgttgataaccatagcgcgggcgatggcgaccagctgctgcatagcgatggagatggagctcagcggagtgtgcgggtcaatggattcgaggcccatctgtgccaaatacttcttagcggcctcgtgggtcttcttccagtcgatgccgaaggggccgcgcttttcgtggcccagcatcacgttctcaccgacggaaaggttggtgcacaggttcacttcctgatacacggtggcgataccggcgttttgtgcgtcgagggtgccgttgaactgctgaggcttgccgtccaccataatggagccggcgttgatcttgtacacaccggtcagagccttaatcatggtggacttgcctgcaccgttctcacccatcagggcgtgaacttcacccgggtagagagtcaaatcaacaccatccaaggccttgacgcccgggaattcaatcgtaatgcctttcattacgacgatggggtttttatctgtcatgtctttgccttaaacgagaatgagatgttatcgttttgtgatatttgagccacacatgagtgatggcgtggaaggaacatccttctcacaccatcacatcaattatttggtccagttatcaatgagtcgcagcagacttatcagtaggcgcgggtgttgttgtccagggcttccttggcggaggcggcgtcgaaggtcttggactcgatctcgatgtccttctcaacggtcttgccatccagatagtccttgacggcctgagcggtttccttaccgaagatcgggttgtactcgatcacgtaggagaggtcgccatcaacaagagcctgcagagcgttcttggtaccgtcgatggtgatgatcttgaccttgcccttgaggccggcggcgtcaacagcctgagcggcaccgaggcccatctcgtcgttctgagcgaagatgaactgcgggttgtcggacttgtacttgtcgagcagaccagcggtcacggtcttggcctcatcagtggaccagttagcggactgggactcaagaaccttgacgttggaggcaaccttgttgtcccaaccagtgccacgatccttcaccacggacaggccggcagggccttcgaggatgaagccgttggcgccatccgggaagttcttgttcacgaactcggcagcctgctcgccgcaccagacgttggacggtccgatgtgagcaacgatggccttcttggcctcggcgtccttgacgtccacgttacggtcaacggtgaagaccggaatctcagcctcagcggccttcttcagggagtcatcccaaccggaatcctcggtggaggacaggatgatggcgtcgacttcgtcgttaacgaacttgttgaacgcctgaatctgcttctgctgatcgttgttctgggtcggagagtaggtcaggtcaaagccggcatcctcgaatgcctgctgaatgtccttctcgttggcggtacggaagccgccctcagggcccacagcaacgaagccaaccgtcttcttgccggagtccgagctgccacctgcgttgctggaaccgcatgcggcaacgctgacaagcgcagcagcagaagcaacgagggcaatggccttcttccaattcttcataaatactcctcctcgagcagtgtttatttttttggatgatctttcatcctgtttggtgactgttcgtcatcgacaatctctagtgtgacgctcacaggccaaatgttcaatcgcatgcgataacagtttgataacaggtttataacagtttgataacagtagttcaaaaaacggcttcacagcgccgttttgccttgttattaagccataataagaggtggttgcacggcggcaatgccgctcgtcagccgagcgacaaagccgccgcatcacaacacaagaaaagttattatgaacaccgtttttcttataccatctactgcgcaccgagggcagtgacctggctatcggcgatggtccaggaaccgtcgagtgagccggaaacggagcgcacaatacccaaatcgtccacaatggccaggcgacgggacaggctgatctgccccgatgccatcgacgttatgattccattgggtaaacgctgcgcattggccgggcctggtgccatttgacgccatgcctcttgttgttcgctgtttccctcaggaggtgtggtggcgtacaccagattcagatcattgtagaacgtgagcatggtgacgtgcctgagcacactcacttgggtggccgctttgctcagaccgctcagtgttttatcaccgttgcgcgccacaccggtcatcatcacgccgttcgtgtcctcgccctcgactgccaacgccaatcggcacccttccggagaaaccgccaatgccacaatgctgtcggcagcaccaagccaatcaagcttcagatcggtttccttgcccccatctgacacatgcaattcgcgcccgttctcggatacagcccatacttcgccatccagaccttcggtaatcgatcgcatcggctcgccggagaacatcaccccacaggacgcaccatcagatttcaggcattcgaccacgccgtccgcacgcaacaccgcgccgccggatgaggaaaaaacgaagccccgagcatcgtcatatccgggggcctcccctacacgcaacggactggagctggccagggaaacgatatgaccaccggtcaacgtgtatacgcccgctgtcggctgctcggtagtaagtttcacatttgcgtcggcatcggaatagtccactccatcgccggtaatcctcagcgcgtattcggcattgccgtcgcccatagtcagacggatgcgatgtaccagcaggcctcgttcttcctcgttcaacgcattgataccgctgttgaggtgtatctccaccacattgttcttcaccggcacgctgtcgaccgcgagtttgatggtagacaagccggcgcctcgcagcactccttccaaccaggagggtgcatccgagagcacttcaccgactgcctgggtgcgccagttgcgccagctcaaccaacgaatatccgggataagttgcttgccggaagtactcacctgatacacggatacttggcggaacacctgttcaaaatctgcggtggaaatcaccacgccgctttccaatgacgagatgcgccattggccgcttttcttcatcagcgtatagggaagcctgcgcgtttgggtgctgtttgacggcgtgtatacgccatgcgaatccaaggaacccaccacctgaagttccacttccacaatcagtgagctttccgcaccttgtggcgcgcttatggtgttggcgcgtcggcggaaatcaggggtgccgctgtataccagtgccgcagaatctccattccacccggcagaagccgagccagtcaggaattcgcgagccacgcgatagccatcggactgcacgccagcaggcatagcgtcatagaaccctttgacaatggtttccggctgtgcatcgtccgcaggcccctgaggattggtgtaaacacgctgggtctgctgttccaccggtgccagagtctgcaccgagccgctaatcggcaaatcgaacggacttgagcatgccgtcatcgtgatgcaacaggctatggccgcgcctgcggcggcaatcgttctggtcactcgtctcatagtggcctccccatcatcgtgtcgcggcgaacctcatgataatcatgtgtgacttggctggtggccacaccaaacccaccggtaacacgcaggtcatccggcgtttcagaagcaaaattcaccggcagttcagcgtccgccacctcaccttggtcggggtcacgcggcagcaataccaagaaccaggtgccctcccccactgccgaacgtacacggatactaccgtggtgcagcaaggcatcagtcatggcgatggacaggcccaatccggtgccgccggtaacgcgtgaacgtgaaaggtcgcctctccagaatcgatcgaatacatgagcgactttgtcttcgtcgataccaacgccatagtcgcgaacgctgatggccacggctttgcggttggccgcgacgcgcacttcgatcggccggtcctcagcgaaatcgacggcattggccaacagatttctgacgatgcgaatcactcgacgcgaatcgatacgagtcaaaacctgcacattgggcagatacgtgtgaatcggcacccgtttggcttgggcgatgccgtcaacttggtccactgccgtttcaattggttcgcataaatcggtttccacaaggtcgagtgccgcataaccggcatcgtagcgggagatttccaacagatcggcgagcatgtcttggaatcgactgatctggccggccaacagttcgaccgtacgcttggtggaggggtcgaagccgtcttttttcatttcgagcaggtcggaagccatacgcatggtggtcaccggggtacgcaattcatgactgacgtcggacacaaatcgtttctggaaaacgcttgcttcctccagctcatcgatcttctggttgagcgcatcagccatcgtattgaaggattgctgcagcacaccaagctcatccttacgatccacggtaacgcgcatatcgagattgccggaggccagtgtttccgaggccgctgccactcgttcaatcgggcgcacgatgccacgaatcaccagccagattactacgcccaccacgatggacagcaacgcacagatgaccaccagactgagctgaatctgcgtcaaggactgctgctggaacgtgtacgaataaatggcgaagaattcgaggttgccggccacgccaaagtccaatacggtgccgagcaccgctgcgggcgtcccgctgcccggcatgccggaatcaccgggaatttcgaccggctgatagaacacgctgtcatccaagtcggaagccacggatgaacggatgtcgtcagaaatcagactttgatagctgggttcggtggatacggggatgatggcacgcgagttggtatcacgactccacaaatacacacctatcaggttggaggacccctcggattgcaacgaggacgccaagtcattgaccagctgttggagctgcactgcggtggagacatcggccgcgtccagactggtttgggcctgctgcaccatgtttgaatagtcggcacgcgactgcgaagtgatttgggtaagcagcgaggcgcgcactgataccatcgatacgccagagaagacgatggccacggccagcgtaagaatcacggtgagggccacggtgcgggcctgcagtgagcgacgaacttcagcgcgtccgtggcgcagcaagcgtttgaggctgaatcgagggcgcaggttcattgttcaggagtgacgaacttgtagccaataccgcgtacggtctgcacgatttgcgggttctcggggtcgtcctccactttggccctaaggcgttgaacatgcacattgaccaggcgcgtatcgccggaattctcgtatccccagacattcttgagcaggctggaacgactgatggcctcgccggcggcggccgcaagcatgaacagcagctcgaattccatcggagtgagattcaggtccttgccatccttggtggcggtgtgttccaaacggtcgatgacgatgggtccgcgttccagatggttgacgtttgcattgccaccgcttgcgccaccggtggcaccgtcttcggcggccggcttggcgatgcggaagcgtgcacggatacgcgccagcagttcggctactttgaagggcttgggcacgtagtcgtcggcaccggcttccaagccggccacgacgtcaagtgtgtctgatttggcggtgagcatgataatcggcacattagaggtagctctgatgcggcgggccacctccgtgccgtccagcccggggagcataacgtcaagcagaatcaaatcgggcttgacgatggggaacatttccacagccctcagcccgtccaggcaggtcacagtctggaatccctcgttttccaaaacaagactaagcatttcgccgatggcctgatcatcgtccacgatgaagatggtcgccatggtgtttgcctcccctttttccactgttattgttgcgttacactttactcccctatgttcatttctgttcgggttccccaccatgcagtatcgggcgaatcttggcaagacgctggctgacttcgtgttcatagccgcgatcgttgggatggtagtactcggtgccacgcagctcttcgggcatatattcctgtggcgccacggcaccgggccaatcgtgcgcatatttgtagccctcgtggttgccccactctttcataagcttggtgggggcgttcctcaaatacagcggaacagcgccgatcttgccggcatccacgtccgcgagcgcctggttaatggcgttatagctggcgtttgatttgggcgcggtggccacggcaatcgtagcttcggccaaaataatacgtgcctcgggcatgccgaccagcgccacggcctgcgccgcggccacggtgacctgcaaaatctgcggggcggccatgccgacttcctcgctggcggcgatcatgatgcgacgggcgatgaagcgcggatcttcacccgctttcagcatgcgtgccagataatggatggcggcatccggatcggagccccgcatggatttgatgaatgcggaaatcacgtcgtaatggtcatcgccgtctttgtcgtagcgcacggtggcggtgtccattaccgtagccacgatttcgggggtgatgatgggtcggcgtgcgccctttttgcgggcttcgtcgccagtgaccgcgccagccgcggcctccagaatcgtgagactcttgcgtgcgtcaccaccggccatgcgcacgatgtcggcgatggcttcgtccgtggctttgacctcgcccctgagaccgcggtcatcagtcagcgcgcgctgcaccagttcgatgagctgatcaggctccaatgactcaagcttgacgaccaccgaacgggagagcaacggtttgatgatggaaaagctcgggttctcggtggtggcgccgataaaggtcacgtcgcggttttcgacggcgggaagcagcgcatcctgctgggatttggagaagcgatgtacctcgtcgatgaacagtacggtttcctggccgcgtgacacgagccgttcgtgagcgcgggtgagtacgtcgcgcacgtctttgacgccggatgtcacggcggagagttcctcaaacacgcggccggattggccggccacgatggtggcgagcgtggttttgccgacgcctggagggccgaacaggattacggagctcggcgcggtgagactgcctttgctggccggattggcgaggcggcgcagcggcgagccctggcccaacacctgcgtttggccaatcacctcgtccaaagtgcgtggacgcatgcgcaccgccaacggccgcgtcatcgactccggcgcatcagccgccccaaacaaatcgttctcactcataacgtcctatagtaccccagtgttcgaacagacgttcgagctgcaccctggcttccctcagagaggggagccaagaaaggaatcagttactcaccttgtagtcgtggaagactacttcgccggtgtcttgggtggcgtcgaggtccacgatgccttcgatggcccaatcgtgatcgccatcggaatcatcgataatctgacgcaccttccacgtatgctcgtcgttctcgtgcttgtcatccaacatgaacagttcgggcgagcgcgcttcggcgccgatgcccacgtactcgtgctcgtcgtagtagtcgtcgagcacatcttcccattcgtgcacaccgtagccccagtctttgtcgagcgcgccgagcttgtccggctggtcgaggtccataagctgcacacggcggaacatggcgtttctgatcagcacgataaggcctcgtcggtcctcgaccaccgcgttcttcttgcccggcgccgccaaggaggccgccgcctcggactggtcggcggaatcgccggcgttctcccattcgtccaccagcgaggagtcgatggagcgcacgagcacgcgcagccacgagatgatgtcttcgagttgctcgtcacgcttttcgggcggcacggtgcgcgccagcgtgcggtaggcgtccgagaggtagcgcaacagggtgccttcggagcgggcgatgttgtatcgggtgatgtatccggtgaagtcggaggcggtttccaccatgtcgcgcaccacggatttcggcgatagccagtagtcgttggcccacggcacatcgtggcggtactggtcgaacgcggcttcgagcatgtcttccagcggcttcggatacgtaatctcctgcagcttatccatacgctcgtcatagtcgagtccgtcggccttcatatcggccatcgccttgtctcgggcctgacgctcctgggcacgcagcacctgcttggggtcttcgagcgtggcctcggccatggagatcacgtccagcgcataggtgtcggactcggggtccagcagttcgagcgcggccagcaggaacggggagagcggctggtcgagggcgaagtcgtccggcatatcaagggtcatgtagtagtccttgccgccgtccttgcggccctcggtttcgatgacttcggtatcgaacagggtttggaaaatctcgtcggcccgctggtgcagatgctccttctggtcgggggtctgcgcggaatcgtcgatgagatcgtcgatacgggcacgggcgtcgccgccctgcgccacttcgttgagcaccatcgaatgcgtgattttcaggtgcgggaccagggtttccggttcggcgtcgatgagcttgtcaaacgtgctctggttccaggtcacaaaaccttccggagccttcttgcgcttgaccttcttgagcttcttcgggtctcccccggccttggcgatggccttctggttttcgatttcgtattcgggagcctcggcgatcaccagtccctcggtatcgaatcccatacgaccggctcgtccggcaatctggtggaattcacgggcgcgcaggcggcgcatcttggtgccgtcgaacttggtcagggccgtgagcaccacggagtgaatcggcacattgatgccgacgcccaatgtatcggtgccgcaaatcacgggcagcagaccctgctgggcgagctgttcgaccagacggcggtagcgaggcagcatgccggcgtgatggatgccgacaccggtgcgcagcagccgctgcagaatcttgccgaaggctgtggtgaatttgacgcctttgatggcttctgcgatggcttggcgctgttccttgctggacacgccggtggaggcgagcgcctgcgcggtctccagcgcggcgtcctgcgagaaatggaccacataaatcggggtttcgccgttgcggaaggcgagttccacggttttttccatcggatcgagcgtgtattcgtagcttaacggcaccggtcgcggcgcgtcggcgattacatccacgtccggggtgtcgttcagatcggagagcttgtcggcaatggcgtccacattgccgagcgtggcgctcatcagcaggaactgggtctgcggcagcgtgagcagtggcacctgccacgcccaaccgcgctccggatcaccgtaataatggaattcgtccatcgccacaaggcccacgtcggcatgggtgccttcgcgcaaagcctgattggcgaggatttcggcggtgcagcagatgatcggcgcgtccgcgttgatgtggctgtcgccggtgatcatgccgacgttgtcgcggccgaacacttcgaccaagtcgaagaatttctccgacaccagcgccttgatcggagcggtgtaataggagcggcggccagtgcacagggcggcgaagtgcatgccaagcgccaccagcgatttgcccgaaccggtcggggtattcaaaatcacatggtcgccggccaagaggtccataatggcctcttcctgatgcggccatggttcgatgcccttgacgtcttccacccagccgaagaatcgttcgtagatgtcatcggccgtaagattccgttcgcgtccgtcgccgtcccattcgggggccagccgccccagggatccgtattccttctcgtcagtcataatgctcagtctacctagtggcctattccggcgacacgagccaccctccgtcgctatgcgacgcctcccgccagcgggcggagccatgcgaagagccgtgccatgcgcttggctccgccagtgggaggatcgctcacgccaaccggcggcgcacctcgtcggggtccacctcgggttcgaggggcggccaggtcatgttcatgttcttcaaggtggtgcgcagcagttcggagaccactgctcgcgaataccagcggttatcggccggtacgaggtaccaaggtgcggcggccgtgctggttttctcgaacacctcctgccatgcggccatatactcatcccatcggtcgcgggcctcgaggtcggagatatcgaatttccagaacttggtgggatcgtccagtctcccgaggaagtgttttttctgttcttcctggcttaccacgaggaagatcttgaggatggcgcatccgctggcggccagttcacgttcgaaatcgttgatctggtcgtagcgggcacgccatacgtcttcgggataggtgccatagacgtgcggcatgaccacatcttcataatgggaacggtcgaatacggcaatccaccccggcttgggcaattcacgcttcacgcgccagaggaagtcgtggtcgagctcctcggccgcaggcttgccgaagccatggtaatggatgcccatcgggtcaccttggctgaacacgtgacgcacgatgccgcccttgccggaggcatccatgccttgcagcacgatgagcagccgccgtgtcgagcctttgacgccattcgcgtacatgagccgctggtatcgggcgatttcggaggagctgatcgaaatgaactcctcggcgtcctctttattgccgtcgaatccgggagtggaatcgccttcgacatcagtgacctgcatgccgtggtggaacataagacgttgagcgggcggcaacgaccatacggcgctgagcagttcactggatttcgccgcacgtgccagtcgttcaggcacgctggcactggagtcgatggtgtctatgcgatccgccgcgagctgtaataccttgtcgatccggcgatcggttttgtattcctttcccttgccattcttgttgttctttcctgaggattttccggctgtaccccacttgccggcctcttcaggcttgttggttctgtcgtcgtccttggccatgctcccgattgtacgtcttgtaactcaggagacccagcaacgtagcgacattcacattccacttgttactgcaaatctataggcatgcagtcgttcggaccgtaattgttggctttgcaccaattccaagcctcatccgtcgagtcgaagccctcaccggcaagaatcacatagtatttgtcggaattgctgctgtaggtgggccagtcacccgaccagataagcagtacgtttgacttcttgttgtgcatcgtgatgaattgcgcaagaatatcgtggtagttccaggtcttgccttcagcttccatgcccttgcgcttgctggacaactgcgcggtatacgtggaatagacccgaaaaatcgaacacggcatcggccacgacattatcgtcgctgtcctgcaacgtgagtcgggtggccgaatcattgaatttcgtggatgcgttcttatcatcacaattcgaagtggccagaatcgtgactatcagattgtcgctcttgatcgaggagactttcatatcgggagcggcatcgcaggttttggcaggctttgccttgtcggggtcgatgtatgccaccagatatccgccggctttgatgacggtgtccgtattcgttacttcgctggcgccgatggtgtagtgcttcttggctttcttgccgctgtcgtagatgccccagcccttcacgtcaacgtctgtggagccggtgttcttgagctcggcccaatcgcaacgcttgctatccgggtctccggcagctttcgtattgccggcatagacctcgttgatgattacggatggtttggcagccgtgttctgttcggcagtggtctgctgctcgtccgcagtcgcagcgggcacgccgatcagggcgatgctgctcagtgtcaccgcagcggtgagcagcgcgactgaactttggctgaattactgctgaagctggttcttggatttgcgtcgaaccgtccgcattccgccgacaatcgcgattacagcggtaccgatagctacgctgatcaacgccggtcgttgcacggcatggagggtggcgagatccggcccggccgcaatggcactgttttcacccgccaagctatccgacgccggatgattgcccgcgtcgatgtgctgggcattgaccacactcgggccggcaagcgccacttggtcggcggtctcgaccttggccacatcgccgtgcttatccaaggtgacgcgggcgcacagggctttggcccagttgatacgctgccagccgtcgctcgattgccatagggggtatccggaatccaaggcggtggctttcaaaatcgcgttgcgctgatcggcgtgcagttcgggataggccagtcgcagcacgtccgctgccccgcgcggggccacgaaatcagcgccggactgggcggtgtctttcgggaaggtgtaggtcaggcgtgcggtgtagacgcgcacggccgaggcttggtccacgaccggctcggtggccactgggtccagaaaatcgttggtgtagccgcccgaaccggaggccttggtgttggcgatgcagacgacgagggtagtgccgtggccgtccgcggcgcagcgggacaccagatagtcgcgcagctgccgggacgcgggcacgatggacgaagcgaattcgttatgccagtactgcccgttctgggcggatgcgccaatgcgcccgcccatgatgtcaagcggataatgcacgccgagcacgatgcggttgttgccggcctccgaagttcgggccatgatttgcggcgcaagttcgggaatcatgccggccagcgcgataccccacgaataggcgccggtagtgtggccggaggggtaggaactgtttttctgcaagttcgagtagccgggcacgtgttcgagccatgagggcgattgcttgatgtcaagcgtggcgggcagtccggcgagatcgttagtgccgccgtagctgctttccgcacggttcagataggggcgcggatgcatggccgcacgttttgaggcgtaggtggaggccacgttaaaggagaagatatcggcgacggcattgagtttcccggatttgagcccttcgctcatatatttgccaagcaccggaccgagcgcgtccggcatggtttcctcggcttgcagatcggagtcgacgagtgcacgcttgcgttgggcgttcaggccatccttatcgagattttcggcggctttgtggttaatggccacggccaaatcttcgtcgagtttcatggtatcggcgtcgagcaccttgccaccgtgctcggcatcggcgggggcctgccagtagttcttttcgtagtcggagagcaatgccagccaatccgggttggacagctggtcggcctgtgcgattgcaggcgtcgcggctagcgtggccgccaacgccagcggcgcaatggtcgcaatagcaaaaacggaggataggtgccggaacatcttcatatgttccaacctatcctccgtgaaggctacgtagccggagcccagtcaaacactcagtaaattcttcgtgccggcttagcggcgattgagctgactgtcaggcctctggcttgtcctcaggcttttgagactcctggaattcgccggtttccgggtcaacctgtgactcgggctgggtggcgtcatatccctgttcgtagcgggtgcgccgccagttgcgaatcgaggcgttggtgccacggtgatgcacatggtatttgcgcggcgtaccgcccagcggcagctcttcgacctccttggccacagcgatctggttgacattggacgggtcgccggcggcgatcggcgccagcggctcgggttcggcgggtgcggccgtacgctgctgcatgcgcgagggcagccattcggcgagcctcgacaacagccagcaggcgatgaagtaaatcaccgcggccatgaccagcgtctgcaggatgttgaagtacatcgagccgagtcggcgcgattcctgcagcaggtcggtatacatgatgatcgagcctagggcggtatccttcaacaccacgaccagctgggtgacggcggccggcagcatggcgtagacggcctgcggcacctcgatctccatcagcgactgcgtttcggtcaggcccaaagcgagcgaggcctcacgctggccgcccggcagattgccgacgccggagcgcaccagttcggcgaccaccgaaccgttgtacagcaccaaggccagcaccacggcccaataggacgggctgggcaggcccgcgaacgcgaaccatcgccagaagaagatcatgagcagcagcacgggaaccgcacggcagaactcgacgatcacggcggagacgccacgtaccaacgggttcggcagcagtcggcccacgccgaacaccaagccgaacaccacggcacccaccacggccacgatggtggccttgatggtcatccacagtccgggcaggtagaagtcggtccacgcctctcgttcgacggcgggcttccacagctcccagctgagctggttctcgccgtccggcgggttgtgcaggcgcatgaggataagcacgagcaccaccgcgaacagaatgcccgcgatccagttgacgatgcgaatggtgcgccggcccttgggaccgggcgcgtcgaacagcacggaattcgaagtatcggccatatccgtcacctccttacggcgagtttgttggacaggtacgtggtgagcatgccgatggggatgatcaggatcacgtagccgagcgcgaagatcaggaagatttggatgatcacgtcgggacggaattcgatcatctcgctcatcagcgaggatgtttcggtggccacggatgcggcggcggccacggtggagttcttgagcagggcgatcagcgtgttgccgagcggtgccacggagcctcggaaggcctgcggcagaatgatctcggtggcggactgcatgaagcccaagcccagcgctcgtgcggcctcggcctggccaatcggcacggtgttgatgcccgaacgcagagattcgcacacgaacgccgccgtgtacaggctcagaccggtgaccgcgagccagaagaagttcgtggtgaaggtgtcggagaagctgagcttcagctgcgcgtaggcacccagcaccatgaacaccatgatgatggtcagcggcaggttcttgaacagttccacatacgcaccggccacggccctgagcgaggaaatcggcgagatgcgcatcaccacaaggatcacgccgaggatcagggagaacagggcggaccatagggtcagttcgatattgaccagaaacgcgccgagcacgtcatactggctgaagagttccaggaatccgctcatcaggcctcctctccttcgtccggggtgggcgggttgtagcgtacgtcgggcgtgtagttggtgcccttggtgttatcgctgatggcgttctcccacgagccgtcctgaatcatgtccacgatggcgttgttgattttggtggccagctgcgtgtcgcccttcttgatgcccacgccgtagtattcctgcgtgaacggtttgccgaccaccttgagcttgccgcgcgaggcggaggccaggccggccaggatgatgtcgtcggtggttaccgcgtccacgatgccggagaacagggcggtggcgcattcggcgtaaccgggctgttccataagctggacttcggaggcgaacttctccttgacggtggcggcggaggtcgaaccggtgacggagcataggcgcttgccgttcaggtcttcggggccgttgatggagttgtcgtccttgcgcacgagcagatcctgtccggccacgaagtacgggccggcgaaggagacggccttcttacgctcgtcggtgatggagtaggtggcgaggatcatgtccacgtcgccgttctgaatcatggcctcacgctgcttggagggagcttccttccagatgatctggtcttcggaatagccgagtttcttggcgatgtacttggccacgtccacgtcgaagcccacgtaggtgccggacttcttgaagcccaggccgggctggtcgaatttgatgccgatgcggatcttgccggtttcgtccgcgccgcaggcggccagcgacattgtgcaggccacggcggcgagcgcggcgatcacgcggcaaaccttccgtttgaacgtattggtgaatgtcattggattgcgtacccgtctttcagtgggttcgtcagtgggtgaggatcttcgagaggaagtccttggcacggtcggtctgcggatgctcgaagaactcgtcgggcgtgttctcttcgagaatctggccgtccgccatgaagacgatgcggtcggcggccttgcgcgcgaagcccatctcgtgggtcacgcagatcatcgtcatgccttcatgcgcgagttcgaccatcacgtcgagcacttcgttgaccatttccgggtcgagtgcggaagtgggctcgtcgaacagcatgaccttggggcgcatggcgagcgcgcgggcgatggccacacgctgctgctggccgccggagagctgggagggcatcttgctggcttgggagtcgacgcccacgcgggcgagcaggtccatggccagttgctcggcttccttcttgtccatgtgacgcaccttgatgagggccaacgtcacgttttcaagaatggttttgttggcaaacaggttgaacgactggaacaccatgccaacttcggccctgaggttcgcgagctccttgccttcctgtggcaggggcttgccgtcgatgcggatgtcgccggaatcgatggtctcgaggcgattgatggtgcggcacatcgtggacttgcctgagccggacgggcccacgaccaccagcacctcacccttggtgacggtcaggttgatgtccttgaggacgtgcaaagcaccgaagtgcttttcgacgtgggtcagttcgactagcggacggttcgggtcctctttgccgggaaccagcggggtcaatttggccttgcttggtgatgttgtgcttgtcgtgcgcgaacgcactgctgtttcattgttcgtttcagacatgagtgggaggataacacgccgacgtttccaacgtgttccagtatgtccacacagttgctcagtcgatgtctcatttccgcatcagacatcgtgaaggcggcattgggcatcggcatacattctcgctgagtcgcgcatcgctcggcgtctgctgtgcgctgattgcctgctgcgtggtggctgagacgttgctgcgacggcaaagcgggcacgtgttgtcctatctgctgattccatgtttggccttggtgtcgttggcgttgctgccgtgtatgccgcagtcgggcgcatggctggcggtcactttgtattgtgtggggctggtctcgccgtttcccatgtcgtattcgtataaatgcgctaggcattttgagcgtggctagctgttcgcacacgatgagtgctgttatacggtggacgacactcccgaagcgcggtggataaccgggcgcggcacacgatatgccggtggataaccggttcgcgccgcttaagttatccccatttttcggttttgcccctgtgccaccgtggaatgcgctacgctcggcgcatgaacggatacagcgaagtgccgcacaatggcgaaatcaacaactatctgcgcaaagatcttgacgccaaagccacggccaagaacacggcctgttggaatctgctgggcaaagtgcgcacgaaacgcacgttgtgtttctcgctgtataccgcattggaattatgcggcgtggagttgccgaggcacagcacgttgccacagaaggacttttatgtgacggtgaggagcaaggggacccgctcttcattggacaatgtcgactatcgcatatggaatgcaaagttcaacagtatcgctttctcaaacggcgtaacctgcatgcatcccatggatgcgtggatacagtttgcccaatatctcaacctcactgaattagtggtgctggctgaagcgctcatcagacgttatggatatgccattgaacaattcactcaacgactaacggcctttcaccgcgttattggccgtgcgcgttgtgaggcggcgctgaagctcgtaaaaccatcggattccgttcaggaaactcgtacacgcttggcgcttatgcttttcggcttgcccataccgcaaacacaatatggcattaccgattcagagaacggatacacctacaccgttgacatggcttatccacaatacaaagtcgctattgaatatgatggcgatcatcaccgtcgcttccgcaaacaatatgtgcgggaccagcaaaaacgtcgacgtctgcggcaattgggctggaccgtcatcgaggtgttcgccgatgacctgtggaacaccgccaaacaacgtgccttcgcacaagaggttgccaccgcgatgcaaataccgcttcctggccgtcctcaaccttcatgccgggtattaatagacggcagccttaccatcaatgcgcgcaaaggggaatacaggaggcggaaacaagcaaaacacaacaaagcatcacaacattgatcaaatacggagttgcgatcgctcctcatggggcggtaatttgcccatggggcggtttgaagaaattgtgaaaccgcggaattaagccattttgacctaccgccccatggggttttcaccgccccatgggttgtttaccgccccatgaggaagttaccgccccatggaaggataatcggcaaacgccaagggggacaccgcatggtgcgaggtttgccgcatggcggaggtgccatcgggcggagtatttggcaccccttggcaggtatttggcacattgggccccacccgcaaaaagcaaatggcccttggaattattccaagggccatttgcggctaatagcaccggagcattactcctcgaaaattaatctacgcgtgcggagaccgccgtccgaagccgaaggcgcactgaagtacgtcgagtgctgaggaaaagcggtatacgctccgtagattagttttcgtcggcgtccgggtcgtagtcgacgccagtctcggcgcgctgctcgtcggaaatcggggccggagcaccggtcagcgggtcgcggccgccgccggccttcgggaaggcgatgacgtcgcggatggagtctgcaccggccaggatggacacggtgcggtcccaaccgagggccagacccgcgtgaggcggagcgccgtacttgaatgcctcaagcaggaagccgaacttctcgtcggcctcttccttggtgatgcccagcacatcgagcacacgggcttggatgtcgtcgcggtggatacgtacggaaccgccgcccatctcctcaccgttgcagacgatgtcgtaggagtcggacatggcgtgctcgggatccttgtcgaacttgtcgatccaatccttggaaggcatggtgaacgggtggtgcatggaggtccacttggagtggccgacagccacatcgtcatcatccggatcgtcggtgggcttgaacagcgggaagtccacaacccaagtgaaagcgaacttcttcggatccagcaggccttcgcgggaggcgagctccacacgcacggcacccagcagcagctgggctgactcgcgggaaccggcggcgaagaacacggcgtcgccttcctcggcaccgacggcctcgcgtaggccgttgcgctcctcatcggataggttcttggcgacggggcccttgagctcgccgttttcgccgaagaccacgtaagcaaggcccttggctccacgctgacgagcccaatcctgccaagcgtcgaactgacgacgcggcgtggcggcaccgcccttgaagaccacggcacccacgtacggggcctggaacacgcggaacggcgtgttcttgaagtactcggtcagctccaccagcgggttgccgaagcgcaggtccggcttgtcggagccgtacttgtccatcgcatccttccaggtgatgcgcggcagcggcagctggacctcatagccggcggacttccagatggcggcgatgaccttctcagtcatggccatcacatcttcctggtccacgtaggccatctccatatcgagctgagtgaactcgggctgacggtcggcgcggaagtcctcatcacggtagcagcgggcgagctggtagtaacgctcgacaccggagaccatgagcagctgcttgaggagctgcggggactgcggcagggcgtaccaggaaccgggcaccagacgggccggcaccacgaagtcgcgggcgccttccggggtggacttaatgaaggtcggggtctcgacctcggtgaagtccatgtcttccagcgcgtggcgggcggccttagccatgtcggaacgcagcttcagattgtgctgcatggacggacggcgtaggtcgaggtaacggtacttcagacgcacgtcctcgcccggcagcttgttctcggactcattctcgagagcggtggaaacctggaacggcagagcgtcggacttggcgaggatctcaatggtctcggccacaacctcgatcttgccggtggccagatgggtgttctcgttgccatccgggcgcaggcgcacttcgccggtaatctgaatcacgaattcgctgcgcagcgggcgggccatatcctcgtcgtaaatgacgacctgcacgaggccggtcgaatcacgaaggtcgatgaaggccacgccaccgtgatcacggcgtcggtcaacccaaccggcaagggtgaccttctggccgaccagggcctcggtcacttcagtggcatgatgtgttctgtaagccgtctggctcattatcttgtttctcctcgatttttcgcgcgaatacgtcagatttcgacggtttgctgggcaaccacagtatccggctcccacgacgtgcaatcggcggcaacctgctcgcccgtgacgatgttcttaacctcgtcgccagcgggctctgcgccttccgcaccttcggcagcggtggccgggaaccacacgtacggaatgccgagtttgtccgcgtacttgatctgcttgccgagcttggccgcggtgggtgccacgtcggtggcgatgccgcgcgcacgcagttggttcgcaatacggttggcggccgggcggtcctcttcattccacacagcgaccagcacggcggccgggctgacacggttggcgtgagcgccggcggtgtgcagcatgtagctgaccagtcggctcaggccgatggacaggcccacgcccgggtacttgcggttgccctgggaggcgagattatcgtaacggccaccggagcagatggagccgagtgatgcggcaccgtcgaggaaggtctcgtagacggaaccggtgtagtagtcgagaccgcgggcgatcttcaggtcggcgatgacggaaccggggcggatggcggcggcctcgtcgacgatcatggccagggtatcaagtccctgacgagccagcgtgtatgcctcggaatccttggcgatgccgtgagactcgcacagcgcatcgaacttggcggcaagctcggcaccgtcggaggcggtgagctcggccaattcgaggcaggcgcgtgcctgtgcttcggtggcgccgcaggtctcggtgagcagtcgggccacctcatcggcaccgattttgtcgagcttgtcgatctcgcgcagcacgccttcgacgtccgtcaggccaaggccgcggtagaagccttcagacaacttgcggttattggcgtgcacggtggccttggggaggccatacgcgcgcagctcttccagcgcggagaccatgaccagcggcagttccacttcatagtggtcgggcaggtcgccggcaccgatcacgtcgatatcggcctgcacgaactcgcggaagcggccttcctgcggacgctcgccacgccacaccttctgaatctgccagcgcttgaacgggaacgccaacgcacccgagtgctcgaccacataccggctcagcggcacggtcagatcgaaatgcaggcccaaccgctcttcaatcggagtgtcggattcatgaccgacctcctgcaaacggctcagcaggtagatctccttgctggtctcgccttttttcaacaaagaagcgccggtttccaccgctcgcgtctcaatgccgatgaagccgttgagctcaaaaaccttacgaagcgtatcgataacacgctgctccacaacacgttcggaggggagccactccgggaatcctgatattgatgcacctttagccacgaaatcaatataataggtgagggttgcgtcaaaacttcctggttcgcccgggatgggagacgctcccgcttatgcattctacgctttaaggagctggccatggccgacgaaactgtcaccgaacccgtaaacaccgctgcgcccgaagagcaggcaacgacacccgcacccgaagccagcgcggccacgccggcgccgactccgtcccccgcttccatgccgaaaccgcacgcgccctcccccgccgccttcgccaagaagactccgtcggccaagccgcgcgctgccgccccggccgccgccaccgccacctattccgaggctgatgtcaaggccgccgaggccttcggccgcgtggatgacaacggcaccgtcttcgtcaaggatggcgacgccgagcgcgaggtaggccagttcccggatgtctccaaggaagaggcgttggcactgtacgcccgtcgtttcctggatctcaaggccaagctcgatctgctggccgcgcgcctgacctcccccaacatcaagacccgtgaaatcgacgagtccgtgaagctgctgggcgaagaaaccgccgaaccggcggtggtgggcgacctcgcggccctcaaggcccgttacgcggaactgaaggccgccggcgaggccaagaaggccgagatcgccgaagcgcgcaaggccgctcaggccaaggccgtcgccgagcgcaccaccatcgtcgagaaggccgaagctctggcggcctccctgggcgacaacaccaactggcgctccaccgccgacaagttccgtaacctgttcgacgagtggcagaaccaccagcgcaccaccgtgcgcatcgacaagccggaggccgaggcgctgtggaagcgcttctccgccgcccgcaccaccttcaaccaggctcgccgcaagtgggctcaggctcgcgacaacgagcgtacagccgccaaggaagccaaggaagcgattatcgccgaggccaatgagctcaaggattccaccgcttggggtgagacttcccgcaagttcaacgatctgatggaccgttggaagaaggccggccgcgctggccgtaacgaggacgacgagctgtgggccaagttccgcgaagccgccgacaccttcttcaacgctcgtcaggctgatcgcgatcagatcaactcctccgagaaggagaatctggctgccaaggaggctctgctggtcaaggccgaggctctggtgccggtgaagaccgacgccgaggccaagaaggcccgccaggagctggccaagattcaggaagagtgggatcagatcggttacgtgccgcgtgacgatatgcgccgcatcgagaaccgtctcgacgccgttgacaagcagatcaaggccatcgaggatgccgcttggaagcagaccgacccggaggccgacgcccgcaagtccagcttcgaggagcagctcaacgcccagctcgccgagctcgacgccaagatcgcggccgagtccgacccgaagaagaaggccaagctcgaagccgagaaggccaccaaggagcagtggctgaacgccatcaagtaaggatctcgtgccaggttcccctctgagggaagccggcagcaaggctgactgaggggagtttacggttataccgcaagctcccctcagtcgcctacggcgacagctcccctcagcgaggggagcttcgtcatatttatgccgttttcttctgccctatactcataactccaccccatagttcctcagtcacccagcaattggtgtcttacgcctgagtccctaccggtgctgcaacaattgccgtgagcccttgatgtgcggccagatattcatgcaacggctggctgtatggcatattcagctcgccgtaattggttccggcacggaaggcggggtaactgtcgccgccctgaagcagatatgaattggatgcgataatcaccaggtcatcgtctgcaatcggtcgaccgtcaacggcgaggttcacgatacgaaccgccgcatgttcgtcggcagcacactcgtcagcgtcagcgttggtatcagcggcggcatcagtatcagcggcggcatcggcattgccgctcccaccggtcgtaccgcattcggcataccgatacgtcacgttcgaggagatgccgagccagcgccgctccagtcgcccatcgtcacggtggaattgctcggcgaacactctcttcacatcgcgcccggtgagcgtctcatgcgcggccttgaactgcaaggccatgagactatccacctcgcgcacggtgactttgccatcgccattcatatcaagccgtggagtccgcagactgccattattcgaaaatccgattaccggcaaacgatttccggcatacacatgcttcatgattgactcgcggttcgcgtccgccaccagcacaccgaccgtattcccgtgcttatccgaaccttgtttgtcgaaattcacgccggaggccaaggtgccaatcaccgcgttgccggcatgattcgaatatgttgccgccgcctggtaaatatgctgagcgcgcgatacctcatcgttcgcctcagtaccggcagacatccaagcggcttgcgccggatgcgcattaagcccttccacgcccagcacgccgtcaaccgccgtatggctggtgccattgccgaggtccacatcggccactcgcaccgtggcgcgacgcccggcaccggtgatgatcaaatcctgcacggccatattccgcccgaagctgcccgcctcgtaaataggcgcaccaccagcggtcgtaccacgcttgatcgcgtgactgtggccggtgtataccacatcaacatctcgcccaatatcggcggcggctgaagcatcggcgtgcagcaaggccaccaccgcatccacctttccggagcgcttgagttcacgggccacacgattgatcgcgtccaccgcccgttcgtcaaggtcggcatcacgagtgatctgcggagtggccaccgagccgagcgcatcagtaagggcgcccacgaaaccgatccgcttgccgttcaccgttcgaatcgtagagtcacgtacgtggctcagcagtccgtcaggcgacttattggcggcagacgcgttggcgcacagccagtcgatgccgttgctgggatcagcgatacgattgttgaaatcggcgacactgcggtcgaactcatggttgcctatcgccgaaatcgtcaatccccacgctttggccatatccagcgtgggttggtccttctccaccgccgactcatacggggagcctcccaccaaatcgccggtcgataccggaatcatattgccgggattatggctgtcggccacggtgaaggcggtggcgttgtctgcaccacgttcgatatgcccgtgaaaatcagtgatgtcggcgatggtcaccgtacgggtgccggaagatggattatcgccggaaaaaggaacggctcccgtggttcccgcacaagcataaggaaccaccagagccgtaaggataagcgctactgcaccaaaagcgatccccgatcgcttgccggcccaccgccggttcttcatattcctgctcacaccagtcacgctagaatcgtcgattgaatggccatgcctaggaaggcgactctcaggtgaattcttagcggcgtcttgggatgggaaaggcctgaccccgtactatcagggtcaggcctttgcaacccgagtcactacgaatgcgtcagcaagaggagattactcgccaaattcctcggcgcagatctcagctaccgcatccacgcacgcctcggcaatcagacggccgcgttcggcgctcgagccggccggattggcgagtccgccgtgagcgggaacgtcaccttggcgcacagggtagcggacataggatttcgccgtggcaccggcttcctcgaccatacggtccatgtgcaccagttccggcgcatagtggagcatcaacgaagtttcggtgacggccgcatgctccaatgcccagccggggaacaccaatccatcgaataccttgtcgataaccgactgcggaaccgggtcccaccaattggtttccacgatggtggctactcccccggtttcgcgggtgaccaggtcgatggcctcgacgatgaacgcctcgttttcaaaatgcgcgttcatgacgacgatcttggtgaagccatcggcgatgagttcgctcagcacgtcgtgcatttggttgatcactgtcacgccgttcatgtcgatagtgcccgggaacagcggcccgccaccggagagcggcttggacttgtatccgtagctcagggtgggcagcacggtgccgtcgatgcgttccgccagatcttcggcgacccgcgtggcgagtaccgcgtcggtgccgatgggcagatgctggccgtgctgttcggtcgaaccgatcggcacgatgacgggacgagtcttcgcctccttgaattccggccaggtcatgtggtccatacggcggttgctacccattgcagtactcctttaggttggtggtggattggatggtcgatgaatacgcccggctccctcggggaaggagccggagctgaggagatcagatgtgattcagatccttgtcggtgttttcgtgggagaggatcatcgcgaccaaggcgatggccgcaacgcccaccatgtaccaggccggggcgatggacgaaccggtcagggcaatcaggacagtggcgatgaacgaggccgtaccaccgaagatggcgttggccagattgaagctgaacgcgaatccggtgaagcgcacggaggtggggaacgtctcggtcaggtagctggacagggtaccgtcgttggcggtcagggtggcgcacattgccagctcaaccagcagcacgggccagaactgggaggtgttgaggatgaggaaggcaggaacggtgaggacgatgaacgccacgcaagcgccgatgagcaccttcttgcggccgaatttgtcggagatgtggcccatgccgaacaccatgaacacgtaggcgaccaggcagatggtggtgatggtgccggactggggggcgtccatgccgacggtgtcagacagataggtcggcaggtaggtgagcacggtgtagaagccgaccgcgttcagcacgcaggctccgaagctgatgatcagagccttgagatggttgtggaacaactcggcgagcggggcgaacatgccgctcttggcagcgatttgaccgtcggcggaggcggcgcccttggactcaagcgcatcgttcatcgactggtagacgggggaatcagcgagcttggcgcggatgtacagcacaatcagaccgagcgggccggccagcaggaacggcacacgccatccccaaccgaccatcgcgctagagttcatgttggcggtcatcagcgtggccagagtagaaccggcgagcagaccgatagcggtgaaagccggaatcagcgagcagtagatgccgcgctttgaagtgggcgcatattcgccgaggaacgtggccgcaccggcatattcaccggaggcggagaagccctgcaccatgcgcagcagaagaagcagaatcggcgcgccaacgccaatcaccgagtaagacggcaggcagccgatcaggaagctcgcaccggacatgaacataatcgagtgggccagtgcggctttacggcctttcttatctccatagctaccccagaacagtgcgccgattggacgcaggatgaaggatagcgcgaacacgccgaaggtctgcagcatggcgacggtgtgattgtcggttgggaagaacaccagggcgatagtggtggcgaagtacgaataggaggcgtagtcgaaccactcgatgaagttgccgagaaaggaagataccgcgacttttctgaccatggcctgttcttcagtttgcggggtggaattcatcagtcgtgcagatgtagtaatcgttgcggaactcatgatgtcaccgtcctttcaaggatgtgctgttcgtgtgactgaatgggattcaagtgggaattcgtttcgcagcaggtcgaccagcgccgcgatagcctcgactatgcccttgagtatttgctgaaacgtgaatcgtcgattaacccgttcggcgtagaagtggacaggttgcccagtggtgctgacgcattattcaccatgctgttcttgccatgatttcgtgagtttggcggcgaatagcagcatcgaccagttcggtttgtcgttatagtcgacgccgaccatttgtgtcactttgtccagtcggttgtacagggtttgccgtctgatacccaattgctcgcacgcgccggttttgctatcgaggttgtcgaagcagacgcacagtgtgtccagcaacaacggagaggcggcgacctcgaatccgatggtctgcaccacgagcatgcgcatcgccttgtccatatcagaggatgcgacgaaacggtcgacgagtgcggacatggtacttacgattcgcccgtatgccggttcctgattggcgatgtcacgcaataccgcgaacccgtcgaccagcgtcaccgtgtccaatgccactcggccatgcaccacgtatataccgtcgccttccagtacggcaagcgcatccatgcaatggcgtccgaatgcggccgcaccgtctgaggaatcggtggtggagcaccatccgaccatcaagtcaccttccagcatgcaggagacggcgcatcccgaccgttcttcgaaccgttcgaccatcgtcgatacatggttgatgccttccaccaccgatctgaaccgaaaagcgaatggcatatagatgcatgatccggcaaaacccagcgcttcgagcatcgcatgcgcttcctgcgcctcaaatgtattgacgtgcacgccgtcggccggacccatactcagatgatgcatcatgcccatgcgcgcaccgccgtcaatataaagggcagccaccggagacacgatggtggcgatggcccgacgcatcgtggcgtcggaagtcatggtgcgttgcgtgatctccaatgctcccaccggccgggagcgactttcaagggcgatgacggcgctcgattcgttgccggcatcgaacgcacgacccgctcgagcggccaacagaccgtcaccatcgaaaatggcgacgctttcgccgaacagcgacgcaatggtttcggccacagcctcgatattgccggtacgggacaatccctcacgtaatgaagtggacattgtgtccacctccaattgcaagtgcatctgttcgtgcacgatagcggtattgacgctctgacagatgtcgacaaaaggtacgcgagatttcaaaccaatcaacgtcaacccatgcagcctggccgcagacaccagttcgtccggcatccgcaccacaccctccaccagttcgaccaccagagcggcgacaccagcctgtgccaggcttgctacatattgtcctagcgtgccgtgccaatcggcggcgagcagagcgttgccctcgataatcagcatctcaccgcccgaaaggaagctggagacatcctctcgctcgttggtgaacacccatcgcactggcgtatcgaggtctttgccttcgacctccaccacaggatcggctcgtttgaactgcgtgttatgaagcacactgcgaatcgatacagtcatacaatctgtccattcccccgcggaacaccggtcgttccggttaacctcaccgcaaagcgtgctgttgacaataacctcagttggttacgcgggcagtcggttcacgtaaccgttcggcaacacaccagttgaaggagcgacgatgactaccacactgttcaccaacgcacatatcgccaccggagaacccggaagcacggctgcaagcaccctgccattgcaggacattctcgtcacggatggtgtgttcaccgcattcggccccggactcgcgcaacaatatgaggctcagggtggtgatctggcggccattgaggtggtcgatctgggcggcaaacttgtctgcccaccgttctgcgatacgcatctgcaccttgattacgtattcacggcccgcaagcccggtgcggtgaatgaaagcggaaccttgtttgagggcatccagcgatggagtgagaccaagtccgacttgacggtcgacgagatcaagcagcgcgcgaaaatcggcattaagaaagaaatgctgcatggcgtgcagctcattcgatcccatgccgatgtgaccgacccgaacctgacctcgttaaaggcgctgctggagcttaaggaggaattgaaggatacggtcactctccagatcgtcagcttcccgcaggagggcatgtactcctacgagggcccgcatggcgaatcgggtgccgagctggtggaggaaggactcaagatgggtgccgactgcgtgggcggcatcccccatttcgaacagtgccgtgagtttggcgagcattccatgcacacggtagttgagttggcttcgaaatacgacaagctcatcgacgtgcattgcgatgagacggatgatccgaattcccgttacgtggagctgctttcggcgctggcatataaggctggcattggcccgaaggtcaccgccagccacacctgttcgctgggatcggcggacaacgcctacttcttccacctgaccaagctgcttaaggcggcgcatatcaacttcgcctgcgcccccaccgagaacctgtatttgcagggccgtcaggataccttccccaagcgccgtggcatcacgcgagtcaaggagctcactgaggcgggtgtcaatgtgtcattgggccaggattcaatgcaggacccgtggtacccgttgggcaatggcaatatgatgctcattcttgattatgtgctgcatttggcacagatgatgagctttgaagaaatcgacgatgcgttgaagttcctgaccgtcaacggtgccactacgttgggcctgcgcgatatgtacggcttggaaacgggcaagccagcaaacttcattgtgctggacgccgatagcgtgttcaacgccgtgtatgagcgctgctcggtattgcgttcggtgcgcgccggccgcacgctgtttacccgcgaggagaccatcgacaccggactcgccctgctgtaataatccgacacaaacagtagctccccttgacaggggagctgtcgccagaggcaactgaggggtagaccacaaacgtgcacatcatgtgtgcgcaggtctacccctcagtcagcttcgctgacagctcccctgtcaaggggagctttgctggtatgcgctagctacgctatcgaaacggactactcctgcggagcgtcaccggaatcggcgggagcggattcggccggctcagtggccggagtggcgtcggctggagtctcgccatcagtggcggcaccgtcttcggcgggcttatcggcggcggccggctcctcgaactcctcacccttgaaggtgaattcgccgaggataccctcgccttccgcatccacaatcacgcgctgaccgtcttcgagatcgcccatcaggatcttctcggagatggcgtcctcgatgtcgcgctgaatcacgcggcgcagcggacgggcaccgagcagcgggtcgaagcccttctgcgcgagcaggtccttggcggcgtcggtgagttcgagcgacatatgacggtcgaacaggcggtcgttgagctgcttgacgtccagatccacgatctggcgcacctgcggctcggtgagctgcttgaagacgatgatgtcgtccagacggttcaggaactccgggcggaactgctgcttcaattcggagctgacctggtccttcatgcgctggtagctggactcgttgttggcacctaggttgaagcccgtgttggcggccttggcgatgtctcgcgtaccgaggttggtggtcaggatgatgatggtgttcttaaagtccaccttgcggccctgaccgtcggtcaggtggccgtcatcgagcacctgcagcaacgtgttgaagatgtccggatgagccttttcgatctcgtcgaacagcaccacggagaacggcttgcggcgcaccttttcggtgagctcgccgccttcctcgtagccgacgtatcccggaggcgcaccgaagagtcgcgaagccgcgtacttctcggagaactcggacatatccacgcgaatcagcgcgtcctcatcgtcgaacaggaattcggcgagcgtcttggccagctcggtcttgccgacgccggtggggccggcgaagatgaacgaaccggacgggcgcttcgggtccttcagacccacgcgagtacggcggatagagcgggacagggcggaaaccgcctcgtcctggccgatgatgcgcttgtgcagttcggcttccatgttgagcagtttcttggactcggcctgagtcagcttgaacaccgggataccggtggtggagctgatgacctcggcgatcacgtcctcgtccacgaccatcttgacgtcggactcgccttcgcgccaggagtcttccttctgcttgcgatcggcttccagcttctcctgcttgtcgcgcagttcggcggccttctcgaagtcctggcccttgatggcctcgtccttgtcggcggcgatcttggcgatcttctcgtcgagttccttgagctcaggcggggcggtcaggcgcttgatgcgcaggcgtgcaccggcctcatcgatcaggtcgatggccttgtcaggcaggttacggtcctggatgtaccggctggacagctctgcggcagactgcagcgcgccatcggtgatggtcacgtggtggtggttctcgtaacgggaacgcaggcccttcaggatctcgatggtctcggcgatggtcggctcgtgcacctgaatcggctggaaacggcgttccagagccgcgtccttctcgatgtacttgcggtactcgtcggtggtggtggcaccaatggtctggagctcgccacgggccagcatcggcttcaacatgtcggaggcacccagcgcgccgtcagccgagccggcgcccacgatggtgtgaatctcgtcgatgaacagcacgatgtcgccacgagtcttgatttccttcagcaccttcttcaggcgctcctcgaaatcaccacggtagcgggagccggccaccatggaaccgaggtccagcgagtagacctgcttgcccttcagggtttccggcacgtcgccggcttggatcttctgggccaagccttcgaccacagcggtcttgcccacgccgggctcgccgatcagcaccgggttgttcttggtgcggcgggaaagcacgaccataacgcgctcaatctcgttggtacggccgatgaccgggtccagcttgccttcagcggcttcggcggtcaggttgcggccgaactgatcgaggatggcggaaccggacttgttctgcttgtccgtcacgccgccggcgttggccaagtcgcccttgccgtcaccggtgccggtgccggagttgccgcgaatcatatcgatggtcgcgctacgcaactcgcccagatcgacgtccatcttgatgagcacctgggtgcccacgccttcgccttcgcgaatcaggccgagcaggatgtgctcggtgccgatgtagctgtggcccagctgcagggcttcacgcagcgaaaactccaacacctgcttggcgtgcggagtaaaggggatgtgcccgttcggagccgcgttgcccttgccgatcatttcttcaacctgcttgcgggtggcatccagctccacgcccttcgaggcgagtgccttggcggctacaccctcaccttcgcggatcaggccgagcagcaggtgttcggtgccgatgtagttgtgctgaagggccctcgcctcttcctgcgccaacacgatcacgcgccgtgcacggtcggtaaaccgttcgaacatgcttgtccttcctcaattgacattccgtcttactctaccgattcacgatgacgtttattcatcggattccacgaattgcgccgtgagaggagaagaaaacgatatgctggttctagattcacccgtagtcgattacaaggaggctcgaaatgagtgaagctgcaaccaagcccgacatcgttgtcggtgtggatggttccgatgaatcctttgccgcgctgaagtgggcgcttgaggaggcctcgttaaccggtcagagcgtcaacgccgtgtttggctggacgcattcctgggatatggggtccgaaccggacagcgacgaggcctgggccaaggtccgccacgatattgccaacgagctgcgtgtgtgggtcgacaaggccgctgcaggcatcgacttcgatccggcgaatctgaagctcacctcggtgaaggcctccggtacttcggccctgctgcagatcggccatgattcgcagcagatcgtggtcggccgccgctcgctgagccgtatggcccgctggttcatggggtccctgtccgcttcgctggccgaggccgccgaagtgccggtgaccgtggtgcgcatcgccggcagcgaggatgagaccgtgaccgaggccattgccaacgccctgactccgggagacaagcccgttcactacacgcagcctcagccggtggttgaggaggctcgccgcccggtggtggttggtgtggatggttccgagacttcccgccgtgcgttcgatttcgcactggaagaagcacgactgcacgacgcgccgctgcatgtgatgttctgctggcagctcaaggatttgggcgttattccgggctatgagaacgccgtggcaccggtgaaggtcggtcagcgccgcgccgaggagattctctctgagctgatggccaaggcccggattcccgatggcgtcaaggtcagcacaaacgccttccatattcccgcatccaaaggtctgatcgcggcctcgcggtacgccagccatctggtggtcggctcgcgtggcctgtccgggctggacgcgcacttcctgggatcggtgtcccgccagatcgtgaacttcgccgaatgcacggtgaccgtggtgcactgattcaccaaaatcggcatggagtgctaacgcacgcctcggtgatgggcttgcagggaggaattctttattcctgcaaccccatcaccatctacttttcgcggaattcggagtttattcctcgtccgccctgttctggcgcagctgctcaatgagatcgatgacggtttcgagttcaggagtcacatcgtctgaaggacgaacgttatcctcttcgtcgtccatctcatcatcctcatcatcatcggcaacggtgttgttgaggatatcctcttcggtggcctcgtcgtcagcatcagacttggaatcgtcgctggaatcagctgcatcaacatccacaacggaatcagatacgttctgtgcaacggactcatcaccggcagactgggattgcgaggtcccgtcgcctgccgcctcctcagcgggctcagtatcgacggcgttcccgtcaacagtcttctgtgcttcgatatcatcaccggcaggctcgcctgtcttgtcggtttcgccttcggcctcgtcctgggcagccggctcctgcttgcgcggacggttggccaccacgtcgatatgcagatcgtcgaaagcaggcttggactgcacccacagctggcttggctcgggaggttcgatttcggaatgctcgccgcagccgtggtccaaggaaaccacgcggccgtcatccggactccacttgttggcgcacacgccgaacatacggtcgagctcgcccgcgagcggcacgaagaaaccacaggtggagcacaggttgccttcggcggttttggtgctcaacgctttggggcctcgcggaccttcataccagcgcttggcagcctgcgcgcggcccagcgaggtcagcacgtgacggcgggtcagtcggaaggtctcgacggcgtcgttgacatcctgcagcgaggattcctcgacttcgccttcctcgatgcgctcgtcatccggatcggtaccgatcgaatcggtgggagccagatccgtgggctcaaggcgatccttccaaggaatccacttgggcggcatcaacgcgtcctcagtggagatcaaggaggattcgttgacggtccaggagtcgatctcctcgtcgtgatacagcgtcaccgaccattgccatccttcgtagccacggatattcgcggcgaagcggaagtcagtgacgtgatcctcaagatcatatgaggtaacgaaatcccccacctgatcgctctcgtcggccacttcgagcagcacggcgcgcgcgatggcgtgagggtccggtgtcacgatggtttcggtggtatcagtcatagatcagatcagtcctgtacatcgaattgatccgccaccgcacgcagcaacgtggccagctttttgctgtcggcagcagatgggtaacggtgacggcgcaacgtattgccggccgcatcaagcatcttgatgaggtcctcgcagatggcggccatgtcatccgccttcgggcgggtggccttgaccaagctgggagcggaggcgatcaggcgaacatccatggcctgcggcccacgacggccgtccaccacggaatactccaccttggcccccttgcgcaacgtggtgacgccagtgggtagggcctgagccggcaggaacacgtccttgccttcctcactggtgatgaagccataacccttggctgcgtcaaaccaacgaactcgaccggtgggcattgcgaaccttccttaatcctcaatggaaatagtaaaccgaaggtacagtttacctcacagggcttgacctcacgctttgggctgagtcgcctgagtcttacgctcagagctgaaccaagaagtcttctgtttggcgtccttggttttgccggtggactgcttgggctcaggagcggcgatctgctcaatcggcagcaccacggtgaaggtcaggcctcccccatcggtgccggtggcgcagataaagccgtgatgtgctttgaccacggattgcgcgatggccatgcccaaaccagtaccgcccttttcgcgggcacgggatgggtccgcggtgtagaagcgttcgaaaatcttcgagcgcgattcaggcggcacgccggggccatggtccacgaaacgcaatacggcatatcgatagccggtctgcatcgaggcacctacttcggcagcgtcgatgaaccgccgcattgacgcgtcgctggcgggcatgcgggcgagctgtcttggatcgatggcggccggcatcacaccgagcgcggcttcagcgggcgaatcggcaggcgtgtagcggtggatgttgcccacgatgttggtcaccacctggcgcagtcgagaggcatcaccgggcagtacgacctcaggccaatcgccttcggcaaggctgaattcggcgggatggttcaaatcgcgcgccggttcgagggaaatctgcatgcggcgaacggcacggtccgggtcgagcgcatgcaaatcgtcgacggcgtcggtgaccagcgacgagagtttcaccgtgccggtcatatcgatgccgcgcccctcatcgagacgggccaaagacagcagatcctcaacaagaacagtcatgcgctggctggaccgttcgatatgttcgatggactcgtccgcacgctccaaggcaccaggcatatcgcgctgcatcttatacagctccgcatagccatggatggcggccaacggggtgcgcagctcatggctggcgtcggagacgaaccgtttcatcttgtcggtggtctcctcctgctcatggaaactggattctattcgggtgagcatggaattcagcgaggcggccagagagccgacctcggtgttttccggcgcggaaggaatacgttggctcaggtcgccggctgcaattttcgcggcggtcttctcgatgcgcttcagcggcgtcatcgtgtgctggatgatcagcgtggacagggagccgccgagcagcaccacggcgatgccgaccacaatgcagtatcgggtgagtgtgttgacggtgtcgatttggtcggccagcgacaagccgatgtacaccacggcacggtccttgccgttttgctggaaggtcaccggcagaatacgccatggtgccctcgccgtgacgatggcggcatggttggcattggcagtggggttggccagtaccttggtgatggtgtcagaggaattggagtttccgttggccggatcgttctggctgtccgcactgtcggactgcaccgtgatgatctgcttggccaccgcctgcgtagtgaatgcctgaccgagcgtgatgccattggtatcgccataggtaggcagaatcggcaccgatactataccgtcctgcatctgcggcatcagcggggtcacgaccagaggattgccttctttgtctttggttccgtcggtgtattgaatctgcagaaagtacgagttcggccccgatgagtcattttttgacagcagatcgatattgttgaccaccagttggctttgcgagcttaactgggtgtcggttttctgcagcatgtagttgttcaccaacgcgcggatggagaaggaaatcaccgacacgccgatgagcagcacggcgatggtgcaggccaccagcttgctgctcaacgagatacggtcgatatgccgcatcagcatgtttttcttacgctcgcgctgctcttggaaatgggcggcgaacggcgacattgcaggcatgggattcgtgttcggggcggcgttcggcgtgctgctcggcggtacgccgcctgactgcttatcggggatactcatgagattgcgatacgttatggatggaggcgattagttcttcggttcgcgaatcatgtatccgatgccgcgcttggtttcgatcagcggagtcaccttgcgcttgccgccttcgccgtcgtcgacctcgatgccgtcgactttcttgcgcaggtaggagatgtacgattcgacgatggctgcgtcgccgccccagtcgtattgccagacatggtcgagaatctgtgccttggacagtactcggccctcgttgtccatcaggtagcgcagcagcttgtattcggtagggctcaggtcaaccggctgccctgcacgggtcacgtcgtgggagtcctcgttgatttccaagtcggcgacgcgaataatcggatcgtcttccacctgttcgcgggtacggcgcagaatggcgcggatgcgagccacgacttcctcgaggctgaacggcttggtgacgtaatcgtcaccgccgacggtcaggcccatgatcttgtcttgggtgtcgtcacgagcggtgagaaacagcacaggggcgttaatgccttcctggcggatgcgacgggtgacggtgaatccatcgatgtcaggcagcatgacgtccaacacgatgaggtcaggctgcactttttcgataacctcaatggcttcagaaccggaagcggcggtgtttacctcgaatccggcgaagtgcagggaagcgaccagcagttctcggatggacggctcgtcgtcgacaacaacaatcgatgcttcaataggcttactcatgcttcctagagtgtcgcgctcttctgggcgtttcctgaatgtcatcttggagttcggccttggaatccttcttgatctccttgcgccgatgaatcaccaccatgaccacgatgatgatgaccagcgccaccaataccacacccatgatgattatgcctacgatcaccgtggacgatgaggtggaggcttttttggatttcacgatttgatccatcattgccgttgccgcgccagaccagctcggcgggttttccagtaacggctgctgtgcggcttcggatagcttatcgacggttttgttatcgagaagccacttatcggagttcttggacacgacgaccaccaggttgccgtcattcgaggccacggcaagcatcactgtgttcggcttgggattcatggactccatcacggttgccgcccagtctcccggtttctgttgactattgaaactggaaagatacagcagatgcacgtgtacaccggtttccttctcggttttggcgatggcatccgtgacttcggccgcatgggagcccaggagattttccgtatccgtgatgttctcggtgatggtcacgccgctgtcggtgctgctgctggagctgtcagagctgtcgctcgagttatccccataggcatttgcagttatccacattgcgttcatcgctactgcagcaagggcgcaaatggcgcaaacaagccattttcggaccatattcccgaaggccgaataggacggctccgaagctaggaccacaatagttgtttttccgtcttcccgattcgttgttgacatatcctccaccttaacggccggtattggcaatcggccgccatacataccattaaccctctagaaaaggagcaacgatgccccaatatcaggtagattccgagcgaatccaatcatcctcggccgcagtggccacttcgatctcgcaaatcaggcaggccgtgggcggcatgtacaccaatctcaatgccttgcaggacgcatggcgaggttcggcggccacccagttcaccgcggtagccgaacagtggcgtgcggcccaacagcagatggaggcctcactcgagtccatccaacgctcgctgacgcaagcctccaccgtgtacgctgacgccgaaatccaagcttcgcgcctgtttgccagctagtttcttggctcccctcaaagaggggagccagaatacaaaaaagggactcccgaaggagtcccctttcagctcaatcagctagcgatcgtttgcggatcagtagcccatgtcggcaccggcggccggggcagcagacttcggctccggcttgttggcaacgacggcctcggtggtcaggaacagaccagcgatggaggcggcgttctgcagagcggagcgggtcaccttgaccgggtcggtcacaccggcggccagcaggtcttcgtaggtgtcggtggcggcgttgaagccttcgccatcaggcagggagcggacggtgttgatgaccacgtcaccggacacgccggcgttctcggcgatctgcttgatcggggcctcgatggcgcggaacacgatggcggcaccggtagcctcttcgccggtcagggaggtgacggcctcggtcttctcggccttggcagcagcctgaacgagggccacgccaccgccaggcagcaggccttcctcgatggcggccttggcgttacgcacggcatcttcgatgcggtgcttgcgctccttggcctcgacctcggtggcagcgccgaccttgatgacagccacgccgccagccagcttggccagacgctcctgcagcttctcacggtcgtaatcggagtcggtgttctcgatctcagcgcggatctgggccacgcgagcgtcgatgtcttccttggagccagcgccctgaacgatggtggtctcgtccttggagacgatgaccttcttggcgtggccgagcacggaggtgtcgacggactcgagcttcaggcccagttcgtcggagacaacctgagcaccggtcaggatggccatatcctgcagcatggccttgcgacggtcgccaaagcccggggccttgacggcgcaggacttgaaggtgccacggatgttgttcaggatcaaggtcggcagtgcttcgccgtcgacgtcctcagcgatgatcagcagcggcttgccggtcttcatgaccagctcggccacgtgcacgatgtcctgctgggatgagaccttgccggaggtcagcagaatgtacggatcttcgagcactgcggtctggtcgtcagcgttggtgacgaagtacggggcgatgtagcccttgtcaaaacgcatgccctcggtgaagtcgaggtccaggccgaagcggttgttgtcttcaacggtcacaacgccgtcctggccgaccttgtccagagcctcagcgatcttctcgccgacctcagggtcagcggcggagatggtggcggtagcagcgatctggtccttggtctcgacgtccttggcggcagcgacgagttccttgacgatgacctcggtggccttctcgatgccgcgacgcagggcgatcgggttggagccggcgaccacgttcttcagaccctcgtgaaccagggactgagcaagcacggttgcagtggtggtgccgtcaccggcgacgtcgtcggtcttcttggcgacttccttgaccagctcggcgccgatgcgctcgtacgggtcttcaaggtcgatttccttggcgatggacacgccatcgttggtgatggtcggagcgccgtaggtcttgtcgagcacgacgttgcggcccttcgggcccagagtgaccttgacggtgttggcgagcttgtcaaggccctccagcatgccctgacgggcttcctcatcataagagatgatctttgccatggttgcgtattcctccaaatggctaggtataccggttatcactcgcaagcgtcaagtcgtgacgaccagccgtcagctgccgattatcactctcgacctccgagtgctaacccagacattagcactcgcgcccgccgagtgccaacaccatcggcggcgattgcgctttgggcatgaaaaagccccaaccgtcgaaacggtcagggccttcaatgcacatccttgcgtgcgtgttgctcactcggagcgggcttcacccgaagacagcttgacaacatcctttgcctgcgtgcctttgccggacgaagcgggcgtatactccacgcgatcgccttcgtacagcattttgaacttattggtgctgccgtcgtccttgatttccgcgtagtgcacgaaaacgtcctcgccgccgtcgtccggctggataaacccgaaccccttcttggcaaggaagaacttcacggtaccttgtgccatatctggtctttcctttgttcccttgggcgtcgcgacacaaaacctatagggaacgtagaaagaaccgcatcgcgctccccctacctcgcgactagatgatgattgtacagtgacgagggaacaatctcaaccgcagtggcacattttcggtacgaattattccataggcgtgagaacgctcacagttttcgatgtatttctcgccgatatcaggggcgcatcaacaacgctagttgagcaacaccaccgtaatgggaacggcgagtccttgcacctgctccacagccgaaatgccaagcgtggtcgccacatcctcagcggtggccttatcggtctcattctgataccacaccacggaagaagccggcaatgtgccgctcggattggtcgcctcgacactggtgtaaccggcggtctgcagcacatcggcctgctgacccgcatatccttggattcctgtggcgttgaccacacgcacctgcgtggccttattcacagtcgcgatggcttcggactgctgagactgctgatcggagttttgattctcattcgaggatgtcgtgtcactgtcggtatcggactttgccgaatccgaagtcgagtccttggacgaatcggtcgaagtggacgaggaatcatccttggtgctgttcttggtctcagccttgctggacgaatcggacttggacgtggtcgccgtctgggacgatcctcccactacattcttgtattctccggaaatccatgcccaggccccgacaccgcacagcgcggccaccagaataacgacgatgaacgggcagaggcgggccattaccgaacgagcgccacggtgaactcccaccggtcccttcggaggattgtcgaaggaatccggttcataggattcgtaggtcatcgtgtcgcgtgccataatcgccctttcttcctatcaaaactacccatgagtgtaatcggcaaacaactcatcagtccaccacaccacgccccatgcaccggatatgcacgtttgactacagtggtgagtcatgatcaaaccattgagcgaactggtagagccagggtgggcccatgccttggccgacgtggagcccaccatccaccatatgggcgattttcttcgtgcggaaaacgccgccgggcgcccgtggctgccggcaagccacaatattctgcgcgcgttcaccatcccgttcgattccatcaaggtgctgattgtcggccaggacccctacccgaccccgggtcacccggtgggtttgagcttctgcgtggcgccaaatgttcacccgctgccgaaaagcctgatcaatatttataaggaattggttgacgaccttggggtgcccatgcccaccaacggcgatctgacaccgtggacggaacgtggggtgatgttgctcaacagatgtctgactgtcggcgtcgggcggccgaattcgcatcagggcaaaggctgggaggaagtcaccgaggccgcgattcgtgcgttgaacgcgcgcacggacgccgacggcaagccccagccgctggtggcgattctctgggggcgtaatgcgcaaagcctcgagccattgctgaccaatgccttcatcatcaaatcgcctcatccgagtccgctgtccgcttcccgcggattcttcggctccaaaccattctccagagccaatcaagccctagtcaccatgggtgccgacccggtggattggactctttaggcaggccaacagtcattgtgagtagttacagtggggggcatgactttgttccccacgcaaccgaacataccttcgccgaccaccgccgcacgaccggtcgccgttcccgcgcccggcgtgtcggctccgctgggtgccgatgacgccaaacgcgcacgtatcctggccgacgccattcgggcgaggttcgcccagacactggtgggtcaggataatctacgcgaatcgcttatcgtgaccttggtggccggcgggcatattcttatcgaatccgtgccgggcttggccaagaccacggccgcccagacgctcgccacctgcgtatccggctcgttcaagcgcgtgcagtgcactcctgatctcatgccatctgatctggtgggcacgcaggtcttcgattttgcgtcgcagaagttcaccacgcagatcggtccgattcacgccaatttcgtactgctggacgagatcaaccgttcgaatgccaaaacccagtccgccatgcttgaggccatggccgagggtgccacgaccatcggcgggcagcgtatcgccttgcccaagccgttcatggtgatcgccaccgagaatccgatcgaggaggagggcacgttcaacctgcccgaagcccagatggatcgtttcatgatgaaggccgtcatgacctatccttcgcccgacgaagaggctcggatgctggccatgctcacccgccgcggctccgatatgatcggtcccgacaccatcaccggcgaacgcatttccgtgtccgacgttgattttttgcgcaaggcggcacgccgcgtgcatgtttccgacgcgatcatgcgttatgcggtcgatatcaccgccacgtcacgaggtgccggctcccgccccatcaagggactgtcgtccttggtgcgtttgggcgcctcgccgcgcgccaccatcgccttgacccgtatcggccaggcgaaggcgttgctgtccgggcgcgactatgtggtacccgaggacctcaaggcgttcgctcatgaggtgctgcgccaccgtattatgctgacgttcgaggcactggccgatggcgtggtcagcgatcagatcgtcgacaagatcgtcgaaacggttcctgttccgtgagttccgattccgttcgcaagaagatcgaggcccttggcactcagctgagcctgcctaccgtaaggaaggctttgggcgcgctggagggcgaacacgcatccgggcgtcgcggcggcagcggcgatgcgatggatgtgcatgcctatgagccaggcgacgaatcccgtcttatcgattggaagaccagcgcccgccaaggccgccccatggtggtcgagcgcgagcgcctgtcgacgtcacgggtctggttgctgatggacgtgggcctggagatgactggcgtatgcccttccggagaacgcgcatggcaggttgccgccaatgcgctgcgtatgttcgccgcactgtcgttgcgccggtcggacgatatttcgctggtgttcggcgatgagtccagtatcacccgcgtgccgttcaacggtgggttcgcgcagttcgaacgcacgctggacaaggcgcttgaccgtgattgggatcatcaccgtaatatcgacgcgctgctggaatatgcgcgccgtatcaaggatcgcgaggcattgatcgtattggccaccgatgagcatgcgatggaggagcggcatatcaccacgatccgtcgtattacccgcacccatccgatggtgctgatcgatgtggcgacgatgaatccgttcaaggccgtctcatcccgccacgctcccaccgacggcttgagtgcacggcgtgtgccggcattcctgcgcaacgccaaggcagcggccgaggtcgatactcatcgcgcgtatatggccgcggctttggaacaggagctcacccgtgccggttcccatatcattcgatccgcatccagcgaatccatgttcgatcgtttcgtcgccctggtgtcccgggcattggcccgcaccacacgcaatagactgggtactgcacccgaactggtcggactgactttggctggtgatctatgatgcacagcatgttccccatcatcccgctcgccactgatcccggcgatctcaggcccgtggagtcgttggccttgaccactcccctggtggtggccatcgtcgcatgcctgttgctggcggtaggtctgatcgcgttgatcatcatgctgtctcgccccgcacgcaaacctcggaacagcgaccgcgcgcgtggcgctcatagcaatgccagctccaaggccgagtggcgtgcccgcatcgacgatgtggtggcccgtcatgaatccggagcactgccccggcatgaggctttcgtcgaattgtccgtcatcgcccgtgatttcgccggtgccgcatcaggcaaggagcttagttccagtacgctgaccgatttggcgtacctgaatcgcacgcccgcgaatcgccaaggattggacgcattgaagcagaccattggcgcgttgtatccaccggaatttgccgatgatgcccgcaaccgaatcgcccagacgaccagcgtgcagcaggccgccgagtgggtggcgaatctggtggaaaggtggcgttcatgatgctggcatggcattggccttgggccgctctggccggcgtcttggcgacgctggcgattatcgtgctgattgtcgtgttcgcccgccgtaacgccgccgacgacacccctgtattctcgatggacgacgatctcaataccgagcacgcttcccgcctgttccgtcaatggcgcgctttgggccgtctcgccatcagcgtgctggtgcttgcgctggcgctggccattgtgctggtggctcgccccagccaagtggatgccggtgacgaacgcgcttccagccgagatatcgtcctgtgtctggatgtgtcggggtccacgctcccctatgatcgcgaggtcatcgacacctatttggaactggtcaagcatttcgagggggaacgtatcggtttgagtatcttcaactcgacctcacgcacggtgttcccgctgaccgacgactacgaactggtcaccaaacagttgacctccgccagcaaggcgctgaaaggcgtcgagtcgcaggatgacatcgataagatgtccgatgccgaatatcaggacatcgccaattggctcgaaggcacgcagaaccgcaaggacgccacctccttgattggcgacggcgtggtgtcttgcgcggcgatgctccccggtttcgcttatggcgaagccaatcatgcgaatgccgaccgtcagcgtgcggcatccatcgtgctggccaccgacaacgtcgtgtcgggcaagcccacctattcgctgaccgaagcgttggatttgacccagcagaccaaaatcaccgtggacggcctgtattccgggccgaaagccagtgaatcggaccaaaccacaacggatatgaagtccgcgatcgagtcgcatggaggcatcttcctcacccaatcgaatggcgcgtcgatagatgagctggtacgggatattcagtcgcgtagagatacggatgtggagaacaaggcgaaatcctcgatggtggacgctcccggtctgtggacgcttgctctggccgtgatactcattatctggatcgtatgtgcatggaggttgaggcgatgaacggattcaccttctcccccgccttgggctgggtcgccggcggactgctggcggccgggctcgccgtactggccattctcgaaatcgcattatttgttcgtcgccgtgcttccagtgacgagaccgtgtgggcttgcatacgacgtacgcttatgctgctcatcgtcgcggtgatggtactgactcccagcgtggtatcgtctaccacctcacaggccatcaatgccaccgacgtcattgtggcggtggataccaccgggtcgatggcggtggccgacgccacatacgggtccgagaagaccattacccgcatcgatgccgcacgccaggccgtgcatgatgtgaccgccgcttatccggacgccagtttcgcggcgttacggttcggtgcttcggggacgcttgatgtgccgctgaccccggatgcgccggccatcgataattgggccaacacgttggcggtggaagccacatccgtgtcggcgggctccagtctggatgctccgatcgatcaattgctgctgaccgtgaagtcgattcgtgaagcgcacccggatgatgcgattgtgctgtacctcatcactgacggcgaacagacctcgaatgtgacgcgtcgtacgttctcgtcactgcgccagtatctcaatgatgggtttaccgtgggcgtcggctcgaccgagggcggcaagattcccgtcatcgccgatggcgtcagtgccggcgattccaacaccacggaccactgggtggtcgacccggataccggcgaacccggcatctccaagatggatgagaagaaccttaaagacattgccgacgagatcagtggcacgtatgtggccgtgaacgcttcacagactttggcggattcggtttcggccaagtcgtcgaagcagtggcgcatgaccaccacggtcagggaacgcacacgcaccacgccggtggtatggccgttggccattgcgttggcgatattgcttgccatggaagtcggtgcatggatcgcaacctcaaggagactgctgtgagaaacagtaacgaaatccacgagaacgatggctcggcgaatactcggatgcgggcgaagtgtccgctttgggcacgtatcgtcctggcttgtggcgccgtattgctgttgctggttgccggcgtggcggcagtaaacctgtccgcttcgattacgttcaatcaggccaccgcatcattgaacgccaatatcaaagcggctcaggacgagtccacggatatcaccacgctcaaggcgcaacagcagcagaccgacgcgcaattcgacgaggccgggcgaatgcgcacgcttctgttgccgcaagtcaaggacgccatcgacaccaatgcttcgatttcttccgagctgacaaagatcaccctgaaacaggccgaggcgcagaacagcggttccgattccgggcaagcccagtcggcacagcaatccgagaattcttcatccaatgccaaaaagggcggcgcgttgaccgacgaacagaagaagcaggtcgaggagctgatgaaggccaatcagcaatccaccgatacccagtcgaacaccacccaatccgagcagaaagcgacgcagaacaagggtaccggggctaccaagccgtggtaagcagtcgttcacagttgttcttttttctcacaccctcacgggtcatggctttatcgcggctgtttcccggtttcggctgtcggctttggcatttatccaattttcgataggccatggctgatccaaggtatgtccaaacaggctatttgtggataatcgttacgactatgcacaacacttggggataacttcacccaaaatcggcaagctagaaccacattggtcgttccggctggacaagcatgagtcttgtccttttagctggatatatgaatacctacaccagcaacccagcacccatcgatcccaccggcggctttgccggcaatacggtgacgccgttcgattacggcacttgcccttgccatgcggcggtacagcgtagtcgcgacctcatgtccgtccagcgtgcggccacactggcgcaatcggaccagacggcggtggccgtgaaccgctccagcaacatcgtgtggaccggtaaagccgccgatctattccgatcgcggctcagtcgcaccgcacagtattcggccagtctcgcgcaagacatggagaccacccaccgattggcttgggggtcgtcatgagcgagcacgattactggcaagtggaatcgtccgtttacggcggagtgggatatgcgccagccactcttgaagaatatgccgccatagccaaggctctcgatgacgaggcggcaggatttgcggccatagccacggcttgggaatcggccgcattacagttgcagtcacatcggcatagtgcgccgatgtgcgtcaccttgcagtcgggcgatccgagcgccgttgttcccggccatgtcactgcaccatatgccgcgctgggcaatcggtgttatgaccatgcaacggcatgtcagcggttgagcgatgatctgcgtggcgcggccgatctgctgattcgcgcacactctctgtattctcaggcggagatgacggctcggcgcatgtttaccgaattattgcaggccggcacacaggccaaaccgggatatgccgcggcgggtgttgccgctgtggcggcgggcggctttctggccggctggactattgacggcaaaccgaacccggcatggatgtccacgttcacctatccgttccaggaaggagtgcttagcggcgcgggcggaatcattggcggcgtacctatcggcaagagcattgcgcacaccgatgaggtcaacaaggctgcggggaaaatcgccaatttctccggcccggcgaaagacgtcgtccaaggcaatcatctggacgtgcgcgaggtgcaggcgaatgccgacgttgtccgcgcaagcggatcggtggccgagtcaatggagaatctgcgcaggctcgccgaagagcggctcggcaaaatcgagctgaacagcggactcgaatatgggaccatcgccattcaacgctatgaacgatctgatggaaccaactcctggctggtcaccatcccgggtaccgatggacagcctgactcaccatttggctgggcgcagaacgtggaactgatgagcgccgatcaggagcgccgcaggaaagcggacagcgctcgcatggttgccgaggcgatgcgtcaggcaggcatcggcaaggatgagcccgtggcgctgatcggccattcccagggtggtatcgttgccgccacgcttgcctcggattgggcggaggaatataccatcgagcatgtggtgacagccggatcgccggtggccaatcatccgattccgcaacgcacgtgggtcaccagcgtggaaatcgatgatgaactggtcgccgcactggatggtgccgccaacccggtcaccgataactggctcaccgtacaagggcatgtatcgcccgcgcccgcggcaacaccatccacagtgcattcggacggctcatgcactcccggcgcaacgcccatcaccggtctgaccccatatgacgccgcacccgtggctggttcgaccaacggcagggagttgtcgcactggatcaaataccatcaggccgcctatcagaacgccaccgacctcggctcccccgccgtgcaacgccacgaagcccatttccaggaagttatcaacggagagctcaaggaaacccgctactaccaaggccgcatgacccagtccgcgaccattgcccctagcgagcgaaccaccgagttcagcacgttcggcggttaaaagtaaataccacacttgacagagttgtcaagaaaggagttaacaatataatgacgagtaggagatggctcatcaaactgatgaagcaagcggcagaacgcaagaatgtcacgtttgaaagtatcaggcaaggagggagtcatgagatattccaactcgatggacttatgattccccatcccacgtcataacgaaatcgacaacaacctcgcggacattatttgcaaagaagcagaagccaaactcgggaaaggctggtatcagcagtgaaaacatatcaggtcatcgttcgtcctggcgaaaaatactggattcttgagattcccggtatcggtttcacgcaggcaagaacaacagcagagattgaaagtatggcacgcgaccttatcaccgtcatgacacaagatgctgatttcgcactcaccgtagagacaaagctgccgcaatccgtgcaggagcatcttgatgaagctcggcgactgcgcaaggaagaagcggaatgcagatcgaacgcagcgcgggaaactcgcgccgcagcacaagaactacatggcatgggtctcgccctacagcaaataggcgatatactcggggtctcacggcaacgggcacatcaacttgtcaatgcttagcatcaatcggctaccccacaatgcaatcaccgcagagacgcggctagcgccactttcccgggattgttgcgctagcatgcccgaaaccccctctatcagcgcaacattcccgggaaagtggcgcgcaaagagtgtcaggcgcgtcgctcgatgagtgcgcggccggatgcgaggcggtcgagcacaccggttttggcgatggccagcatcagatacctggccatcacgccgctgataagcacgccgccggtgacctcggaaatcatgtgcacaatgccacgcgggctgacgaatgacacacccacgtagcgaaacagcatcagatatgtgccgtattccaaggcgaccaacgcaccggatgcaatggaaatcggcagattgaacatgcggtaacgggtcaaggcgaacggaatctcagcgaaaacaccttgcaacagcgccgagataatcacgaagcccaaatcgaactggctaccaatcaccgtttcgaccagcgtgccgataaggttcacgtacagcgccgctccgggtttgcgcagaatcagcaccgccagcgtaccggagaagtaccagacggcgtgcacgatgctggcgaaaccgggcagaatcgcgccgaataccgaagagatcggcatgtacgcgaagttgaatccccagaagatcacgccgcaggccgcacccagcgtggcaccgaccgcgatatccaacggctgccatttcagtgacgatacggcaatcggacgtttcggaagagtatgaatggtggttgcaggcatggtgatctcctagccttaaaggccgcacacagtaatcgaaccacgggcgttccttgacctgtgcggctcgggcgggaacgccgcaccacagtatagccgctcggttcacggctggaagtacccttggaggttatgaagcttaccgatatttcccccgcaatcgcattgaccccactcgacggccgttatcacaaggccaccgccccgctcgtcgaatacatgagcgaacctgccctgaaccgcgaacgcatgcgtgtcgaagtcgaatggatgattcttctggccaacggctttgagggcaacggcaaccagccgatcgttgacggcgtcaagccgttcactgccgaagagcaggccttcctgcgcgccattcccgaggacttcggcgccgaaggcatcaagcagcacgccgctcatgaggccatcacccaccacgatgtgaaggccgtggagtactacatcgatgatcagatcgacaaggctccggccgagctgaccaacatcaacgacgagctgaagaccctcgtgcacttcgcctgcacgtccgaagacatcaacaacctctccatcgcccgttgcgtcaagaacgcgatggaaaacgtgtggaccccggagttcaagcgcatcatcgaccacctcgccggcaaggccgaggaattcaaggatatgccgctgctctctctcacccacggccagccggccacgccgaccacactcggcaaggagctcgccgtctacgtctaccgtctgaaccgtcagctcaagcacatcgaaaaccaggagtacctgggcaagatcaacggcgcgaccggcacgttcggtgcccacttggccgcatgcccggatgtcgactggatcgctgtctcccgcgagttcgtcacgaaccgcatgggcctgacctggaacccgctgaccacgcagatcgaaagccacgactggcaggccgagctgtactccaccgtctcccacgccaaccgcatcatgcacaacctgtgcgtggacgtgtggatgtacatctcccgcggcgtgttcgcccaggtgccggtcaagggtgccactggttcctccaccatgccgcacaaggtcaacccgattcgtttcgagaacgccgaagccaacttcgagatcagctgctcgctgctcgacaccctctccgccacgctggtggaatcccgttggcagcgcgatctgaccgattcgaccacccagcgcaacatcggttccgcgctcggctactccttgctcgccctgaccaacctcatgggtggccttgagtccatccacccgaacacccacgtcatcgagcgtgagctggatgagaactgggaggtgcttggcgagccgatccagaccgccatgcgcgcctgcgagctcaagggcctgccgggcatggataagccgtacgagaaggtcaaggagcttatgcgcggccacaccatcaacaaggaacaggtcgagcagttcatcgaccagcagtccttcgacccggaaaccgccgctcgcttgaaggctctgacccccgccacctacaccggtgtggccagccagctcgtcgctttcggccgctgagataggcgcgatgcgagtctctcgagtccctcgagtccctcgaatccttcgcatccaccacactactgcgctgagtcacaaaccgaaccgcaaactgaaccgaacaaggacaggcgtcaggtgaccatttcatgactactgaacaggatcagtccactacggaagatcgcccgaacaaggcgacctcctccactaccgaccggccgatcgcctctggtgacggccggtcggccagttttgctgtcagcggaccggacagcccggcaaccgacgacagcaacgattccggaccatacatcgacgacatcgctccgcgccgcacgcgcgacttcggcgacctgacccgagccggtctgtcgctattgatggccgccgtggtcatggtgttcgccgtgtatctgggcggcatgacgcgcggcgtcgaatccgacgcgcataccgccgcccaagccatcaactggctggctgctttcccctccaccgtactgacgcagctggccaccacggtcatcgtagttatcgtgctcgctcagttgctcttggcccgcgaatggctgcaagctgcggtgtccgcgctggccatgtttgccggatacggcattgtgtgggtcatatcgacggcaatcagcagtctgaacgatttcaccctgccaatggcactggtctcagccgccacctcatacggctccgggctgttgcccgacatctacgccggcatggcgtccttcctgaccgccgccgggccacgccgtacccgctccacggtcaaatggagttggaatatcctgtatgccatcgccgcggtgatggtggtgctttcgtggcattcggttaccggcatgctggtttcgatagccgccggtcgcacggtgggcatgctgatccgattcgtggtcggcacgcagaacaagggcgtgtggggccaagatctggtcgccgccctgaaaggcatcggactggacaccgcctcgctgattcggcatcaggagcccggcgtcggccacggttcactggccgtcacgctggacgacgatctggccgaaggctcgcgcatctacgatctggataccacggacaaccgtcgtttcatcgtttccgtcatcgacgcgcagacccataccgtcggctatctgaagcagttgtgggactgggtgcgtttcaccagtgtgtccatccgacgtgaccgttccgtgcgtgacgccgtccagcatcatttcgccatgctgctgggtctgcacaatatcaaactgcccgcgcccgcaccctacggcatcgccgataccgacgaatccgcgattctggtgctggatgcacacaccatcgaactgcccgccaacctgaacacgcttaccaaggcggatgccgtggcctacatgcgctacctgtccgtggcgagccggcgcggctatacgcaccggcgcatcacgccggacacactcgcccggcttgaagacggcaccgccgtgattgccggctggctcaacggcgacaacgcttccggtccggccaacaccgcgctcgacaaagttcagctgctagtgctgttcgccgcgctgatcggcgtggaaccggcggtggaggccgcccgcgaggcgtggggagacacgactctgacggccttggccccgttcattcagaaggtcgcggtcccctcccccacgcgcgcgctggaatcctgggacaagcagctgctcaagggcctgaggagtcgtatcaccgcgctggctgacgaggagacggtggaatccgccgaaccggtgacgctggcccgattctcctggcgttcgatgatcaccatgctgctggtcatcgtggccgtggtcgtggtcttcacccaactgaagcccgaggagatcatcaccgcgctgaccaacgccaacccgttgatggcggtggtgacgctcgcgttcggtgtctgcggctggatcggctcgtcgatttcgctcggttccctgatggcgcggcacaagcgtgacaatatgggcgtcttcatgagccaggtggcaggcggcttcgccaccgtatccatgcctgccggcgtgggcccctcgttcgtcaacctgcagttcctgcgcaaatccggctatcgcaacaccccggccaccgcaatcatgagcgccgcgctcgtggtgtattacgccgtgtacttctccatgctggtcatcatcggcctgttcaccggccgcaacatgttctccggcgcaatcccgacaaacacgttggttatcgtgctgggcgtggtggttgtggtgctgtccattgcgatgatgattccgccgttgcgccactgggtgacccgtcgtcttatgccgctggccaagacgtatatcaaccagctgctggacgtgctttcccagccccgacagctcacagtcagttgcctgggcgcgctgttccagaacgcgaccactgggctcgctttctgggcggccctgcaagcgttcggccattcatcgaatccgattgaaacgacgttcgtcttcctgctggcctatgcattgggttccgcagtgcccactccaggcggtctgggcggtgtggaagcggcgctgacattcgcgttcgtggcggtcggagtgccgcagggcgtggcgctttccgccactttgctgcaccgcgtggtgttctactggctgcgtattccgctgggcgcggcggccatgaagtggcttgacaagcataatcttgtctgattcgtctattttcatacccccttcggggaaatagatgtgaaaacccttataaaacgcgggttttcgcagaaacatgcgctagtatcattgatgacaacatggactaagcaaaagtgcttgtcccctgacccaagaaggatgctttatggcatacaacaagtctgacctcgtttcgaagatcgcccagaagtccaacctgaccaaggctcaggccgaggctgctgttaacgccttccaggatgtgttcgtcgaggccatgaagtccggcgaaggcctgaagctcaccggcctgttctccgctgagcgcgtcaagcgcgccgctcgcaccggccgcaacccgcgcactggcgagcagattgacattccggcttcctacggcgttcgtatctccgctggctccctgctgaagaaggccgtcaccgagtgaccttctgctcgtagcgattacttcgagcattactgacgacaaagaccccgaccgagatggtcggggtctttttgttgtggtgctgtgacgtgttgtccaaccgtattattccggactagttcagcgcttccataagctgctcgaatcccagggtgggctcggcctcgaagggatcgaggagtatggcttcccggcgttcgggggcggtcagggtcaggtgggtccagtcggcggagaactgggctccgacgttcagggccgcgtccacgaaccggccacgcagggcggcacgggtgtcggtcggcggattgtgcacggcgtattccacgttgtctcctgtcagcagctcacgcatctggttgcgggctacgagcgaaccgtacaggcgaccgttggcgatgtcgtggtagtcgagctcaagctgttccatctgggcgaaggtgacgtccgggcgacggcgtttgagcgcgtcgaacagacgcttcttggcggcccagtccacgcggtcggcgagcgcatcgtatgcaccacgctccagcgcgtccagaacgcggctccactcccccataatcgtgtcgatcgtggtggccggcagcgaacttgccagcgcatcgacatgggtttcgatgaaggccttgaccgccgcataataccggcgctgcagacccagtgcagacacggattcgcctgattcgagcgtcagttcggcgtgcggattgtcaaggaatcgactgaccgtgcgattggcggcagccggatcagcaaaggcatactgctcgaatccggacggagtgccgtggcggaaggcgtcttcgatcgcgcacagcacaaggtgcgtgacggcgagcttcatccatgtggaccattgcgaacggttcgagtcgccgatgatcacatgcagccggcggaaggagtcggggtcggcgtgcggttcgtcgcgcgtgttgaccatcgggcgggagcgggtggtggccgaggagacggcctcgtccaggaagtccgcgcgctgggtgatctggaagccgtccggggtcatgcggccggcaccggtgtacagctggcgggtgatgaggaacggcagcagctggtgttcgatggtctccaacggcacgaagcggcggaccaggtagttttcgtggcagccgaaggcgtggccggcggagtcgacgttgtttttgaacacatggatcgtggcgtgtgcgccgtaggattcgcgcagcttgcgctgggccttcagggctaggttgcgcatcacgtgttcgccggcgaggtcctgggccagggcctcgcgcgggtcgcgcgcttcggcggtggcgtattcggggtgggatccgacgtccagatacagacgtgagccattggccagatacgtgttggtggagcgggaacgggagacgatgggctggaacatggtcatcgccacctggccggcgttcacggggcgttcggcaccggtgaccgccacgccgtattcggtttcgacgccgaaaatacggcagaacccgtccatctcggcggatggtacgggttccgtggcgtgcagggagcgggtgccgctgtcacgcagttggggcatcactcgccgcctttttgcacgaagctgttgacgtattcctcggcgttggtttccaaggcggattcgatgtcgtcgaggatgtcgtccaacacgtcggcttggtcggtggactcggtttgggcggcggcctgcgtggtggcgagggcgtcgtcttcctgggtcgcggcctgctgtgcttgaggttgttcgaattgttgtggcatgttgtcttctttttgggctgtcaaactcccctcagtcagccttcggccgacggctcccctcacccgaggggatccggaggagtcaaaaaattatcgctggttgatggagtcgagccacggatactgctgcaggtaatgctgcagttcgcggatgatgagtccattggaggccactacatcgttatcgtgacgccagtggatgcgttcgccgtcccaacggctcagcgtgccctgtgcctcccagaccactacggtgccggcggcgatgcccgcgatatcccacacgtgcagcatcggctcgaagtaggcgtcataggtgccgtcggccactttgcacaggtcgagcgagacggggcccacgcgcttgatgtcggccgggcgtccggcgagcgaggatgccacgtcgagcgcacgctgcgattcgccgggcaagaaggacatgccgtagcccagcacggaaccatccagcgaggaggtcatcgacggcacgactttgtcgcgcttttcgccgaccgtggttttgtggatgcgcacggcgcccgctcccctggcggccaggtaggtcaggccgagggccggggcgtgcacgatgccgatgatcggcttgggctcattgtccgggccgaattcgaacagggcggcggtcactgtccattcgctcatatggcgtacgtagttgatcacaccgtcgattttgccgatgtaccagtaacgctggccggggcggctttcggcgggtcgggtggtccagaagccgtcgaagtgggcgatgtcggcgattctggagctcataaagcgcaaaatcttgctgtcgacttcgagcttatagcgggggccgcgatcagcttcggtgctcggctgggcgaggttacgcggattgagctggtcgtggagggcatgctgaccggcttcttcgagaaggccggcgactttgagcgcaaggttgcgcaggtcctgtggggtctcttcgcgtgtttcttccatagctaccaagtctatcgttcggcgttgatggccagcgacttcagcagatcgatggcgtgttcggccgaattgagttcggtttcgcagcgcgccttggtgaaggcgagcggatcggagatgtcaagggagaacaggtgatggtcggtagcggccatatggccggcattgccgtagaattcgacagcctcgccctcgtctgcggcgtgcgggtcgcgaacagtgagtcgggaccagctggcggcggccacctcgctaccgaatcgtgccacgagtttcgccctgagccaagcgcgggtgtcttccggaggttcggtggcggcgcgtgcgatgtcggcggcgctcatcacccgttcggtacggggttcgagtttggtgaagatgctgtccgcggggtcgagcgccgcccatttcaggtcgatgaccttcagtcgcgggtcgttccagccattggccacgctgggcgcagctgccgcggtgattttgcggcgcagtttttcgagcagctgccatttgagcagccattcgatgcggctggcctcgccggtcatggccagacgttcgtcatcgtcggcggtgtgacggatggaggcgcagtcgatgagcgcctgctgccacattgccatgatggatgtggtggatttgtccggccaggcgggctcgccggcggtgtcggtgccttcgaccagtgcggcgacctggtagacggcttggcgcagtttgagctggataagccatgcgttggtttcgccgccgttggccagcggcaggcttgcgcccagcgtcaggtcgtgggagacggtgtgcatggcttcgaccgggtcggccagttcgagttcgtcgaggaaggcgttcagatcgaatccggcttcgtccgcgtgttcgagcagccacagcagcatgctcgtggtgccgagtttcagggcctgcggtacctccatacggttggcgtcgccgacgatgacgtgcaggcggcggtattcgtcggtggagtgggattcgtcacgcgtgttgataatcgggcgttcgaaggtggtttgcaggccgactttgacgtggatgtagtcggcgcgctggctgagctgatagccggggatttcgctgttctcgccgattcctacgcggccggagccggcgtagatctggcgggtgacgaagtggagggtcatcaggcgcgtgactaggtcaaatggcactgagcgggccatcatatagttctcgtgcgcgccccagcaggagcccttgccgtccacattgttgcgatgcagggcgatgggggtgccggtctgtgtgcgggcgcgttcggtggcggcctgcatgatgaggtctccggcacggtcatagcgggccgcttcgaacgggtcggtggtttccggtgccgagtattcgggatgggcgtggtccacgtagacgcggccaccgttgggggcgatcacgttggtgatgttgagttgtggggcgtcggtgagcatgtccggtcgggcggcggcacgttcgagtcgggtgccgcgcgcgtcgttgaccgggtcctcctgccggtagtcccagcggatggatttgctgtggctgtccgcggcgccgttcaccacgtcgaaggacagttgcaccgggttgtagcggtccggggtgttcagggataccgcgtattcggtttcggtgcccatcactcgtttgacggtcatgtagtgctccttgagcttgagctattcggcggtgcggatgcggcggatcgggtccatgccgttgatgcgcgaccattgttcggggtccacgtcggccatggaatcgcgggtctcgcggtattcgtcttccacggcggcggcgagcaacggcacggtgagtgccacgtccgagccggtttcgatggattccttgaccgctcgggtcttggcccggtccacgatgttcttgagcatcgcgccggagaccacatcggccaggaacaacgcatgccactggccgttctcctcctgcacgtcgcacagatggcggcgttcggaggctccgtaaatgtcatgcaccagcacggcggacaaggcgtgcgcgtcgacgccatcttccagaggcaggtcgtcggtcaagtaatggtccacgatggcgatggcctgattggctttgggccgaccaacacgaatcttgacgtcgagacgccccggtcgtagcacggccggatcgatcatgtccacgcggttggatgcgccgatcaccatcacattgtcgagtgattccacgccgtcgagttcggagaggaactggggcacgatcgtggtctccacgtcggaggagacgccggagccgcgggtgcgcagcagcgaatccatttcgtcgatgaaaacgaccaccggattgccgtccgcggcgcgttcgcgggcgcgctggaagatcaggcgaatcagccgttcggattcgccgacgtatttgttgagcagttccgggcccttgacggacaggaacacgcctttaacgcgggtttcggccgggctgatcgagccgtcgccgttcgtatcgtaacccccctcgcacagggcgttcgccacggccttggcaatcatcgtcttgccgttgccgggcgggccgtacagcagcacgcccttcggcggcttcaaatcgtaacgctcaaacagcgcacgatgctggaacggcagttggacggcgtccctgatacgaccaatctcactatccaagccgccgatgtcggcgaacgtgacgtccggggtctcctccagcaccagatccttgtcgccctcggcgggcagcgcttcgatggcgaggcggacggacggatcgacgataatgcggtcgccctgattgatacccgcatacgcgagcgcgccggaacggcggatgagcacgggattgccggaggcgtcggtaacgatcagtcgaccgtcgtcgagtacctgcttgacactgcgaatctggcccacggtgtcagcgtcgcgctgctcgaccagcacgagcttctcgttgagcatcacggtggccccggcggtcaggcgggcggcgttgacgttggaggccacaggcaccaccatgcggcgggtgccggaaatgacttcggccgacgcgtgctggatgccgtcttcatcggtgcgggtggaatcgaccttgaccatggtggcgaaggtgagcggcggctgagcgagctgggcgagctgtgacttcgccttggtcagttccttgccggcgcggctcagcgcttcggcgagcgcatggttcttggccatcaggcgatcgttcagcgcggcgagatcttcggtgtcgctcatgcgggttcttcgcttcccttctatccgggattgtcggcaacttatggcagtcggcagaccctattcgttgccgtcggaggatttcctgttacgtatcacagtacgcacttttcgcaccacgaaccatacgatgatcacaatcacggccgcgatgaccacgtcctcgaacacgccgagcgcgccttgaatcgagcaccactggtcgccgagcaggtaaccggcggaaacgaggatggtgttccacacggccgagccgagcagggtccagccggtgaagtgcaggaagttcatgcggttgaatccggcgggaatcgaaatcagcgagcgtaccacgggaatcacgcggccgatgagcaccgaccatgtgccgtatttggtgaaccagtcgttggctttgctcacgtctttgcggctgacgccggggattttgtctgccgcgagattgatgcgatgcaggcccacccagcgggagatgccgtacaaggtccaggcaccaagtacggagccgatggtggcccagatgattgcgcccggcaaactcaaggtgccgcgtgcggcggtgaagccggcgagcggaaggatgacttcggacgggatgggcgggaagatggattcgagggcgatggccaaggccacgccgataccgccgatggtttccatcagcatgatcagccagtcggtgatggtgccgatcaggccgggttcggtggtggtgcagatgggcgtagggtcggtcgcaagaatagtggcggctgccatggaaaaactcatagagggcattgtcccaaggttttccaagaatcagaagcatgacgcaagaagatgtgcattttattgacaagtccgccgagagcgaagttgggagcccggctggttctgcggtttctgtgccgacgctgagcgagcccggcctgctggttatggatgtggactccacgctcattgacgaagaggttatcgacgagttgggcgtggtggctggctgcggtgaggagattgccggagtgaccgcacgcgccatgcgcggcgaactggagttctgcgatgcgctgcgcgcacgagtggccctgttggagggcctgccgatctccgtgttcgacacggtgcatgacaagctgcatttcaccaagggtgcgctggagcttatcgacacgctgcatgaacacggttggaagatcggcgtggtgtccggcggcttccatgaagtggtcgatatgctggcggccgaaggccatatcgactattggatcgccaaccggcttgaggttgccgatgggtgcttgaccggcaaggtgctcggcgaaatcgtgagcaagactgtgaagttacacgccttgcagacatgggcggaccgtttgggtattccgatgagccagaccgtggctgtgggcgatggcgccaacgatattccgatgattcaggccgccggtctgggtctcgcgttctgtgccaagccaaagacccagctcgccgccgacaaagccatcaacgaccgcgacctaacccacgtactcgattacctgcgccggtaaaattttaccgacctcggctccggcacttatagttgagccatgactacttcaggcgcagaacagttgacgcttgcggggctggctccccgcaagcggcgtaaacgtgcgcctgcggagcatacgccggccgagcagcatcccatagcgcaagtcgtgctggatgtgcaggcgctccacctcggtcagacattcgattacttcattgatgaaaaagacagcgaggccgcacaaccgggtgtgctggtgcgcgtgcggtttggcagtcagagggtcagcggtgtgatttgggcacgcaccgataccagcgatacgccgcgctcttcgattcgctatatcgagcgagtgctaagccccgatgtactggttcccgcttcgatgcgcgaggatatcggtctggttgccaaagcctatggcggcacacgggccaatattctgcgtttcgccgtgccaccgcgcgtggccaaggtggagaccgagcagcggttggccgcgtcgttccgtcggccggtcggcggctcattgccggataatacgcaaggcggttttgccgggcgtggcaccaatcccgatgggaccaaacctgctggctctacctttgccgttgctagcaccgtttcggagggagctgcgcaggggtatcgtcgtctgaccgccaattacgccgatgtcaatgtgcttcatgatgcgcttaccggtcaacgtttccaatcttttgtgtttgattcgttgcccggtgcacaggagtggcaacggaacatggcatggatggtggccactgcgttgagtgccggtaaggctgccgtagttgaattgcccaccatgcgcgaggtcgaagacctgatgcatatgctacgcaattatggactcaaaccatttgccccggttccaaccggcggatggatgggcgatgtggccgtgctcaatgcgaagaccatgcctgcggccgaccggtaccgcacgtatctggctgtggcgttgggccaggtgaaggtggtgatcggcacccgcgcggtgatgtatgcgccggttgaaggcccggcactgttcgccattctggaggatgccgcctatcagaacatggacggtatgatgccgtatccacaggctcgcggcgtgatgcggttgcgcgccaagtcccatggcggcgtattcgtggccatggccaatgcgcgcactccgcaaagtcagtgggaaaacaccggtccaggtacggtggaaactccggtgagcggctattccaccgcgattcatccgcttgcctcgccactgaaggatgcgacgccttgggtgcgttggctcaatcgcgatgagcttgcgcgtctcgctgacccgtccatcggggcgcgcgtgccgcatacggccgtccgcgtgctatctaaggctttggaaagtggccccgtgctgctatccattccgcaagacaatgtcagtgagaccttgagctgtgcgaaatgccatcgtcaggtgcgttgtgccaagtgttccggaccgttgcaactgccggccgaccgccgggattctacaccgcgatgccgctggtgtggggctgccgccatcaactggaagtgcccgggctgtgggcatgaacgtatgcgcgtggtgcgcgtgggtgctgcaggcactgcggctgaactggccggattgttccgcggcgtgccagtagttttgtccagcaagacgcagggcctggtgcgcgatgtggcttgtcagccgattatcgtcatcgccactcccggtttcgaaccgcgcgtgcgtccggtcagtgccgagcagggatcggctggccatgagtatcgtgccgtggccgtgctcgacgcttggaccagcttgtatgcgttgggcgtggatgctcgcttggatacattgaccgcgtggatgcgtgcggtgtcgttgtgcgcgccgcgttcccgtggcggccaggcgttgattctcggcgaaaccgacccggccatcgcccaatcgctgatgctctgggattcgaggattcttgcagccaaggatcttgaggagcgtgtggagaccggtatgccgccggccgtggccgccgcctgcgtatggggacgccgtgatgcggtgatgacgctgatgcagcgtatcggcgcgctgggcggcgattggacggcctgcggcgagctgcccggcatgttgggcccggtgccgatcgcgcaaccggacacggtcgacgcccgggagctcgaagccacggacgaccgggtgaaggcagtaatccgtgtgccgcagagtcggcgagccgagctggcggcccgactgcaccgggaaaccgctcgtcatgtggcgtcccgcgaacccggcgagcttcgcttccgagtagatcccaaggacctgatctaatcgtcttcaacacgtgaaacgataattacagaacgaacatcgctagaaggaggacactatgaagggttggcctggagagccggatatggattacgacgtgctggtcgcggatggcgaggccgctgcgaacgccggcaagccgatcaccgacgtgatcttcgatttcggcaacgtgctgatttactgggatccggtcgccgtgctcatcccccgctacagccagaagaccatcgacgaattcctcgacaacgacatctccggcttctacgatgtcaacgacctgatggacggcggcaccagcaccgacgaggccatcgccatcatgcgccgtgacaagggcgataagtgggcggacatcctcgactactacatcaagaacttccgcgactccctgaccggcatcgtgccgggcgcgcgcgtgctggtcaatgacctgaaggccgccggcatcggcgtgtggggcctgagcaactgggaatccagtctgttccacgtggccgaggaacagtgcgatattctgcagcagcttgatggcaagctcgtctccggttttgtcaagctgcgcaagccgcacaaggaaatctacgaggccgcgttgaaccagttcggcatcaaggccgatggcgcgttgttcatcgacgacaaggccatgaacatcgtcggctcgaatgcggccggcatccgtggcgtacgtttccaggatccggtcaagctgcgtgaactgctcatcgccaatggcgtgaacattccggccgtgcagtgagcatcgacatttcaaggaggaccatgctcaaactcgtgttcgccggcacccccgacgtggcggtgccctcgctcaaggcctttgccgccgacccacgttttgatgtggtcggcgtcattacccgccccgatgcgcctaccggtcgcggccgcaagctcacgcccagcccggtcaaggcgacggctctggagctcgggttgcccgtcatcgatctcaaaccccgctcccccgaattcatggaggcgttgaacgacctgcatgcggatatcgccgctgtcatcgcctatggcaatatcctgcccaagaacgtgcttgatgcggtgcccatgggctggtacaacctgcatttctccaacctgccgaagtggcgtggcgccgctcccgcccagcgtgcgatttgggcaggcgacccgaccaccggcgccgacgtgttcaaggtcggcgagggcttggacgatggcccgatcgtcgcttccctgaccatcgaactgaccggccgtgagacctccggcgaactgcttgaccgtctggccgaagaaggcgcgcccatgtatgtggatgctctggccgccgtcggcgaaggcaccgccacattcaccgcgcagccggccgagagcctggaatatgcgcacaagatcacggtggaggacgcccgcatcagttggacggacgaggccgaggccatcgaccgccagattcgcgcctgcacgccacatcccggggcatggaccgaactgtttgcggaagggccaatcgccgataatgacgagtcaaccgctaaatccctcgccctgcatattctcgccgcacaaccggccgaccagtccaatcccaacactccggccgagcttcagcccggcgagctgaaggtgggcaagaagaacgtgtgggttggtaccggcagcacgccgctggaactcacccaagtcaaggcgcaaggcaagaaggccatgcgcgccgccgactggacccgaggcgcacgcctctcccccgccgcctgcgtgcgataacaagcaatatcgctcccgccttcggaagcacagtaaaggcccggcatcttcataaagaagatgccgggcctttcagctatgcaatcggcgatcagttgagaccggagagcttgttgatcagctccgggtcacgcgtcgcacccttgtcggccgagcgggcgaaggcggcgtacgccttcagcgcctgggagacgtggcggttgcggtgagccacgtagccgtcgccagcctcaagctcgcgacgacgctcgtccagctgctcgtcagtcagttcgacgttcacggaacgggcttcgatatcgatatcgatgatgtcgccgttcttgatgagcgccaccgggcccttgttggcagcctcaggcgccatgtggccgatggccagaccggaggaaccgccggagtagcgaccgtcggtgagcatggcgacctgtttgccgatgcccttgcccttgacgaaggaggtcgggtacagcatttcctgcatacccgggccgcccttcggaccctcgtaacgaatcacaagcgccatgccaggcttcagggtgtcgttcagaatgacctcgatggcctgctcctgggagtcgaccaccagagccggtccacggaacttccagatctccggcggaacaccggcggtcttgaccacgcagccgtcgggggccaggttgccgcgcagcacggcgaggccgccttcgtgaatctccgggtggttgatgtcgtggatggcgccgttggtgcggtcgcggtcgagcgagtcgaacagggtggtgtgcgtccacggctccggggagatgatgtggccaggagcggccttgtacatctgctgggcttcctcggtgcaggtcgggcgcatgatgtcccaatcggccagcttggcttccagcgtcgggtagtcgatggaatgcacgttggtgtgcagcttgccggcgcggtcgagctcgccgaggatgccggtgatgccgccggcgcgatgcacgtcggaaatctcccacttgccggacggcgaggccttgcagatgcacggcacggtgtgggaaatacgctcgatgtcgtccagggtgaagtccacgtcggcggactgggccatggcgaggatgtgcagcacggtgttggtggaaccgcccatggccacatccatggtcatggcgttctcgaaggcttccttggtggcgatggagcgcggcagcacggaatcgtcggaatcgtcgtagtactggtgagcgatcttgacgacttgcttggcggcacgcttgaacaggtccttgcggtaggagtgggaggcgaggatggtgccgttgccgggcagggccaggccgatggcctcggtcaggcagttcatcgagttggcggtgaacatgccggcgcaggagccgcaggtcgggcagacggtcttctcgtaattgagcagttcctcatcggagacgttgtcgtcggcggtggcgtacatcacgtcgataaggtcggtgctcttgactgtgccgtcggcgagcaccgtggtgccggcctccatcgggccaccggagacgaacacggtcggaatgttgaggcgcagggctgccatcagcatgcccggcacgaccttgtcgcagttcgggatgcagatgagggcgtcggcgcagtgcgcgttgcactgatattcgacggtgtcggcgatgatgtcgcgggaaggcagggagtagagcatgccagtgtggcccatggcgatgccgtcatccacggccatcgtgttgaactcgcgcggaatgccgccggcttccttgatagcctcggaaacgatgcggccgaccttgttgaggtggacatggccgggcaggaactcatcgaacgagttggcgatggcgatgatgggcttcttgcccatgtcgtctccgctgacgcccgcagcacggtagagggctcgggcgcctgcaaagacgcgccctgacataatttttgcagatcgcatttcagtcatggttctattcaagcctttgcgagggacacgccatttgtcaagagtcgaatagtggaattttcaaaaacgtaacgtttctcacagttttttttggaatacattcctctggcgagagtccggtatagggctgacagaagtccccccaaacggctacacttgcttcggttgagatagattttccaatgtctggagataagaacaatggcttttggtactgacccgacacccgacggtcttgcgaacccgccgatcgacgacctgatgaagcacgccgattccaagtacgcgctggccattttcgccgccaagcgcgcacgccagatcaactcctacttcacgcagctcaacgagggcctgctgcagaacatcggcccgctggtcgaataccagaacaatgagaagcccctgtccatcgccttccgcgaaatcgacgagggcctgcttgaggagaccttgggcgaggacgacgccaacgagggcaactgatcgattccgacaattcgtttggattgtttggacagttcgtcgccgaatgatggtgtgagagttctctcacaactgattttgagcgacacgcttgcctgagttatcgcaatcggctataactcaacatcgggagcgaataagacgcaaggctcgcgccaccgcgctggttggcacgagcctttatttatgcccgcttccacagtgacaagtaaaaattgacaccgtatcattgtgcctcgcatcccgcggggcgataagtcctgaagaaagggatgatatgacagaagaacatcggcttatttccgccgaatccgtgaccgaaggccaccctgacaaggtctgcgatcaaatctccgacgccattcttgatgatttgctggcccaggattcgtccagccatgtggccgtggagacctccgccgccactggcgtgttcctgatcttcggcgaagtcacgtccaaggggtactgcgacgtgcagtccaaggtccgcgaaaccctgcgcaacatcggctacacctcctccgaagtcggccttgacgccgattcctgcggcgtggtcgtggccatcaccgagcagagcgccgaaatcaaccagggcgttgcccgtctgactggcgatcaggagaccgccgccagccgcgaagagcgttacgaagcacagggtgccggcgatcagggcgtgatgtttggctacgccaccgacgagaccccgacgctgatgccgcttccgatctacttggcacatcgcctcgccttccgtctgaccgaggttcgtaagtccggcgaagtgccgcacctgcgcccggacggcaagacccaggtgaccattgagtatgacgatgacgataagcccgttcgtctggacaccgtgctgatctccactcagcacgatcctgaggttacgcaggattggcttgctgttgagctgaagaagcacgtgattgacccggtgcttgatgaggtgctgggttccaaggtgccgcatgacaactaccgtcagctggtcaacccgactggttcgttcatcctgggcggcccggcggccgacgccggtctgaccggccgcaagatcatcgtcgacacctacggtggcgctgcccaccacggcggtggcgcgttctccggcaaggacccgtccaaggtcgatcgttccgccgcgtacgccacccgttgggttgcgaagaacatcgtggctgccggcctggcccacaaggtcgagatccaaatcgcctacgctattggcgttgccgacccggtatccgtcaacgtggagaccttcggcaccgagcaaggcgtgacgcgcggccagatcgccgccgccgtacgcaaggtcttcgacctgcgccccgccgccatcatcgacgagctcgacctgaagcgcccgatctacttgaagaccgccgcgtacggccacttcggccgcacagacgttgagttcccgtgggagaagaccgacaaggtcgaggagctcaaggccgcgattgctggggagtgaggtgctctaattaggacagagagatcataagaataccataagaatagggtgctttccgctgttgatggcggaaagcaccctatttgtttttcgcagtgtcctacgaatctgttcttatttcaatccacgcaccccagtggggtgcgacgccacgattccaaggatcgtgtcgaccgcttccaatttcaatccacgcaccccagtggggtgcgacatgcgtatcctgctctgccacgcaaagtgcaggtatttcaatccacgcaccccagtggggtgcgacacgagtgtgagcgcatacgcctatgatgcaagttatttcaatccacgcaccccagtggggtgcgacctagataatcgtctaggctgatgtcttgcggcttatttcaatccacgcaccccagtggggtgcgacagcgcggtcatggtttcctccttaaaggatcgttatttcaatccacgcaccccagtggggtgcgacacctgcaactgtctcacttgacgtaccgttttgagatttcaatccacgcaccccagtggggtgcgaccaacacgcgactatcagccttgccatgcttagggcatttcaatccacgcaccccagtggggtgcgaccgttcgtcagatacaccgtatccgcgtacccgttattatttcaatccacgcaccccagtggggtgcgaccgtaacgggtggtgcccccgcagtcctcaacctcatttcaatccacgcaccccagtggggtgcgactcccttctgattatcagtcttcgtacaggtcatcatttcaatccacgcaccccagtggggtgcgacgagattattcacgccgttggcgggttcgatacgatttcaatccacgcaccccagtggggtgcgaccgacggcacggccacgttccggtcggacgcggttatttcaatccacgcaccccagtggggtgcgactacagataaccagttaatcagcgacactatgataggcatttcaatccacgcaccccagtggggtgcgactgacccgaacagtggcacggtacagcaggtggtatttcaatccacgcaccccagtggggtgcgaccatgcccaggaggattcggccgagcgaacggaaatttcaatccacgcaccccagtggggtgcgaccgaaaccgtcctgcaggcgggtcgattgtccgcaatttcaatccacgcaccccagtggggtgcgacttccccaccacgtccgccgtggggcgcgttttcgaatttcaatccacgcaccccagtggggtgcgaccccgcgacgcccgatcggcggactcccacgagaaatttcaatccacgcaccccagtggggtgcgacaaacgaggcacaggagccgcaagggaacgagcccatttcaatccacgcaccccagtggggtgcgacatcttctggttcgcgccgtcgcgtccgccaaatgaatttcaatccacgcaccccagtggggtgcgacacaagcgacacgctctatttttgttacagagatatttcaatccacgcaccccagtggggtgcgacggcgacaccatcatggacgccatcatcccgaccatatttcaatccacgcaccccagtggggtgcgacggcgcgcgtggtttaggtaagacatacggtatacatttcaatccacgcaccccagtggggtgcgaccgggcttcaccgattcaatgaaggccaacgtgttatttcaatccacgcaccccagtggggtgcgactgaccggtcttgccgtttacctgaccgtccaagggatttcaatccacgcaccccagtagggtgcgaccaccaccttggcggtagaccccgcgcccgtccaatttcaatccacgcaccccagtggggtgcgacttaattaccgtgtttggcgtccaaacattgtaatcatttcaatccacgcaccccagtggggtgcgaccgccggttactttttgtaaccgagtgtggtatgatatttcaatccacgcaccccagtggggtgcgaccgcaacgcctctgggaacgagccctaatagcctatttcaatccacgcaccccagtggggtgcgacgtcgtcggctgccacctcgcggttgtccacggggatatttcaatccacgcaccccagtggggtgcgacgcaacatcaccaccatctgggtgccggcgatcaaatttcaatccacgcaccccagtggggtgcgacccaaaaatctcacagcattaggcgtaaccgacaccatttcaatccacgcaccccagtggggtgcgacaaacctatggtcgatcagattacagagatgtatgaatttcaatccacgcaccccagtggggtgcgaccaggaggtcagggctcaaacgctcaagctacttcaatttcaatccacgcaccccagtggggtgcgacccgccttgtgtttccacccgtccggcgcgatggatttcaatccacgcaccccagtggggtgcgacgctgattccacgtgtccggcgtgccgaaaatggcatttcaacccacgcaccccagtggggtgcgacggtgcttgggacttcacgattcccgtgggtgtcttatttcaatccacgcaccccagtggggtgcgacacgatcccgcgtggcgatgccgggactgctggcgtatttcaatccacgcaccccagtggggtgcgactatcggccttcttgctggcggcttccttgtcgagatttcaatccacgcaccccagtggggtgcgactatcggccttcttgctggcggcttccttgtcgagatttcaatccacgcaccccagtggggtgcgacccgggcgattctttcttttttagttgttcaagagatttcaatccacgcaccccagtggggtgcgaccttgcctctccgaccacgcgcgggtcaaacatcgaatttcaatccacgcaccccagtggggtgcgactcaagccgcagcggatagtgcgagcaaggccgggatttcaatccacgcaccccagtggggtgcgacgtctacgttgtccatctgagttaccaactgagccaatttcaatccacgcaccccagtggggtgcgacgttgccgcagtattggcatggttcggtggtgatatttcaatccacgcaccccagtggggtgcgaccggtcttgctcatttgaatactccttcgcagtgatttcaatccacgcaccccagtggggtgcgacgaggccacgtccttggcgaggtccttgccctgggtatttcaatccacgcaccccagtggggtgcgaccgggcggaagctcaggttgttgaacatgcagtccgaatttcaatccacgcaccccagtggggtgcgacgcgctgatgattgggccgatctgctcgcggaagatttcaatccacgcaccccagtggggtgcgacccgcgttgctgatgccccacaattggccgttccaatttcaatccacgcaccccagtggggtgcgacttcacgcgccgtgttcatttgcaagacgatggtatttcaatccacgcaccccagtggggtgcgacttcgggcacgatctggcagtcgcagtcgtcgtgatttcaatccacgcaccccagtggggtgcgacggccatgtcacgccaggcactgcagcgcatgaaatttcaatccacgcaccccagtggggtgcgacccggcagcaaccgacgccttgcctaccttgtccttatttcaatccacgcaccccagtggggtgcgacgatgccctggccgtcgatcttgccgacgacggcatttcaatccacgcaccccagtggggtgcgacttgacgcgggtgatggcacgggtcacgtcctggtcatttcaatccacgcaccccagtggggtgcgacgtcatggctttccaagatcgttgtagccttcatcaatttcaatccacgcaccccagtggggtgcgacacgtagggaaacacgttgtcgtaggtgtcgtgatttcaatccacgcaccccagtggggtgcgaccacgcaagggctgttgatggcgtcgcccgccttatttcaatccacgcaccccagtggggtgcgacaaaccgttctggttcagttctatgaccttcttgttatttcaatccacgcaccccagtggggtgcgaccatcaggcccaaaaccgtggccacgccgccacagatatttcaatccacgcaccccagtggggtgcgacctcaatgtcacggcaccatgtaccgggcagggatttcaatccacgcaccccagtggggtgcgacgatatcaccgccacgctgttcggcgtgtccggcaaatttcaatccacgcaccccagtggggtgcgactctgcggccggttctccacacggttcacggtcgtatttcaatccacgcaccccagtggggtgcgaccgccactcaacccattacagtcttgtgtgccagaatttcaatccacgcaccccagtggggtgcgacctggagttaatgctgagcgtgggtagcatcgtggcatttcaatccacgcaccccagtggggtgcgacgtgcttgggactttacgattcccgtgggtgtcttatttcaatccacgcaccccagtggggtgcgactcacggtgccgtccaggcctctcaatttcagccaatttcaatccacgcaccccagtggggtgcgacgtctggtaggcgctgtaacgggtgttcgtgtcgatttcaatccacgcaccccagtggggtgcgactccagcaacatcaagggatatgtgaccaccgagcaatttcaatccacgcaccccagtggggtgcgacttgttgtccttggcgcgtttctcccattcgcgggaaatttcaatccacgcaccccagtggggtgcgacaaggctggacgtgacgacggacgcgaccttgctatttcaatccacgcaccccagtggggtgcgacaattaccttgagtgaatcggccgcgaactttgaatttcaatccacgcaccccagtggggtgcgacgtcatggctttccaagattgttgtggccttcatcaatttcaatccacgcaccccagtggggtgcgaccactcgtccagcagccgagggcttcgtggcgtatttcaatccacgcaccccagtggggtgcgaccaacacacccttctcaggtgccatcacactatcgatttcaatccacgcaccccagtggggtgcgactggtggggccggtaagtatcacgtcggtattccaatttcaatccacgcaccccagtggggtgcgaccagcaagaaggaagagtaacccatgaccagcaacatttcaatccacgcaccccagtggggtgcgaccggtctggctgccgccctcgctgtgcccgtcaagatttcaatccacgcaccccagtggggtgcgacgaacgcgcgccgccagccggccgggtcgtccgcatttcaatccacgcaccccagtggggtgcgaccgttcgaccgactgtgcaacgcattgcgagtggccatttcaatccacgcaccccagtggggtgcgacgttgatggctatcactatacgcggtccaatactgatttcaatccacgcaccccagtggggtgcgacgacgcctgtacctctcgaccgattggggagtagaatttcaatccacgcaccccagtggggtgcgactcggtggtcttcgacgaggaggtcataccagtagatttcaatccacgcaccccagtggggtgcgaccggtgttggcctgcacggtgctcatctgctggtcatttcaatccacgcaccccagtggggtgcgacgccgcctgagtagggcgcgccgttctggataactatttcaatccacgcaccccagtggggtgcgacttgggcatcccggcgtcgttgatgctcgcgaaggtgatttcaatccacgcaccccagtggggtgcgactggccgccctacgcgaagaacttatcgggcttatcatttcaatccacgcaccccagtggggtgcgaccgtgacatccagtaaacactgccactggatcgcatttcaatccacgcaccccagtggggtgcgacccagcccggttatcacaccgggctggttcatctatttcaatccacgcaccccagtggggtgcgacttgttggctccatcataggtattcccaattggatttcaatccacgcaccccagtggggtgcgactaacccacgtcgcttactggaggctccaagcgagtcatttcaatccacgcaccccagtggggtgcgacgacttcgcggtatcactaccgcaagcggacagggtatttcaatccacgcaccccagtggggtgcgacaccggccttgttcgggttgccgggggtgatctgatttcaatccacgcaccccagtggggtgcgaccatcacgtcggagatggtctgctggtcggcgttatttcaatccacgcaccccagtggggtgcgacgcacaccgccgctcaaccgttcgcactccgccatatttcaatccacgcaccccagtggggtgcgacacaccacatgccccgacctcgcgccgaacgggctatttcaatccacgcaccccagtggggtgcgacgattcttggcggcttactacagcaatcaggtataaatttcaatccacgcaccccagtggggtgcgaccccctcacatacgcttcctgcatctgccaaaacgtatttcaatccacgcaccccagtggggtgcgacaacacctcattagtcacctgcgttttctgttggatatttcaatccacgcaccccagtggggtgcgacgtttgcgctcccccgtcgcggtctgtttcacgtatttcaatccacgcaccccagtggggtgcgactcataagccggtcttcttcgcgcagctcacgcgaatttcaatccacgcaccccagtggggtgcgacagagtatcgagggcgtggacgtgtgttgggtggagatttcaatccacgcaccccagtggggtgcgacgacaggtcaacaacaactgcctcgtgtccggcgtatttcaatccacgcaccccagtggggtgcgactataccacgatgcggcaacagcctactgccggttgatttcaatccacgcaccccagtggggtgcgacgttgcgctggtcaaaacggttcacctcctcgacgcgatttcaatccacgcaccccagtggggtgcgacccagcttctggttccccgtcggcttggcggacgatttcaatccacgcaccccagtggggtgcgacatcgcgtctctcaaggaggcccaaagcatctggatttcaatccacgcaccccagtggggtgcgacttccggggctccggcttcggcgaggtgcgtggaatttcaatccacgcaccccagtggggtgcgacaacttacttaattgagctataattattatgtcaacatttcaatccacgcaccccagtggggtgcgacccggtgtggcttgggtaggcgttccacgccgtggtatttcaatccacgcaccccagtggggtgcgacagcatgtcggtgtgcggctgcatggtcatctgcgtatttcaatccacgcaccccagtggggtgcgacgcgcgccacccggaactcacgacagtcgttactgatttcaatccacgcaccccagtggggtgcgactgacggcgatcagctttgtcttctggctccctggtatttcaatccacgcaccccagtggggtgcgacgattgtctcgttgacggatgtgttgctgacctgagtatttcaatccacgcaccccagtggggtgcgacgcccgcttgacgtgcgctcaattgagcgcaacaatatttcaatccacgcaccccagtggggtgcgacgaggaatcaccgatgcaaccatcaccctcatcccatttcaatccacgcaccccagtggggtgcgacatgaacaaacaccatttttaacaccacaacatatatttcaatccacgcaccccagtggggtgcgactcggcttggtgccccatgcggcttccacggtctatttcaatccacgcaccccagtggggtgcgacatacgtctgtgggtagctctcgtaatcctcagcatttcaatccacgcaccccagtggggtgcgaccgttgacggcaatcgacgcgacaatggacggattatttcaatccacgcaccccagtggggtgcgacacccacggtctttttccgacaccagttcaaggtcatttcaatccacgcaccccagtggggtgcgacagcgtggcataagccacgcgcgtatgatgatacgaatttcaatccacgcaccccagtggggtgcgacggctcatctccgacgaggtggcgcaggccaacgaatttcaatccacgcaccccagtggggtgcgacattcaaagaccttgacgccatcaacgccgccaagatatttcaatccacgcaccccagtggggtgcgacagagcttggccgtgtccacgccgtcgaacacacacatttcaatccacgcaccccagtggggtgcgacactgcggcaagcatgattgacgccgggatgccgaatttcaatccacgcaccccagtggggtgcgacttcaacaggacactgcggatacgactccacaggaatttcaatccacgcaccccagtggggtgcgacctcacgccaccgcgtcatctcggcgggggagggatttcaatccacgcaccccagtggggtgcgaccggttcggcccagacgcggaccttcccggaagcgatttcaatccacgcaccccagtggggtgcgaccgatggcctgtgcggggtctccgccggtctcgttatttcaatccacgcaccccagtggggtgcgacccgccgcaaatgcaaggccagacacatcgcagccatttcaatccacgcaccccagtggggtgcgactcgggcataaaaaaccacccgtgcgggtggttgggatttcaatccacgcaccccagtggggtgcgactcggtgaccggaaccaacctgaacggatcacggaaatttcaatccacgcaccccagtggggtgcgacaacggctatcaatggacttttgacgacatgctaatttcaatccacgcaccccagtggggtgcgaccggcgcgatctgttcacgtcaggttgcagcacgagggaatttcaatccacgcaccccagtggggtgcgactgagggcttatcattatccccgaactgcgagagattatttcaatccacgcaccccagtggggtgcgacattcccttggcttttgcggaacttccaaccgccttatttcaatccacgcaccccagtggggtgcgacattcctgtcgttgatatcgggtatgcgccccgtgatttcaatccacgcaccccagtggggtgcgactctacggtgagcttggtacgctggtcggcagtaatatttcaatccacgcaccccagtggggtgcgacggcatcgaggctagccaaagtaagctgggcgcatgatttcaatccacgcaccccagtggggtgcgacgcgccctcctgtcgcgccgtcaggaaagcgagacgatttcaatccacgcaccccagtggggtgcgactctcgcactgcccgaggggctggacaccggtagtatttcaatccacgcaccccagtggggtgcgaccatgcgctatctcggaggagaggtcacggcgcttatttcaatccacgcaccccagtggggtgcgacccgtggcgcgccgctctcgcatactgggcggcatatttcaatccacgcaccccagtggggtgcgacgtcacatagcagctaccgaatgtgacgtcgtgctgatttcaatccacgcaccccagtggggtgcgacgttggcttcggcgcttacccttggcggtgacgtatttcaatccacgcaccccagtggggtgcgacagggtctcgctaccgtgttccaccgctccgacgcaatttcaatccacgcaccccagtggggtgcgaccatgtactatcatctgctacgtgagcttgcgttatttcaatccacgcaccccagtggggtgcgactacggcggcaaaaaactcatgatagatgactgggtatttcaatccacgcaccccagtggggtgcgacacgccggcaccaacatcaccaatcacattgaaagatttcaatccacgcaccccagtggggtgcgacatgcggccgcgacctacatcggcaaggtgtcgaaatttcaatccacgcaccccagtggggtgcgacaagatggcgacggcacttcatacggcttatacggatttcaatccacgcaccccagtggggtgcgactcgtcgatttaccagttcctggatcaccatagattacatttcaatccacgcaccccagtggggtgcgactagacgtggtgtggaggcaggacaacaccagtcaatttcaatccacgcaccccagtggggtgcgaccgaccgccatcggaatcccaacctacgaataagatttcaatccacgcaccccagtggggtgcgacgttcgccgcattggcggcggcgttgaagccgatatttcaatccacgcaccccagtggggtgcgacccggcggggtccaggccactccggtcggagccacatttcaatccacgcaccccagtggggtgcgacgccatcgcgcgatatgacggccagccggacaggcaatttcaatccacgcaccccagtggggtgcgacccgtatcggactgcaggacatcatcaccgtcacgatttcaatccacgcaccccagtggggtgcgactatccgctcgcccaagaacggcggcgacgaactcatttcaatccacgcaccccagtggggtgcgaccgagcagtggcgcctgtcccaatcggaggccgatatttcaatccacgcaccccagtggggtgcgaccgcaacaatgcgatcagcgacgagtacccggaaggatttcaatccacgcaccccagtggggtgcgaccgcgagaatgggcatagcattccataatacggaagctccgtctgttctcaaaactgattttatcgcgaaaatccatgtacatcgctcaatacacaaattctcgaaccaaaaacatcaacagaccatccacttttgagttatcaaacgacgaggagaacataatcagtctccaagcattcattaatctcagtgcgaaagaacaagtatttcatgagaactcagagttcgcgctggtcacatggctgcagcatcaagcatcgatgctcagccacgattttaatcgtatcgtcctatactgtcctacctcgttttatccaccttggtcttcatcacagtaaggttttgcattgcccagtcatcatggaagaccgtcacacgaaccgacattagagcatcatcacgtcatcgattggcaggtgccgctgtcttccgcgatgctcaatcttcgaagaatacttcgcccctaaattgtagtaacgcaggctatcttgcgattcgtccattatttccgccaaatcatgtttcaaaatcagatagtcagacggtgacaccgaacattcaaagacgctattctgcacgcgttggccgtatttcatgcaggttttagccacgttccgtagtctgcgtttgccttcaggcgactccgtattgacgtcataggccacgacaaccatcattccaacacctcatcccggtttccatctctagttggctcaaactccaatgcccctcggcaagaccaaagtaccctcccaagaagaactacttccacatgaacggcgggtaagcgtccaaatcgccacgaatcgcacggttgagcagcaacgcctgtgcatggggcaccaatccccacggtatcttctcgttgaagaacgggtgggtgattgtctcctgcttgcgtttctgccaagcagcaagcacggttttgcgcccgccctcggaaagaaacacgccgccattctctcggatctcgaactgggaaggcttgaccgctccagtgttgatgagcgtcagcacgaaacggtcggcgataaccggacggaattcttcaaccagatccaaggccagggaagcacgtcccggtcggtcagtgtgcaggaatcccacatagggatcgagcccgactccctgcaaggcagcgatgcaatcgctggtcagaatcgagtacacgaatgacatcaacgcattcgtccgatccaatggcggtctgcggctacgctgctggaagaagaaatcgtccttgttgcgcagaatcaagtcgtcgaaagcgaagaaatagtctttggctgccagcccttccacgccgcgcagctcatcgatggacgtgcagtcgcgcgcgttcagcagagcctgccgcagtttctcgctttgctccgcgatacgctcgctgttgacgcgcagcgcatggtcgcgcttggtccgctcaagaacccaacggcagttgtagatctttcctataatgaacgactgcgcaaaaggcagggccgcgtcttcgtcgtccgcgaaacggaactgctcgcgacgaagtagtacgtttcgattcttctcaccaagtatcgagcagtagtaacggccgtgtggagagaagaacgaaaggccgacgccaaattccgaacacttgcccatcaacgccggcgacgagcccttataagaaaaactcatgatgccttctagggagcgcagtggaatcctcccgagcgtggtatctccttgctggacaatgacattgtcgttcttcaacgataggtaagcgtcatcgctggtgacatacagtgtgttaagtaactgcttcatatgtggtctgacttctccccgatttccacttccccacgcacggcttcctcaatgaactgtctcgccgaacgcgtcctgaccagtttcggtagacagacatcgcgcagggagcacgcccgacaggccttcgacggtctgaccttcggcgtatgacctcgagcgaataagtcgtgcatctcccccgtcatcgtgacgattcgattgcgcaaagattcgtcaaaactgacccgctcccggtgtctggtctgttggtagaacaaagcgccttctggaatcgcacaggccagcatctcctccagacacatggcctccgcgcaaagttgaaggcgatccgcatccgtctgcttgggcgcaccatgtttgtattccacggggtaaggaagccaagtgccggatcgtccatgcaacggtacgccagcctccgattgccggaactcgaccacatcacacgcaccggtaattcccaaccgccgcgaaaacacacgcagatcacgcataatcagcaagctgccgcgcgtttccgattcactgtaatcgtgggccctatcgtgttcaagagaaccagccgtcgtgagatagttatcctcccactgctgctcgatatgaattaaagcccactgccgcctgcaaaacgcgaaatgttggaggccggaaagagccagccaatcgtcctctggataatctgttggctctttcacagttgctcctttatgccgacaatactgacgggattgattcagcgaccttcgagtacttcgtaatggagaccgggaatatgcgtggtatccacggtgatgacaccttcttcatcaaccttggcagtacggtggaccttcgctgacgaatattggcccgctttgctgttgtgcgtaaaccacgccagattcaccacttccatggagcctgcaggtcgtgctgaactttcgtcattctcaaacagagtcagcaaagcttctttgattttctctgcgtctttctcagtgaaaccagtcttttctgccaattgagggctgatactgccatgggtcacatatacagcacgtccggagacacggtgcttcatacccatggtgtcggaggatttcttattcgtgtctgtagtttcgccattcactgacttggtgatttgtacgtcgtcaatagcgatgggttcaagagagaatgcagattgtatggtgaacggaccgcgcactggaatggagacggaagcatcgccttccttttcctttcctttgaacgcaaacacttgtccaaaggagcggacatcaatccactgttcgcaagctctgtaggatagagcttctcggtctttctggtcttccttgcttagggtcttggtaaaagctttccaacgatctgacagagatttttctccatcatcagtacggtctgtggactgtacaaagattcgctcgcctgcgtcttgtaggcgattgcggatcttgcgcttttctgccacatccgacatttcacccaagccttcagcagtggtacgtggacggtttccattcagcggatcgccgttagggttggcgttttcaacagcgaacgtcagtacgaaatcaattttgtgctgcaagctagtcatgattcattctcctttattttcaatgttctgttctttgagttgcttggcggcatcggccctctggataagctgtctgcgtttgtgggaataaccgagcaaaaatagtgatgacaatggcttattgctttcgaagtctccttctttgaatttgctcatgacctcgtcaacttcgttctggaagaacatcccattggtggaggagatgatatatggattcagttgctgccgtaatgtcagccacgtggtcgatggtttggctacgaaattattcatcagttttacggcattagtggtgcggtccggtgtccttccaccgctctgccttaataagactctgtattcgtaattgtcagcgagcgccagcaactggccgaataaataatctcggtccgttcgcttctcgtctaaatccatggtgatgttgttcctttcatctaagggaatttttttatcttgatcgatgtagtactttttccacatactgcaggcgacttcgaaatcgtgctgccagacagataaactgtcataggacaatggccgaataaccttgtggaaagccggctgcaggagcgatgcaggaaggccagcgttgctgaacatgcactctacgagttgtttttttacatatttggcaaagcgtctgtaactatcactgctgtgatcgtcagtgctgtacacacagttgataacatccgcgaatgacggcgcgccgatgtatggaattggcttcggtttatcggaagacttcttggacccgcgcggagcctcgtcatcggtagatgcgctgtttttgttatcaaaacaagtgaggtaccacgcagcatcttcgtgccattgaagaacgctttcaatgtactcgttttggaataattcacggtagaaggtaacgctaagacgccccgaagtggcggcatcgaaaatagccacgactattcgtctgctatgctgctgcatttgttgcagtaccttctcgttgccataaccgcgcaacaatttaccgaattgctttgcataattcgcgtaagtttgaacgtttgcgtctataagtttttcagaatcagtacggtcatcgacctgttcggctacatcgcgggaatttccagtgggatcaagaacattgtccgtcggatggccgtcaattgcccaaatcacaatatcctgactaccggtaagcgtgccattattggttgcaagccagcgcagcgttgtatggattttctgtgaagtcagggtatcaatactcagtgcttcatcgcgattagcgaaacgcccacggaaagtgaaatacgtgttgtcattggcggatatcaatttggcgttaccgtttacattgacaatcttctttgggaagttagtggaaggcttgtacagtgtctcgccgaacagatcagttccaagactggcaccgtgccgcacctgctcctcatgggctatccacaaatcccgtattgcatgatccgcccaaactttcggttcataatcaccatggcgaacatgtaccgcaaagcggactccgattttactatctttcttgggatcgatcccaataccttgtgctcgagcttcttcgattacgctatgttgcgaaagatattggtaaatagcatttaacttcgcattatcacctttccaactggcaagctggctgagatatgattcatgcttgaccgggtcataattggtgtcgatgtattgcaactgatcgaataacgggtgcggaggcagcacctttccggagcgccccatggattgctcagtacaaggggcgataatttcaatgtcggcattatctcgcttgatagtggggtatccgttttcatcaagtgtgacctgtagctgagtcttcaacgtagtgtgataaagaggcaacaaggttttattcacgtcttcattgagaggtgtgattcctgctgaactgttcactgcatcataggtctgcagcagactggaccataaactcatgtctactcctccgccatgctaaaattgcaaccctcaataaaatctttgacatgctgattgcgccggataatgcgttgatctaattgtgtggaatcggggcgttcaaactgaatgatgccatcgtgcattattggacgccagaactgggcgatgaagtcatgttccgggttttcatctggataaataaaactatgaaactcaaagccgaactgccaatcaccataaccgtcgtagaatccttcgccagaaccgaactcgcatggttccacatatccttggcactctctggtgccgaggaaaatgtctcttcggcctccaagattgactgatctcttggcgatattgtggtgtttgttctcgttgcggtctacacgcaagtcttcgcgttgctcattccactcaaaatgagcaagtacttgatacttgactttcttcaaataggtgtaatacgacagatcattcccaccactcatcttgattggccggatacctttgccttcggtctgaatcttgttcatcacgcgtactgcgtcaatgacccacacgattgttggtttccaatagatgctctcagtaatacccttcagggcttgatacgttggaatctgatatgagtttttttctccgcccgtgcgggtggcaacttctgagaacaaggcgtagtcgccatatatcacatattcaatcgagttgcgatgcttttccataatcacctacttcatcagaagcggcatttccgctttcaagaggaatccgaagtcttgactgtagttttcttcgttgagcactaatatgccgaaatctccattcgcttcgctaatcgatttcgacttgtcaagtgccttgaattcgtaatcgaagagagaaaccgtatactcctgcaatgagcccagtatcttaatcttggatgcaaaatccccctcaccattaagttggtcaatcagttccatcgcctgtccataatgtaccacaacatccgtggtacctccgggaatgacatggaagctatctcccacagtttggaaagcctgggcaaatgcgtatgggtattgctctccgacgcggttacagtacaacccgcgacggcgacggttgaacgacaataggtcgtatacggtttcttcgcctccgagaattgagtaatccatggttccaatgttccgtgatttggagtccactaattttggataccggataaggaaagcgcggtaatattcttcgatcataaatgcagagagcaagtcttgttccggataatcatggatgagttggtccgtgatctctttccctaattggatttcaggaagatatctcaatcctgactcatctttaatggaatatacataaacgtttctcggcatctgcgattcgccattgcgattgcagcgacccgctgcttgcaagatactgtcgagtcccgccattgcacgaataacacaagagaacgaaatgtccacgccggcttcaatgagctgagtactgatacaaatcactggttggcccgaatctccagtttttttcggcaggcatttcttcagcacggcaagttggtttttgcgatgtgcaccgcacatcgcagtactcagatgcaccaatgtaaaccggtggtcaacgtctagttccttgacgagttgatatagctgtttggcttcgcctttcagattaaccacagccaaacagttaccgttatccaacgctttgctataaatttctgctgcaaaatcatcgagggtcagaccctgcgatgaagcgacaatattggtccgacgaagttgctcggcataatcattgtcgggatcaattagatcaggcttatctgaaagcaacagatttctgcggtcggtttgttccaaaagtggctgagtggccgaacagagcaaaatcgtggaacccagaatcttggagaggaaactcacgacttcgttgaacacgttaatggtattggtgggcagtgcctgtacttcatcaaagacgataacgctatcagccaagttgtggaacttgcgtagtcttgttgctttcgcagacatcacagtttccaggaactgcaccatcgtagtcacgatgataggcttatcccatcgctctgcagcaagacgtcgttgctgctccttttcgtcatctttatccggaaccacgctcgaataatgctcgagaagaatctcgtcgtctttgtcgagatcgaggacattgcggaatacctgcacggtttgctctgtaattgacaaataaggggtgatgtaaatgatatggtgttttcctgtttcctgggcatgatggagcgcaaaacgtagagaggccaaagtttttccaccgcccgtgggcacacctaaacggtatattcctgtatcgcgtgtgctggctgcaagacaattttcagagatacgcatcctgattttgctgatcttcgacgatgtatcaaaaccactgatcgcattttctagtcgacgagtcagttcttcccaattgggagtctgcgaagtatatggttgatgagccgtgaagtttgccgcatcgactcgatccgcatctacgagccgcgaatagatgtattttgcatacaggcccaagaagaagctgcgagaattccttgtgttgcgcggtgaaataccacaggaatcgactatttctagcagtctattggtctcaacgacactgttggcgaaattggtgtttatatctaggtttaaggaagaaacatggctcagtacttcttgatagtggtactgctcggcttttttgttctcgcctgtcaacttcctaaagtaagcagttcctccacaagcgtctaggcaatccggcagatgaccatgatgattagcgattgccagctcaagtacttctgcggttatcatactggctgctgatgatggaaaatcggcagcacaatcatcaacaatgaacgcgccttgcttggcatgaacgacttcccctcgcttgcggttgccggtcagcagatatcgtttgaagtcatccgtagctttgccggaatcgtgcagcaatcctgcggcaaacgccgtaacagaacttcttttttcaaagcccgctgccagttccgctgtgttgtgcaaatggtcatacagcgtctgcgtattgccatcatcatctttacgcgctaataataaatccttaggcatcaatgcctgtcccattgcgcaccctttctgaataattgaaacatctgcgtgcccccattatcgccgaatcttttatgtgcggtaaatttttaccgaacgcgacgtaattatgcggaaaattagaggtccagtgctgaaaaagccgtggaatatggattgcgtcgtctgtgcctccgctttgaatcggaggcacagacgacgcatttttgagatacctatactatctgcatcattttttcaatccacaccttgctgagatgacacgggcagccgatggtgcgccctgcaggatatcaggtgaatggtgtcgcaactggcataacatcattcatctgctaccctctaatagcgaagaaagactcatactcctggatcgggaggatgagaatgacaatgatggcgattagttccatcttcatcacctgcacctttcccgtgaaacaaaggccagtatttctggtctctaggtgagtacgacttgtccggcctgctcgcctagaaggaatcatatcttcaatgatgtagatagtaaaagccatgttcgatcggcgtgtcgatgtgcattgttcgacaaagtcaagattggcgtctttccgggcatcctaaataacacagctggcatcacggagtgcatacgaaaaaacggctcttcgggtgtttgtgtgggtgtgggtccctggtctggcttacgggttattggcgtccggggagttggaggttgaggccgccgcatctgagcatgaccagggcgatgaggttgccgaggttcctgtagccgtagccgatcttgatggtggtcttgatcttgttgttgacggcctccagacgagcgttggatagtccggaccggatggtgcgcaggatgtcgaagcggcggcggtcgatcttctcgccgagcctcgagaactcctcgatgcccgagagggacgcgtctgcagaatcgggcccacgctcttccagttgacgcgcatcagcgccgacacggcgctcctgggcgcgtgcacgctcagccatgcgacctgccgctcgaagtcacgcgtgtacgcgctcttgcgtctcgccacggcaccatcgcgacggccaccccgtgctccgcgcaatcgaccctccggggcgcgtgctccagaaggagcctggcgcagccgatgtcgagatgccgccagcggcgcacgcccagccggtcgtacggccggccacgctccccacatctggcgcaccggtccatgtctccctcgcgtacgggcgcaccgggacgatgacgacgtcccctccgcgcgggtccttctcgacgcgcggcacgccggccacgacgttcgcgggcaggcccggcatgcgcttgagcgcgccggctaatatggtgggcacaggcgttcctctgttcctcggttctatttcttggcggaaacaaatctaacaggagaacgcccctcccatacccgcacacgaaaaagccccggcaatggacgccggggctttcccaccacacaaactggcgaagacacaaaaaacttgtcgttgtggctggaatccacacaatcccaaccacaacgacaagctcatatcaattggcgtatcgagtttactgggctgtccacaacgttcaatattgacaactcagcaaactcaattcagcgatctcacgccttggcgacctccacgcccagctcggcgccctccttcacctcgaaggaggaggccagcgtctcatgggcgatcagatcgcggaactgctcgaccttggccacgtcgtcagcaggcacggtcagcgccagcgagatgcggtccgcgatgtccagatcggcagccttacgtgcgtcctgcacagaacgaatcacgtcgcgggcgtagccttcggccagcaaatcggcatccagcgcggtgtcgaggatcacgaagccaccggtcggcagagcggcggagaccgaagcggcggcctcggtggcgttctcctcctccacgcggttgatcagctcgtactcgccttcgaccagcgcaaggtcgccggacggcgtggagaccaccggcgcaccggacgcagcatcgacatgccagtcgccggacttggaggccttgatggcgaactgcacctgcttgccgaggcgcggacccgccgcacgggcattcacacgcagctcgtgaacaatcttcagaccgtgggcggaggcgtcctccagagtcgagaactcaatattcttgatattaagttcggccttcagcagctcgtcgtaggctttgacggcgtccacgttctcgaccaccacggtgagcttggaaagcggctggcgcacgcggatcttggcggccttgcgcagggacagggtgccggagacgacctcacgcaccttctccatcgcatccaccaaggccggatcgtcgaccagcacacggccgagttcggtgtcttcaccggtcttctcgtccaccacgaacggccaatcggccaggtgcacggactcgccaccggtcagaccacgccacacggactcggcttccatcggggccagcggcgcaagcacgcgcatgaacgcctcaagcacggtgtacagcgtgttgaacgcggacgcatcctcgttccagaagcggtcacgggtgttgcggatgtaccagttggtgagcacgtcgatgaagtcggagaccgcatcgcaggcgtcggaaatcgcgaactcgttcagcgacttctcggcggccagcaccaggcggcgggtacgggccagcaggtagcggtccatctccggcagaccggcgacctcgtccgcgcgcagctggcgggcgtcgaatccggccccgccgttggccgcgttggcgtacaaggtgaagaagtagtaggagctccacaccggcaacatgacctggcgcacggtgtcgcggatgccatcggcggtgacgatcaggttgccgccgcgcagaatcggcgaagacataaggaaccagcgcatggcgtcggaaccgtacttgtcaaacacgccgttcacgtccgggtagttgcgcaagtgcttagacatcttctggccgtcggagccgagcacgatgccgtggcagatcacgttcttgaacgccgggcggtcgaacagggcggtcgccatgacgtgcagcaggtagaaccagccgcgggtctggccgatgtattccacgatgtagtcggccgggaagtgctgctcgaacttctccttgttctcgaacgggtagtggaactgcgcgaacgacatggaaccggactcgaaccagcagtcgagcacatcggaaatacggtgcatgtgcgacttgccggtcgggtcgtccgggttgacgcggaccaggttgtcgatccacggacggtgcatgttgatgttgccgtccttgtcgcgcgggtagtcaccgaagtcggccttgagctcttcgagagaaccgtaaacgtccacacgcgggtacttcggatcgtcactcacccacaccggaatcggggaaccccagaagcggttgcgggagatggaccagtcgcgcgcgttggcgagccacttgccgaactggccgtccttgacattgcccgggatccagttgatctgctggttcaattccagcagacgcggcttgatcttggtcacggacacgaaccaggaggagaccggcttgtagatcagcggggtggcgcagcgccagcagtgcgggtaggagtgcacgtagctcttctcctgaaagaggatcgcgcggcgctcttccgggatggaagcgagcgggccgtcgccggcgcgcaggttgcgcaggatcggcaggttggcgtcgaacacgaaatcgccctcgtagtcggggcactgcgcggtgaagcggcagccatcgtcgagcacgtcggtgctcttgatgcccttggcattcagcgtgttcatatcgtcttcaccgtagggggcctggtgaaccagaccggtaccttcgacggtgtcgacgtagtcggcagtgaagatcgtgtagccgttcgggccgggcacatggccttcggattcggccgtctcgcccgcgaagtacgggaagaccgggtagtagcggcggccttccagctcggagcccttgagttcgcgcacgacctcgtagttctcgccgagttccttctcgtagtgcggcagcaggtccttgccgaggtagaacttcttgccagcgaacttgccttcggtcgggcggacctcgacgtagtcgatgtcggcgccgaccacgatggcgaagttggtgggcacggtccacggggtggtggtccagaagacggcgtaggcgtcgtcttcatcgcgcatcttcacggccacggacacggtggtgtcctggcggtcctggtacacgtcggcgtccatgcgcagctcgtgcgcgctcagcggcgtgcggtccttcgggcagtacggcagcacgcggtagccctggtaggccaggcccttgtcgtagagctgcttgaaggcccacatcacggattccatgtacgggatgttcagggtcttgtagccgtgctcgaagtccacccaacgggcctgacgatgcacgtagttctgccattcgttggtgtacttcagcacggaagcgcggcaggcgtcgttgaacttgtcgatgcccatcttctcgatctggtcgaccgagtcgatgccgagttccttctgcgcctcaagctcggcgggcaggccgtgggtgtcccagccgaacacgcggttgaccttgcggcccttcatggtctggtagcgcgggatcacgtccttggcgtagccggtcagcaggtggccgtagtgcggcagaccgttcgcaaaaggcgggccatcgaagaacacgaattcgttctggctatggtcgccggaagggttgcgttcaacggacttctggaaggtgtcgtccttgtcccagtagtcgagaacggtctcctccatgtcggggaagctggggttcggcgcgacgtgcgcggtctcgccgccctcgttcgccttgggatatacgttttcgctcaccgtaaatctcctgttagtactgtgcactggtcctacaggagcgtcattgatggcgattgccgggcgccgacgtgtgccggctgggttcacgaatgtcacgtaccgaaccgtggggccgatcgcgtcaatcgcctcgcagccggaactgactgtgttccgcccggaacagccctgtctgccgttcctgcctacgaggacgatgacgggcgctggtatgcgctccgcaccgcggtaccacctcgcttatcgcaccggttgcgccgctccgaactgttgcactcggagccgcgagcctgcgcgaccgcttgtgttcggctgtctcgggccgatcccgtcggttctactgggcgattgccgccgttcttccgaagactccccgctgataacggatcactgcctcacaacggtgcatatcgtaacacgccacgcggtcaaatcgatgggaatgttcatcaggaatgttcattctttctcatttttgtattcatcgcgtgcaccattgtcagcaaacacgctaggctcctttaccggcgatattgcacatctggctcaggggcggctcccgtatgggccggagaaaggattattgaggaatgacgtacgatttcacgtcgattatggacaggcatggcaaggatgcgattgcggtcgatgggttgggaaccgacctaggtttcgctcccgacccaccgagggacggatttgacgtgattccgatgtgggtggcggacatgaatttcccgaccgtgcccacggttccgcaggccattatcgaacgcgcgcaacaccccgtctacgggtacttctcccccaccgacgactattacaactccattatcgactggcaatccacgcgcaatggggttaccggattgaccagcgaggcgatcggctatgagaacggggtcttgggcggcgtgatcagtacgctgaccgcgttcgccgctcctggcgacagcgtgctcctgcacagcccgacctacatcgggttcaccatgtgcatcgagaacaacggctatcgcatcgtccacagcccgctcaagttggacgagcacggcgtatggcgcatggattacgaggatatggataagaagctcaaggagcatcacatccatgtggccgtgttctgcagccctcacaatccttgcgggcgcgtgtgggagcgttgggaaatcgagaaggccatggaagtgtacaaggccaacgattgcgtggtcatttccgacgagatttggtccgatttgactctggggaatcaccagcacatccccacccagtcggtcagcgaggacgcacgcaatagaaccgcggcgttctacgcgcccagcaagaccttcaacctcgccgggctcgtgggcagctaccacattatctataaccccatgctgcgcgaccggatcgtggccaagggctcgaagtcccactataacgagatgaacgtgctttccatgcatgcgcttatcggtgcctacaagcctgaggggcatgagtggctcgacgaactcaaagaggtgctcaccggcaatgtcgactacgcctatgactacatcaccaagcatttccaaggggtgagtttggccaagccggagggcacctacatgctgctgctcgactgcgagcagtggtgtaaggctcatggtttgactttggcggaattggagaagcgcggctgggatgtgggcgtcgattggcaggacggcagcatgttccaggctccctacagcatccgtgtcaaccttgcgttgcccttaagccgcatcaaggaggccatgcgccgccttgaccaatacgtattcaacgcgtaaacggcatgcatccgcgattgcggtgtcctggaaagacgaatgccgccaacgaggtttgtgcccgttggcggcattcgtcatagagaagccgagccaatctaccttcacaactaatcgtcgaggctgtccacaccgagcttctcttccagctcgatgacaatgcgctcgtgcatcttttcgtcgatcttcaccgtgaacatgaagacgagaagactcagcacgatgaaggcaagcgggatgtagaacgcgaaggtctcgaaggtgcgcacgttggcggcggtcatgtcggcggcggtggcggagccgaccataccggcggccacggccacgaagccgacgatgccgttggacagcgcgcccgcgatcttgtcgagcatcggacgcacggagagggttacggcctcgttgcgcttgccggtcttgagctggccgtattcgatggaatcggtcagggagaggatcgcggtcatctggatgaacgtgccaggcaggtagaacagaatcaacgccacgatcaccacgggcaggctggccgaatcgagaatgaacagcacatagccgattgccataagtaccatgccgccgcagaacaggtatcggcgcggtatgcggcggttcagggccgggtagagcggcgccatgaccaagcccgcgatcacggggatcacgccggtgatggcgaaggcatccggcaggttaagcacgaacttgaacagatagaacatcacgccgttggtggccacattcgccactgcatacagcaggtagctcaacgccacccacagcagctggtcattttttacgatagcggcgaacgcctgcagcgggttgccgctctgatctgccctggaacgtaggacgctttcgttttccttggtgccgaacgccacggtccatgcggtcaggatgccgagcaatgcggtgatgatgccaaatgccgtccagcccgactgactttcggcgcgagaaccagtgaacatgaaactgaaagtggtcacgatcggtaccacgacaatggtgctgccgttatagccaatcgaaccggtgaacgtaccgagcgcagtatatacgctgcgttcgtgcgagtcggaggagatggcgggaatcatgccccagtaggagatgtcacgcatcgaatagaacacgtcgaggacgatgaacaccacgacgaacagcacgatgaaccaagtctggttcacgttgaccagcccgaacagaccggtgtagaccatgacgagcagcacggcggagaccaagccgccgatgaactgccacgggcggaaccggccgaagcgggtgttggtgttgtccaccaagttacccagtaacgggtcaaggaagatctctgcgatacggattatcacgataaggcttgtgatcagtgcgatgagtttggtggccaaggctttctcgacattgacgaacagcacgctggtcacgtaaacgacgaaataggtgctcagcgcgttatagaacgccgactggcctagattaccgaaagcataggcggcacggcgcctcagagtctctgctttggtaggacgatttatctggccggattcatctccggccggattcggtgattgggattcgctctccggtgactgcgaaacggacattgacattttctccttagagtcattctcggtgaggtcttctccgacctcgttggagagtgtacatcattaccaaaatttaataaatcttttcactaattattgtcaatagaaccaatctcaaaaccaacgtcgcagcactcgcaaaaatcgcagaattccaacgaatacacacctctatcaccatatgaattatcgacagcgcgacacaccgccacagaaaatacctccagcaacttgcgatctgcaccatcaggttttaccataatcagtaaagagttttaccctctgaatcaacaatgtggttatcaactcaaggaaagcggttatgcagcatcccatccccaccaccatcgcatcatctgattggctcaccgatccgaccgtattcgccgtcaaccgcgaaccagcccattccgaccatcgcttctacgatcacgtaccgcagccgaacgaaacgatgagcctcaagcaaaaccttgacggcttgtggaatgtcgccgtgacgaccgccccggttttcggcttccccatgaacgattccggcaacgctgaatctccggatttcaccgcaaccgattatgacgacaccggtttcagccgcatcgccgttccctcaacactggaaaccaagggcttgctgaaccataagtacgtcaacgtgcagtacccctgggatggccacagcgaccccaaggctcccaacatccccactgatggtcacgtagccatttaccgccgcactttcgagacaagcacccccgtctccgccgccatcgaaaacaagcgccgcatcacgctgaccttccacggcgcctccaccgccatctacgtctggctcaacggttccttcgtcggctacgccgaggactcctacacacccagcgaattcgacgtcaccgaggcactgatttccggaaccaatacactggccgtggcctgctatgaatacgccaccgcaagttggctggaagatcaggacttttggcgcatgcacggtctgttccgctccgttgaactcaccgcgcaacccactgtgcacatcgaagacctgcacatcaccgccgatttcgaggcgaccacccatgccggcaccatcgacgcccatgccgtgatccgcaacatcgccgacgccaagcaactcagcgccgcactcatggatgccaacggcacgccggtctggcaggattcctatgccatgtccgacatcgtcgacacctccggcgtaccctgctgcggcaccgcagacgccgcgatcgacagcaccgccgtgcaattccgcgcgaatctggccaacattcgtccatggagcgccgaaaagccctacctgtacacgctggctctcaccgtgcgcgcagcagacaacagcatcatcgaagtggtgccgcaacgtctcggcttccgccatttcgaaatcgttgacggcattatgcgactcaacggcaagcgcatcatcttccgcggcgccaaccgccacgagttcgacgcgcgtttgggccgtgccatcaccgagcaggagatgctcaccgacatcatcacctgcaagcgcaacaatatcaacgctattcgcacctcccactacccgaatcagacgcgattctacgaactgtgcgatgaatacggcctgtacctgatcgacgagacgaaccttgagacccacggcagctggaccattcccggtgatgtggagacccctgaaaccgccattccgggcagcaatcccatctgggaaggcccttgcgtggaccgtatcgccagcatgatcgggcgcgaccgcaatcatccgagcgtactgatctggtctctgggtaacgaatcgtacgcaggcgaggtgttccgcgcgatgtaccgcttcgctcacgcggccgactccacgcgacccgtgcattacgaaggcgtggtgcatgaccgcccctttgacgacgtgaccgacatcgagacccgcatgtatgccaagcccgcggaaatcgaggaatatctgaccaatgatccgaagaagccctatatctcctgcgaatatatgcacgccatgggcaattcggtcggcggcatgcatctgtacaccgagctggagcgttatccgcattatcagggcggctttatctgggacttcatcgatcaggccctgtggcagcagctggacgacggcaccgaacgcctgacctacggtggcgactgggacgatcgtccctgcgactatgagttcgccggcgacggcctagtcttcgccgaccactctccctcaccgaagctgcaagaggtcaagcgtctgtacgctcccgtggtactgaccgtaagcgaccacgatgtgaccatcgaaaaccgcaatctgttcgtctccaccattgatttcgcgttcacggcgaaactgctggcggacggcaatgccatctggcaggccgactaccgctttgatgtgcccgccggcgagacccgcaccttcccgattgacttcccgtcggtggacgccgctggcgaaatcacctatgaggtcgatcagtcgctggcaacggcaacaccgtgggcaccagccggctatgaactggcgttcggccaacacaccgttcagtcagtcgtgccggcttccgccggaaccgattcgaccgcgtgcggcgcggttccctccgcggctgattccgatacttccgataccggtacagtaacggttggccgctggaacatcggcgtggtcagcggtgacggacgtaccgaagcgttgctttcacgcacgcagggcggcatggtgtcattcaagcgtgacggtcgcgaaatggtgttgcgccgtccggcgatcacctgcttccgcccgctgaccgacaatgatcgcggcaatggcagcggcttcgaccgcgtgcgctggttcggtgccggccgttatgcacgtatagcgaatcagcagttctcgcaaaccgagactggtgtcatcgccgaatacacatatacgttggccgagccgggcgaaacccaagttgccgtgcgctatgaggtggatgccgccagcggacgtgtacatctggccgcccgatatgccggtgccaccgatgcgccgacgctgccggcattcggattggaatggacacttcccaagcagtacgagaacctgcgcttctacggccttggccccgaggagacctatcgcgaccgtctgcacggtggcaagctcggcattttcgagcgcaccgcggccgaagacaatgcaccgtatctggtgccgcaggagaccggcaaccatgaagacgtgcgttgggccgaagtgcttgacgcccaaggacacggcatgcgtatcagtcaggccggcagcgaacatttcgcggcgagcctgttgccgtacagctcgctcatgctggaagaggcgacccaccagaacgagttgccgccggtccgtcacacgttcctgcgcctgttggccgcgcaaatgggcgtgggcggcgacgattcatggggcgcgcccgtccatgagcagtaccagctgcccgccgatcgcgcctacacgctcgacgtgaatctggaactgttctaacagcgataaagaagctccctccacagagggagcttctttatcgcacagagggagcttctttatcgtgctggtacgaaactgtcacgcactactagggtggtggagatgaaggtgtggtggtgcagcgtgcgccgactggagatggcctcggcaagcatcgtaatcgcagtatcggccatctcattctggtcgatatcgtaactggtcaatgtcggcgaagtgtactgggcgatggcctggttattgatactgatcacactggtatcgcgaggcaccagcactcccgcagcggtaaacgcctgcagtacgccgactgcaatcgtgtccgcagccacgatgaacgcatccggcatgtcatctcgatgatcgttagccgctttctcccctagagtgcgcccggtgtccacagtgaacgcgccttgcgcgtaaatcaggccttccgcatccagccccaaacgctcggtccaattgcggaatgcggttaatcggctgtcttccgggtattcgtgcaaacccatcgtgaagccagtaccgccgatatagccgatgcgtcgtttgcccgaggacaccaacacatccaatgcgtccaaaatggtttggcttaaatccggttgcaccgaatcgaacaggccgggcgcaggattgatgtcgatgaatacgccataaggcaataccagatggagtttcaacagttcatccgaagaaggtacggacggtccgatggaaatgaagccgtcgaaatcaccggcgttggcaatcagatcgtcgatatgggaaaacgacgtgagttccatgtgctgggctctggcattgtcgccgagcacggaccgtagttcatcgaaataggcgtccgccagttcttcctcgcgggtggcgttgtcgagtacggccacacggcgtggcaatacgatacggcgtgatccggtagcgtagccaagctgctcgctgacctcgatgatgcgacgtcgcgtctcctctttgacagacaatgtcgggtccccattgagcagccgggataccgtggcctgcgagaaacctgattcctgcgcgatttccttcatcgtgaccatgacatcatcccctcaatgcaaacattacgtagtacttcagtaaattactttactacttagcgtaacacgcaaagcccgcaaccggaatacaccggtcacgggctttgcgatatcaatgtcacatcagcagacgatatgacctgatgtcagctctcgtcttcggcgacgcgggagcggctgtagatcatcttcatcgagcagatgaagataaccatcgcacccaggacgatgatgccgccgaccatgaagacgttggcataggtcgaggccggaccggattcggtgccgaacagtgagccgccgctcatcgcgccattggccatgagctggccgaagatcgcgacaccgaccgaaccggtgatggcctgcatcagatcgttgaagcccaatgcacgtccggattcctcggcctccacggtcagcgttgcggtatccacaatcggctggtagaagaacgaggtgccgaagtagtagatgcacggcgccacggcaagagcccagatctggcccatcggaatcaggaacgcaacggcgatcaggccaccgcccatgcaggcgagcgccagaatgatggaggccttgcggccgatcttctggatgatcgggccagcggcgaagcccatgatggcggcgaggatgatcgaccacaccagcaggttggagacctgggaggagtcgatgccgtacacgttcaggccgatggcgttgcagccggcgttcagggtgtagctgaagaagtagccgacaaagatgacgatcatggtcatcgcgaaggccgggttggtgagcatctccggggtgatgaacggatccgcggccttgttgatgtagaccacgaaggccacgccggtgaccagcaccgcgataccccagaagatggtcatgtcggtgaagaacatggtcaccgagccggcgaacaggccaatgagcgtgaagccgatcacgtcgacgcgcgcgcccttggcatgctcgtcaggcaggttcttggccaggatcgggatgaagaacaccgcgatgatgccgataccgaagaggatgcgccaatcgacaagggtcatgtagccggcaaggaagacgcccagagccgcggcgatacggaacacggcgacgaacacgccgtaccagatgactcgcttcttcttctcgatgtacttggagacgagcaccaggaagatggagccggagacctgccagcctgcggactgcacggtacgggcggcgatgacgatccagatgctcaggtcgccgaagcagccgaggaccgaaccgagcacgaacacgatcgtgccgagaatcatcatcttcttcagggacacgaagtcaccgagagaaccgtagatcacgcacacgatgccgagcacgatgcccggaatcgaggtgatcaacggggcgaggttggcctggccgagctggtcgccgatgttcacatagatcatgccgaaagcctgctgctgcagcacgcccatggtgaagatgatcagtacgatcggaatggcgatctttgccatcttgttcatacgggcaaactcttcggtgccctcctcaggcaccgggataccgttcgccttctccttgacagcggtttctgccatggtgattcctttctattggtttgagtttggtggaatgccttatgcgcgagcgcaaggagtaaaaacagctacctcctctcgcatgggaatcgacggcgccgcgcctcttctggataccgcgagggccgaggccttcgcggcgaaatcaagtgcatgggcgatgggttcgccggacatcaggtcggcaaggagataaccagtgaaggtgtcgccggccgccgtggtgtcgaccgtgtcgacgagataagcggactgcgtgacgacgtggtccccacgcaaatacatcgaaccgcactcgccgagggtgagggctatatccgcctgggagaaacgcgcacgcatcgcacggatcagtgtctccccatcttcttcggcccctgtgagcatcgccgcctcgccctcattgagtacaaaacagccgatggcatcaagatcgacttcgtcgagccgcgagtcagccggcgagggattgagcacgatgaacatgccgcgggccttggcgcgggacacgatatagggcagttcgctgatttcgttctgcagcagcagccaatcgcccttcccatacccgtcaagcacctgatcgacgaaatcacggtcgatggcacggttcgcgccggggtacagcacaatgcagttgtcgccgctggcatcgttttggatgatggcgttgccgctgcgcacatcatcgcgcactaccaccgaggtcacgcccaccgcgcaggattcgagcaggtcgcgcaggaacatgccgtcccgtcctacctggccggcatggtgcacatcggcgccggcacgagccaatgcgatcgattgattcagtcccttgcctccggggaacacgtcgagcgcatgcgaggtgatggtctggcctttggccgcaaaatgatccaccccgtacacatagtcgatgttcagcgagccgaaattcagtatgcgcatcaggactcctttcccatgacgggaccggtgacagccagttcgtagatgcgacggcaatcgtcgcgatcaaggcgggcaatggacccgatggtggcgtccggcccgtagaaatcgatgttgtccaacatgcgttcgatgccgtcgcccggcagatcgaagtccttgaaggaaacaggcatgcctagcgagcggaagaacgattccgttgcggcgatgccacgccgggccagttcggtttcgttcatcgagccgggcctgatgccgaatacctcagtggcgtatcgcgcgaaacggaacggggccttctcgctggccacgcgcatccaagatcccatgatgattgacagggtggccccgtgaggggtgtcgtatagcgcgctcagctcgttggcaatcaggtgggtggaccagtcctgttcacgacccacgccgagggtgttgttctgcgcgatggtggagatccacatgatttgcgctcgcaagtcgtaatcggcaaggtcggccaacgatttcgggccgacatcgaccaaggtgcgcaatgcgccttcggccatacggtcgattacgccgatctcgttgtcggcgctgaaataccgttcgcagatgtgggagaacatgtccacaatgccgcaggcagtggggaacgccggcaccgtgacgctgagttcggggttcatgaacgcgaatgccggccggagtactggttcgctcagcgtgagcttggaatgctcatgctcattgttgatgacggcgacctggctggattcgctgcccgatgccgggcacgtcagtaccaccgcgacgggaagggtgcgatctaccggcactttgccggtgaaataatcccatacgtcacgctctccggcggctcccagcgcgattgccttggccgaatcgatgacgctgcctccgccgatggccacaacggcgtcgacattgcgggctttggcgatggcgatgccttcacgcaccagcgtcagtcggggattcggcttcacgccgccaagctccgtataggaaatgccggcccgtccaaggctgcggcgcacggcatctagcaagccgctggtttccagatatgctccgccatcatgatggatgagcacgcgggaaacgccctttgcgcccagttcgtctcccactttggtttcggcgtcgcgcccgaaaacgaaggtggttccgatgcatatggtgaaatccctcatatcatgctccttgcgtgtatgacggtgtccgtcatgatgtcgttgagttccgcgatgtcgtgcgccacatatgcggggtttctgctgagcaacgcgatttcgtcgccatccccgtatgtgaccgctatgcaggagatgccgttggtccgtgcagcttcgatgtcgctgaaggtgtctcccacatagaggcattgtctcggcgcgatgccatgccgtcgaacgatttcggctatcatttcgaccttcgtcgcctcacggccgggtatggaatcggggcagatccaatcgtcgaacaggttcgcccagcctttgctgccgagtatgcgcctcaatgcgccctccggcttgttggtgacgatgatattgcgtacgctatgtcccttcagctcattcagcatgctctgaatgcccggatagagtctggtgcgcgaaaaatcattgagcgtgcggtagtgtacgcgtacatcctcatcaaatgtctccagatacgcctccccgggataggggatcacgtgccgcatgatctcatccatcggatcggccagattggcgtcatcgcgcatgtacaggtcatcgatcgccccgcccgcacgacgcgcggcgtacgtcagggaattccacacgtcgctgccagtgtcggcaagggtgccatcgaaatcccataacaggcatcggtactccattggattgctcctttcgttcattcgcatggcggtggtcgatgattggaagcgagataccgccggccggccagaaggggttggagtcgccggccggcggtggagggggttgttcaggggcaagactcagtcgtagttttcgagggtgctgttcagtaggtcgacgaatccggggaagtcgagttccagcgcggcttccgcattcggctcttcgccgcgatagcccatcgtcggcgtgcgttcaagatccacggcaggcacggtaccgcgcagatgacggtagtcgcacacggtcataccgcgggtaagtgcgccgtgcagctcgatatcgatatgcatcgggaccgcagtgatcagcgacgggtcgataacccatgccaccgcgcatgcgtcgtgcatggtggcgcccgtcagctcggactcctcctcgcatgcgccgatgaagaaatcggtcagatcggcggccaggttcgcggccttggtgccgatctcacggaacttggctgcgtgcttggcggtcagctcgcattgacgggtcaggttgatgccagtcatcttgacgtgcataccggagttgaacacgcgcgatgccgcctcggggtcgacgaagatgttgaattcggcggcaggggtccagttgccgtaggtgacggacccgcccatgatgcacagctccttgacccgttccacgatgcgcggctcacggttgatggcggaggcgatgttggtcagcggaccggtggcgatcagcgtcacgtcatccgtgctcattacggtgtcgacgatgaagtcgaccgcatgcttgttctgtgcggcgtgcgtcggctccggcagcacgggaccgtccagaccagtctcgccgtggaactgcggtgcggtgaccagcggtgcgaccatcgggcagctgtgccccggatatacgccgatgcggtccgccacgccaaggacctcaagcaccttgatggcattgcgggtcacgttctccagtgtgcagttgccgccaatggtcgtgatacccagcacgtcgaggtgctgcacggcgagcatgatgccgaacgcgtcatcgtgtccgggatcgcagtcaaggatgaccttcttcttgttttccatagggatacctccgttggttgtgttctttggattggtcgatattcgggcatggcgttcagccggtttgcccggcgaggaactcgtgcagctgtgcagcgtccggcgaggaacgtgccccgcgacgggccactttgtatgcggagacggcattgccctctcgcaatgattcggcgagggaggctccggcgagtctggcagcgatgaaaccggcgttatagacgtcccccgctccgatggtgtcttcgacgttcacccggaacgccgggctttccgtcaggccgtcttgcgtaagaccgatcgatcctcgggcgccgtcccggacgatgacggtccggccgtccaccgcataggccgtggcgttgcccatcatgtcgtcgtcgcctaaataggcgaactcgtccggccctgatcccagcagataatcgacattcggaataatgcgttcgagtgcagccgcgaaatcggggtcgagcacgccgtcgtccacacgcaggttcaggtcgaaagatgtagggactccggcatcgtgggcctgttcgaagatgcggatgatcgtctccctagcgctggtgtcgtaggtcaggcacatgcccgaggagtggacccaatccgcctcacgaatcatgtgcatcggcacaaggttttcgtcgagcaccttgaacgattgccgttcgcgaggccatccccacaggtacctctctccgcggtcgtccacgaaagcgaatacgccgaccgtgctcagggtcgaatccgcaaccagcccggtcacgtccacgcccgcatccttgaagtcctgcataacgaaacgcccgtactgatcatctcccacggtgcccacgaacgatacatccaggccgagcttcgccaacgccacggccgtgttcgccgaggttcctcctccctcgatgccgatctgcggatattcgacctgcgtgcgctcctcgttgagaaaacgcggatagggcacgatgatatccacattggcatcgccgacgacaacgaccttaggcatctttggccgccttgataaaagcctcgaccttggccgggtccttgcaccgatccgtatcggcgcgatcatcgtcgtaattggtcagggagaacgagtcgacgccatacgggtgcgtggcataaatcgcctcggccacattggaggcgtccagaccgccggcgatgatgcacggcacgtcggtggcctcgatgatggcccggtcgatggcccggtcatgggtcaggccggtcgctccgatgtctccggcagcaggtgctttggtgtcgatgaggaagaagtcggaaaccggctcatagtccttcacatactgcatgaccttctgttcgtcgagaggcactccggctagcaccgggatggcctgcatgatcttcagttcggggaaccggctcttaagttccgccacttcggccggactgatgccttcgatgtcgccggacaggtgcaacacgtcgggcatggcttcgcgcaggttctcgctgatttcgtcgatgtcttcggcgacggtcaggcctatgcgcacggcttgtggttgcacgccttcgaagatttccctggcccgttcgcaatcgagctgaccgggcgtccgcttgattttgccgtaggagacgccgatatgttcgccgcccatgtcgattaccatgcgagcgtcctcgacattccttattccatagatttgagcaatgacatcagccacgatggttcctttcctgagcaatggcgttgatgaacgcggggacggagaataccgtctccttgaggcctgcaccctgagccactcgggtgacgggcggcggcgtcacgaaggaacgccgaagtgtgtcggtctgggcaaacacctcgcgggcctggccatcgagcagcacgcggccgtggtacatcacgatgacacgggagaagttcgcggtgacgaatttcatgtcgtgcgaaatcgtgatgcagagtctgccttgtgctttcagacgttcgatgatgcgtgcaaggcgggcgttgcccgacgcatcctgaccgcacgttggctcgtcgaaaatcaccacggatgggtccatcatgatgacggcaccgattgtgcagaatttcttctcggtgggcgtcaggtcgaatgggtgcacgtcgagctttttggtgaggcctaccagctcggcgatgctgtccacgcgatgcgcgatgccctgatcgctcatgccgatctggcgcggaccgaattcgaattccttgcggacgctttccagaaacagctgatcgtcgggattctgaaagacatagcccacgctgcgagaccattcggcggtgctgcgctcattgacgtcaatgccatcaatcagcactttgcctccggtggggcgcagaatgccgttgaaatgcttgaccagcgtggtcttccctgcaccgttctgccctatgatcgccaccggctcgttgccgtcaagtgtcaagtccactccgtcaagggccttgtcccctccgggataggcgcgctccagtgcctgcaactcgattttcatgagagcgcctccttggccatgcggatggccggctcctcggtaatggcaatcgggccaccgagcgcacgggtgatcttcacgtaatcgggcacttccacgccatgctcttcgatcgccggatcggagaacacctccatcggagagccaagggccacgacttcgcctcgctcgagcaccatgacggtatccgcgtatcgtgccactcgctccatgtcatggtcgaccatgatgacggtgacgccgtccgcattgagctgtttgacgatgtcgaaaatctcctcgctgcccatcgggtcgagctgcgtggtgcactcgtcaagcaccagaatgcgcggttccatgatgaaagtggatccgaaagccacacgctgcacctgtccacccgacagttccagcgggttcttgtctagaatgtggtcgatgcgcatcaatttcgccacagcttcgacgcggtcgatcatctgcgctctgggcacaccgtggttgcctaatccgtaggccagctcttcggcgacggtcccggcggtgtaggacagctggttgaacgggttctgaaacaccaggccgatggtcttcgacagttcggcgatggtcgaatcggcgacatcggtcccgtcaattaggatgtgtccagcccccgcccccacgaaatagtgcgggatcaggccgacgagcgcattgcataacgtggatttgcctgccccattcgcgccgatgatggtgaagaagctgccttcctcgacctggaagtccacgtgtttgacggcccgacgcttggtgtcgcggtacttgaaggagaaatccttgacctctactatcggactcattcacttgcctccccacgagaccggcaacggaatcacaccgatgcggatgcatacggaaacggcgaccacggcgatcagaaacaggacgaagatccaattgagtaccttgtcggcggcattccagctgaccttgacataactggtctgcttcactccagtaatgccgaagccgcgagtctccagggtcataccccgctcctgggcgtcggtcagcgatgacatgacaaccggaccaagcaacgggatatacgccttgatgcgggcgatgaccccacccgatgcatcgagtccgcgagcggattgcgcctcctgaatcaccgccatacgtcgttgcatctgcggcacgacattcaggctggcgagcaccaggtatccgaccttggcgctgagccccaccgaagtgagcgcggataccatagcaccgacataggtggttttgttcatgatgtagaagctgccaagaaacaccagcaggctcaccaccactttggccgcatacagcacgccttcgagccccagttgcgcgaagccaaaatccagtaatgcggtacggttcttgggactgtacagcccttggatgaacatgagcatcacagtgacggggatgccgaaaccgaacattatcttggcgaaatcacgctgtatatgagccaagaacgagaccacaagcagcaacaccacgagtatcagaccaagcgtgaagtcaggccatgccaatgcggacagacccaaggcgaacacggccgctatcttggtgatcggattcagcttcccaattacggtgtcattgatgaccggcatatgcgacgacatgtcttactcgtcttcttcttcgtcatcatcactcagcgcatcattgtccgagccgcccatggagtcggccgcatactggctgagaaagcgacggggaatcttctgcacgatcacccacgcgatggcgacagtgatgcccttgtcgaggaggttctcgatcagcgacgaggagatcaccgaggcgagaatgtctttcatggccacgaccagcgttgccgtcagcaccgatgtaccgttgacgccggtggcaccgccgtatacgaatgtggtgatcagcgatgcggagatcgcattgacgaacgtgcacaccagccagatgaccacgacgccccacttcttgtggaacagtccggccttgaccatatagccgacgaccaaaccgcacaataccgacaccgccgcatagggaagatagaccgggttggctaccagtgccaggaaaagattggtcagcaggccggtcagggccgcgacccatggtccagacaggcatgcgacgacgatggtgccgatcatgtcgaggaacagcggcagcttgagtgcggagcacagagttccgccaatgagattgattccaaccgcgatcggaatcagcaccaggcactttgtggagaattgtgccttgatcccttcccagaacgacagcttccttgccatgctggccctcctttattttccaaccctcggttttccgcagtgtgcaatctacattgtttgtcttgcggaatcttaggaaatcattttcctaaaatgttttcttgagataagattataggacgccaacgtcagtgtcaacacggcgggtcgagggtcaagcaacccggaccgaacggcccacaatggcgacgtagcaaggaacagaacgctacgcccttgtacactgatacagaggaaaacaggcaggaggggagacatgaacatcagggacatcgcacgcatcgcgggcgtctccacctcgacggtctccaaaatcgtcaacggcaaggattccagcatcagcgaggaaacccgcaagaaggtcctgacgatcgtcaaggaatatcattacaagccatatgcctccgcctcacagcgcacgcgtagctacaccatcggagtgctgctgcgctcccccatctccttcgatagcacgctggacggcatcatccaggccgcccagaacgccggatacgcaaccgatgcctacaacagctattccgatccggaacgcgagctcaaaaacatcgcagcgatatgcggccgcaacgtcgacggcgtcatctgggaaccggccactccggacagcctcgcctatgcctcgcaattccccgaaagcaccccactgctgaccataggacccaacggcggcgaccagtcactgctactgccttataaagaagcggcctacaaactgaccagcgagctcatcgaacgggggcaccaacacatcgcctgcctaatgaccaagggacgccgcacgcaggattttctcgaaggctttcgctcctgcctgttcgatcatcagctgccttatagcgacgatctggtctactacgacctcaacgactcgctgcccggcaaaatcggaagccgggacatcaccggatttgtctcctcgcattaccggcgagcactcgagttcacgcagatgatcagccccctgcattaccggcttccagaggatgcttcacttgtctccatcaaaaacgacaccgccgaagcgctggcctatcccggcaacacggaaatatctacctacaccatccgcaactccgacttcggcgcctacctctgcgagaagctcattgcgcagatagagcacgacaaagagcagcatccctcgttcgtacaggattttcatctcgacaacaccagcaccatcgcagccccgcccacttccgccatcaaacatgtgttggtcgtcggcagcatcaatattgaccactatctgtcagtgccgcggctacctcatatcgggggtacggtatccaccaaatcggcggcgcgataccccgggggcaaaggggtcaatcaggcgatcggcgcagccaagctcgggcaccgcgttacccttatcggcaatgtcggcgtcgacaatgggtccgattacatcttcaaggcgatggaacagcatggggtcaatacggccggtgtgcgacgctgcgccggagaggacaccggctcatcgttcatattcctcgcccccaacggcgaatcggtcatcgcgattctctccggagccaacgcgtcgctcaccccggatgacatcacctccaacgaacgcctgttcgacaatgccggatactgcctgatacagaccgaaataccgttggaatcagccaaagtcaccgcgatcaccgcccgacggcaccatgccaaaaccattatcaagccctcgtcatgcgactatctgcccgactccatcgtcgccaatgccgacattctcgtgccgaacgagcacgaactggcgatcatcgaaactgagggaaaaacaatggaggataaggccgcgcatcttctcgaacgcggcgcgggctgcgtcatcgtcacccaaggagaacacggctgctacctgcgcggccagaatgtcgagtgccactatccggccgctgacttcacccccgtagacagcaccggagccggcgacgcgttcatcagcgcgctcgcctcgtatctgatgtacggatacaccgtgcggcaggcggtcgaaatcgccacctatgccgccgggtactcaatcacccgcaaaggcgtcataccctcgcttatcgaccggctctcgctggacgcctacgtccatcacagcgaacagtagcggcacgggtatctgtcttaaggcagtttccaccgcagacaattaaggggaaccgcatctagtctgcggctcccctcagtcagcttcgctgacagctcccctctctgaggggagccaaaaagcactactccagctccaccgcgccggtgtacagctggtagtactcgcccttttgcgcgatcagctcgtcatgcgaaccacgctcgatgatgttgccgtggtcgagcaccatgatcacatcggaattgcgcacggtggacaggcggtgggcgatgacgaagaccgtacggcccttcatcaggttatccataccagcttgcacaacctcttcagtacgcgtatcaatcgaggacgtggcctcgtcaaggatcagcgcaggcggatcggccaccgccgcgcgagcgatggagatcagctggcgctggccctgggacaggccggaaccgtcgccttcgagcaccgtgttgtatcccccgggcagcatgcggatgaagctgtccgcattgaccagacgcgcggcctcgatgcattcctcatcggtggcgttcaggcggccgtaacggatgttgtccatcacggtgccggtgaacaggttcacgtcctgcagcacgatgcccaaagacctgcgcaggtcaggcttcttgatgccggccacggagataccatcatacagaatctggccttcctgaatgtcgtagaaccggttgatgaggttggtcacggtggtcttgccggcaccggtggcgccgacgagcgcgatcttctggccgggcttggcgaaccaggtgatgccgtgcagcaccggcttgtccgggttgtagccgaaggtcacgttggtgaagcgcacgtcgccgcgcagcagggtcagtcggccgtcgggcgaggtgatcgcctgctccttggccttcatcgccacctcgcgggccgagcccttgagcttttctgcggccttcagagacctcgtaccgtcgtcgccgacctcgcgcttccatgcccagtggccggtctcgtggtcgacttcggtcatggtgcggccatcctcgccaagttccacgttcacgagcgtcacggtgcccttgtcttcctcgatgggctcatccatcagcttgaagatacgggaggcaccggcgagcgccatcatcaccatggtcagctgctgagagacctgaccgatcgggttgatgaacgagcgggacagggtcagcagggagacgagcgtgccgagggtgagcggcttgacgccggtcagaccgatgtcgttgacgccggccagcgagacggcggcgccgacgatggcaagcaggatgtagagcaggtagcccatgttgccgacgaccggcatggtgacgttgccccaggtgttcgcttcggcggacgcctcgaagagttcctcgttcttctcgtcgaaggtattctgggtggcgtcttcatggttgaagaccttgatgaccttctggccgttgacggattcctccacgaaggcgttcacgtcgccgatccactgctgctgcttgacaaagtagcggccggagcggctcacgatcttgcgcacgatgaagtagagcagaacggtgaacacgattacgaacgcggtgaacggaatggacagccacagcatggacagcagcgccgcgaccgcggagataatcgaggagaacatctgcgggaacgactgcgagatggcctggcgcagcgtatcggtgtcgttcgtgtagtggctcatgatgtcgccgtgctcgtggctgtcgaagtagcggatcggcagcttctgctggtgggcgaacatgtcgtcacgaatcttcttgagcgtgccctgctcgacggtgacgatcagccactgccacagccaggacgccacgatgccggccacatacaggcccgccatcaggctgatggcccgcagcagcggggcccagtcggggttcgactcccccaccatcggcagaatatacgtatcaatcaacgactggaggaacagcgcggaaccggcctgcgcggcggcaccgaccaagatgcacaccacgatggcgatgacgcgccacttgtactggaagatgtagctgaagatgcgcttgatggtgccaggctcggctttgcccatggcgggcttgcggttcttgaaactctggtcgttgctcatcgtgcttctccttccttggtatcggctgcattggcatcagctgcgctggtatcggccgtgggcatggtcactgtcaccgtcacggtttcggacggctcagcggtagatgactcagcagcctgttcggcagcggccagttcttcgggctgggcctggttcttggtctgggattcgtagatggaacggtattcatcgcaggtggcgagcagttcgtcgtgtgtgccggacgccatgatgcggccggaatccatcaccagaatcatgtcggattcctgcacggaggccacgcgctgggcgatgatgatcttcgtggtgtccggaatctcgttgtggaacgcggaacggatcagcttgtccgtcttggtatcgacggcgctggtcgaatcgtcgagaatcagaatcttcggcttcttcagcagcgcacgggcgatgcacaggcgctggcgctgtccgccggacacattggtaccgccctgctcgatgtacgtgtcgtacttatcggggaattcctgaacgaatccatcggcctgcgcgagctgcgcagcatggcgaatctcttcatcggtggcgttcgggttgccccacctgaggttttcggcaatagtgccggagaacagcacgttcttctgcaacaccatggccacctgatcgcgcagcgcctcgagatcgtagtcgcgtacatccacgccgccgaccttcagcgaaccggagctcacgtcgtacagtcgcggcacgagctgtaccagagacgactttgccgaaccagtaccgccgacaatgccgacggtcatgccggagcggatcttcaggttgatgtcgtcaagcacgggcttttcggaactgtcggagtagcggaaggtgacatggtcgaattcgatggagccgtcggccatgtcagtcaccggctgtgccgggttctgcaccgtgctttcctcctgcagcacctggcagatacgctcggcagaagcctgagaaataatcaccatgacgaagatcatggacagcatcatcatggccataaggatctgcatggcgtaggtgaccagtgcggtcaggtcgccggtggtcaggcccacggcggggttgttgccggaggcgacgatctgctgcgcgcccatccatgcgatgaggatcatcgaaccgtagatgcagatcatcatcagcgggctgttgaagctcatgatgcgctcagccttggtgaagtccttgaagatgcgctgggagatgcggccgaacttggagacctcgaaggattcgcggttataggacttgaccacgcggatgccctgcaggttctcgtcgaccacgttgttcaacgcatcgtaggtgtgaaacacgcgctcgaacaccggatgcacgagcacggccagaccgcacaggccgatggccagaatcgggatgcaggccaggaacaccatggaaatcgacggggagatacggaacgagaacagccaggatacgaccaccataatcggggcacgcacgcccagacgaatgatcatcatgtaggcgttctgcaggttcgtcacgtcggtggtcagtcgggtcacgatcgaaccggtggagaaccggtcaatattggtgaagctgaagccctgcaccttctcgaactggtccttgcgcaggttcttggcgaagcccgcgccggccacggccgcgtactttccggacaggaagccggcacccagcgaaaccatcgagcacaccagcagaatcacgccgaacttgacggtggccggcatgctgccaccggtgataccctcatcgatcagcgaagccatgatggtcgggatcaggatctccaggatgccttcgaccgtcacgaacaccggagccaggatgctggctttcttgtattcacgaatcgactggcccaacgtgcgcagtacatgtttgggcttgtccggttcgacggctttgcgcgcctgcgcgattgcctctgcggtatcgctcattcgttctcctccttcgtgttagcaacctctgctccgtcttgatcgggagccatcaccacaggtgactgagggagtgtttgatgttcaaattcgcgttgtgcgcgctcgatgttcgcacgcatgcgtgcgacgtagtcgcgcagagcggccttctctccatcggagaagccgccgaccagcaaccgttcgacccgatcgccgttcgccttgagatcggcgacgatcgcgtccgccttgtcggtcaggacgatgcgcttgcagcgcgcgtcatgctccaccgattcacgggcgatcaggcccttcttctccatcagggccagcacacgcgaggcggtggaccgggtgatgcagaatttctgttcgatggtgtgctggtatatctcacggccgcggttacgcgccaagaacatgatgatatgcgcgttgccgccggtggtttccctggcggtttgcggcatgctctcgcccaaatagcggtcgacggctttggttaccgcgcgcatttcgatgctgagaatatgctgatccattgtcctccgtaccatgcgggggccgtgtgcgtttgtaccttcaccccacattgttgtatacgcaacaattcatgataaagagacctatatacaacagttgcacatacaacaatcggcgtgttgtagtatctccaaacaactgttgagcctaaacaaagctggctcccctcaggagagggaagccagctgtattacgccgtgcgattgcctcgcttcagcccttacttcgcgagcttggcgtactcgtcaaccatgaactgggcgatcttcttgccgccttcgcccagcagggtgggcagcgagttgatcggcatggggttgaggaacatgcgcatcatggcgttgtcgggcagcttcgtcagctcgccggcctcgccggcggcggccacggcggccacgatcttggcgccgaacggatcggcctcccactcgccgtaggtggaccattcggtgagcggctgggtcttgccgtcgccatcgagggccacggcaacggtgtcggcaatgtcgcgggagctcacgcccacttcgatggcatattcgccggcctccacgtgccagtcgttgtatttttcggaccagtaggcgaacgcgcgctcgtcgaggtcgatggtcacggtcttggattcgccggccttgaggaacaccttggtgaagcccttgagctcgtgcttcgggcgggccacgtcggccttgcccggagccacgtacacctgcacggtttcggcggcatccacatcggaggtgttggtcacggtggcggtcacggtggcggtgttcgcgccggtcttggcggcggcgacgtcatcgatctcgaatgtggcgtagctcaggccgtagccgaacgggtagtccacaaccttgccgtaggtgtcgtagtagcgatagccgacgaacacgccctcgccgtagtcgacgtggccttcctcgcccggccagttcagcgtgctcgggtcatcgctgatgtccagcggaatcgactgggcgagcttgccggacgggctgacctggccgaagatcacatcggcgagcgcagggccgccggcctggccgagcagacaggattcgagaatgcccttggcgttcttggcccacggggccacggagacgacggagccgttggacagcacgaccacgacgttctggttcgcggcggcgacctgttcgagcagggcgatctgcttggcgggcatgtcgagggtttcgcgatcgaagccctcgattcaaagcatccggcgcacgactatttcgcggaccgcgagcgccgcagcgtgacgaacgcgctcaacatcaactggtcagtacccgacggcgcgaacgtggagcacgtgcttcaggcgggcctgtcgatgatggacggcattcagctgcgctggctgcgctctcccggtcgcgatctcaacgccatgtgggtcgactgcgaggatgtgctgttcccctcccccttatgggacggataccgctgacccttccgtaaatcgcgcgtctcgcacatcacctccgccaccgcgtcatcaatcaccgtcatcccgaaccatcaccccatccatcccgcatgccagacatgccgcagatcccaagggtcgaggcgcgtgtcgtccatcacggcggcgtccccgtcacccataccgggcgcgggaggcgcgagacggtcaaactcgccgcgaccgccgcgcagtcgatagctccagtagacctgaccggcggagacgttccacgcgtcgagctgcatggcggcgacgcggaggtagacggcgcggcggcgcgcggcgggcgacgggacgccgtccccggcgtcgcccgcgcgcgaaccgacgtcaccggatgcgccgtctccaacatccgcaccgccgtcaccgaacgcaccatatccgtcgaacgcaccaccagacgcatcaacggacgcgacctcaccttgcgccccgcactcccccatgcgcgccgcaagcccgttcgccacgcaccactcccccaccatgaccggcgtaaagcgcgcggcacggcggatgcggcgcgcgccccacgccgcgaacagccggtaccagcgcataagccatgcgtccggcagtatgcggaacagcacctcgggccgttccgacatgacgagatacgcgtgcgtgtcgatgatgacgccgcgcatgccctcacgtacgaaccagccgcgccagcggttcaggcggaatccgtcatggaacacgatgaccggcccgtcgcccagcaccgggcgcagccatcggtatgccgcccgatagaaccgtttgaggaagcgcatcggaacgtggccgctcccccgcgcctcccccggatccttcgcccgggagctcgacggcgacatgagataagtgagacggtcgaccggctcgttgagcacttcgatgccgtacaacgcagggcggtcgcggtaacgtcgcgcgagacgctcgagcacgtccagtgcgaacgcaacctgccgcggcgtcgtatgccagcggaccacgccggtcaggccgccattgtcgaacccgttctgcgacccgggcacggtgtgcaggtcgatgagcaccttaagcccggccctctccgcccagtcgaacgcacggtcgaggtattcgacgcatccgggatgcccgggcacgtcaccgaagatgaaaaacggcacggggatgcgcacaaggttcagcccgtgcgcggagatggcgcggaagtcgtcctcggtgatgtacgtgtcgcggtgacggcgcagcaggcgctccagttcggccgggtccgtggaccggtgcagccagatctcgtcctcctcgccgctcgcacggaacaggccgggcgtcatccaccgttccaataccagccagccgccgaggttcactccgttgattcgcccatcgtcttccggcatggccctctcatcagtattccgcatcattgctccgttccgcacaaacgacaccgcccgctccagcatacgaccggagcgggcggaaacatatgaggcccacacgaaaccgattcacacgggaccggctcacgcgagagcatctcacgcagagcagattcacgcgacggtgaaggtggtgcgcttgaggtcgtcgcggcgcgacgagtggccgatgagcagctcgaactcgccgggttcgacgatgcggttcgcatcggcgtcggcgatggtgcagtcgcagaccggaatgtcgaacacgacggtcgcggtctcgcccggttcgagcgtgacgcggcggaacgccttgagttcgcggtcggcccagctgtatgaggtgacgacgtcgcccacgtacgcctgcacgacctcggtgcccgcgcggcgccccgtgttggtgagggcgatctcggcgtgcacggtgtcggtctgcgcgaacgtgccgtccgcgttcgaggccccgccgacgatcgtcggctcaccgtacgcgaacgtcgtgtagccttcgccctcgccgaacgcgaacgccgggtcctgcgtaaggtcggcgtagcggttgccgtgctggccgcggatctggttgtagtagaccggcagctggcccgcgtggcacgggaaggtgatcgggagcctgccggacgggttcacctcgccgaggatgatctcggcgatggcctgtccgccctccatgcccgggttcggcgcccacaggatggatccggcgccggacttcggatcgttgcaacggccggcgagcacgccggaatcgcccacgatggaacgcggcagcacctgtggcttggagctcaccagcacggtgaccatcggcttgccggtctcgcgggagacgtcggcgagtgcgtcgagcagcgcgttctggccgccgagcagttcaagcgtggcggtggaacaggtctcgccgaccagctgcaccacatcgcccacgacggcgacgatgaggtcggcctcgcgcgcggcggcgacggcctcgtcgagcagggcccggtcaacgggcgcgctcactccgatcttcgggcgcggctggccgtccgggtagaactcaccctccgggtcgggcacgaggtcgatgacgttggcaccgcgggcgtaggtaacctcgcatccgtcgccggcgagcgcacggaagccgtcgagcacggtggtgatcatgccgcgcggatgaccgtcgggcatccagccgacttggccggagctgccggcccagtcgccgagctggttctgggcgtcgtcggcgagcgggccgaccacggcgatgcgcttgcgcgcgggcgcgtcaccggagccggggatcgcttcggccggcgccgcgtcgaacggcagtccgccgtcgttgcgcagcagggcaacggcctcgcgagcgagctcgaggttcacgcggcggtgatcctcggagccgatgacggccttgatgcgcttctcgtccggcagacgcgggtcctcgaacaggccgaggcggaacttgagcgcaaggatgcgcgcgacagcctcgtcgatgagcgactcgtcgagcagaccggtgtgcacggcctcgatggcgccgtcgtagaaccccggcgtggtcatgaccagatcgttgccggccttgaccgcgtcggcggcggcgtgcacgtagtcgggcttgaccttctgctcccatacggaacggcccacgttgtcccagtcggtgatgagggtgccgttgtacttccatgcgccgcgcagcttgtcggtgagcagccacttgttgaacgtgaccggtacgccttcgatggactcgtagccgagcatgaacgtgccgcagccctccttggcgatgcgttcgaacggcggcaggaaccaggattcaagcttgcggtggctcaggtccgcttcggaggcgtcacggccgccctgggtctcggagtatccggcgaagtgcttggcgcaggcgaggatcgcgtccttcggcagcgtctcgccggcctgggcaccgccctgatagcccttgaccatggcggaggccatctcaccgatgagcatggggtcctcgccgaaggtctcgtccacgcgaccccagcgggtgtcgcgcgcgatgcacagcaccggggagaacgtccagtgcacgccggtcgaggagacttcttcggcggtggcacggccggccgcttcgacggccttcgggtcccagctcaacgccatgccgagctgggaggggaagatcgtggcgccgggccagaaggagtagccgtggatgcagtcgtcgccgatgacgagtgggatgccgagacgggtcttggtgttcacggtttcgacggcgcgcggcaggtcctcggggctggtgtgcaggatggagccgacgtgcttgttcacgatgagctcgtcgaggtcgccaccgcgggcgtcgagctgcatcatctggccgaccttctcttcgagggtcatgcgggagagcaggtcggcgatgcgctcggaggcgggcaggtcggggttcttgtagggcagcgtttcgactgtggtttccggtgtggtcgcggtcatggttgtgttcgcctttctgggttccgtgcggtcactcgatgacgaaggtgttgaaggagcgcggggcgagcgtggccttgaagccacgggaggcgtcggccgggtcggcgaactcgaacgggcgttcgtcctccagcgcgttctgggtcacgaccacgatggtgccgtccgggttgcggaaggcgatggccatggagttgaagtggctggtggtgccgagcaccttcgcgccggggcgcacgtacttggagaagtggcgcatcacgtagtattcggggttgtggcgcacctcgtgcgtgtcggcggtgatggtgaacagggagttctggcgcgaccccggccagccgaccaccgaccggggttttcgtaatcctagaccaaacacacccggcacctggcaggccgcggccggtacgacaagggccagaacgcccgccaggacgctccggcccgaatcacggccggcatggaacccggtcagcgctggaacacgtcggggtgcttcggatctccgggaatatcgtcgagcaggccctcgaggccgaggaactcacgccagaagtcgagcggctggccatacgggttggattcgcggccgtgcgcctggatgttcgccttggcttcgaacacgtcttcctcggtgagcccgtcgaagtagctttcgagacggatgcggttggacggcacgtagtacagggacgcgatgatctcggtgagccgttcgacgcgttcgatcggcagcgaatcccagtggcggaactcgatgaagttcttgagacgcacgtcgttgaaatgcgtggagatgatgtggttgatttcgtacgcgttgagctcgcggtccgggtagacctcgccagcgttctcacggaaggcggcgcgatgcagctccttgcggctcagccccgattccaccgcttcgggcgtgtgcgtcaggtcggcgaacatcagcggcgtggacagcacgtcacgcgcgtagtcctcccagccgaaacgctggtcgaacaggccgggggtcacgttggtgcgctggaagtcgaggtagtcccacatgcgctggcgcagcagcggatacgggttgagacggccctcgaagtagggggtgttgcggaagaaccatgcgagaatcggcccgatggcggtgccgacgcgcatcttatcgatcgaatccttctcgtcgacatagtcgatgctcacctgggtggaggcggagcagcgcatcatgcacggaccgaactggccgacgcggccaaggaagtcggtcatcgcgtcatagcggcctttcggattgaccggcacgtcgacgaaactcgacttcggctggtatccgtagttgacgaaacggaagcccagctcctcgaggatcgggtccgcctcacaccggaagtcggcgtacaggccgttgaggtcgcccggctcatgaagcacgccgatggaagcctccacctggccgcccggttcgagcgacaccgcaacgccttcgcgcgcgagtccgaccagatggccgttctcccagtattccttgctttcgtcataatacggagcgagccgtttgaggaacgcttcgatgccgttcggctcgtagtagcttacggccgtgtcgtcggcgtcatgcaccggcagatgctcaatctcgacacctaaaccaccggtgccgcgcttggagcgccccgcctcgaagaacttcagaaggctctcgacatgcttcgggttcggctcggcgagcaggtgcgcatagctgattctgggagtgaccatgaacggtatcgtaggcgagtcgcgcgacgcgcgtcgccgcgcgcccgcgaatcggctatatctttttccgataaccggcacgtcgccggacatccgccatatcacgccgcaacgccgcaccgcgccgtcgcaccacaccgcgccgccacgcccccatcaccgcacgccacgcctccgcaacgccgcgccacaccgtacggctttgccgttatgcgcgatgtcggatacactcattgatttgtaaaccttgtttacaaaaacgtccggcagagaggccggaccacaccatcaacccaccatcaacccacggcgaacagccggaataaaagaaaaacaacagaaaacaacagaacacggaaaacagcaacaacccatacaaaacaccggcaaccataagcacgtcggaagcacaccggaacgcacaccgaagcgcaccggcgaccgctccggttccacaccgaaaccacgccgaaggccataccggaaacggaccgaggacatatcggacacgcccggcaccccaccggcacgccggtgcgccacaatcgaaaggaaggaaagcggcatgacatcccgtcagggcagacaagccatagccgcgacggccgcaatgggcgtggccgtcgcgctggcgttgccgaccgctgcgttcgcgcagtcagcaacgcaaggaaaggagaccgctacgaccacgtcatcaggcaccacctactacgtgtcgtcggcacacggcgacgacgccaacgcgggcaccagcgaaaacgcgccctggaagtccctgaccaaggtcaacgacatcgcctcggacctcggtccgggcgattcggtgctgctggaatacggctccgaattcaacgaccagtacctgcacatcaaggacaccgccggcaacgccgacgcgccgatcacgatctccgcctacggcgacgccgacgaaggcaagccggtcatcgcgtcgaacggcgtcaaaggcagccagtgggagcaggactaccgtgccaacgtcggcaaccacaagaacaagggcaccgtctcaaccacgctgctactcaaggacgtgtcgtacatcaccgtctccaacctggagatcaccaacgacgacgcggacgtctacgatccgatcgacacgtggaagtggaccgacacccctgattccgacggcacaaaactcgaccgcagcgcctcgcgcatggaccgcaccggcgtggccggcatcgccgagaacggcgcgacgatgagcaacgtgacgctcgacaacctttacatccacgacgtggacggcaacatctacaacaagcacatggccaacggcggcatctacttcatggcccactaccccatggagaacacgagcgccgaaaccgacgtctggctcagggagcacgtctcacgcttcgaccacgtcaccatcagaaacagcaccgtcaaggacgtggatcgttggggcatcgccgtcggctacaccgcctacctcaactacatcgacgcgaactacggcgacggctccatcgacgacgccctcatcgcgaagtacggttccaccaacgtgcgcatcgagaacaactacgtcaagggcgccggcggcgacgccatcaccctgatgtactgcgaccgcccggtcatcgaacacaatgtgggcgacagcgtctcgaagcacatcaacacgcaggactacacgcagcccggctcctacggcggacgcgtggcggccggcatctggccgtggcgttgcaaggatccagtgttccagtacaacgagatgtacaacaacctcaacgccgagcacggcaacggcgacggccaggcgtgggacgccgactacggcgacggcacgctgtaccagtacaactactcgtacggcaacagcttcgcctcgctgatgatctgcaactggtacgcggttaacaccacgttccgatacaatatctcgcagaacgaccgtcagggcgtgttcgacctgccgtcgaacggccccggcaaccacatctacaacaacaccgtctacgtggacgccgacagccaggtgctgactaagcgttccaactcgcagtccctgttcgagaacaacatcttcatcaacgcgaccaacacgaagaagacggagacctggaaccgcggcagccagaacggcggccagacgtacgacaacaacatgtacgtcaactacgcgaacaagcccacctccgacgccaacgccatcgaggccgacgacgtgtccgcagtgcttgcgggcgccggttcggctccgacatccgccctcaagagcggcgccgagcatgcgcgcaccggcgagaaagccgcgttcgacggctaccgtccggtcgcgggctcgaaggcgatcaacgccggcaaggtcgtctccgacctcaacgactacgcggtggagaacgacttcctcggcaacgcagtcaagggcaggcccgatctgggcgccgtggaaagcgacgtggtgtccgtcacgatggcctcctccaagtacgagaccggaaccgaaaccgattccgggaccggtgacaagaccaaggtcatccacgtgaccttcaccgacaagaacccggtgaccgtcaaggaactgctctccaacgtgtccgccgacaagggcgtggacaaggccgtgtaccgagtcgccgacgccaagtccggcaagtccgccgacgccaggtccgccgagtccgaaccgaacatgctcgaccgcctgctctccctgctcccaggctccgaccggaacgccaaggacgacgagacgaagctcgccgactccgaaccggtccgcgatggcgacatcctgcgcttctccgccgaaggcacggacgagaccgacgagtacacgatccgccagcgcatcacgtgggattgggtcgcggactacgagcaaggcgtcgccgacttcgactggaaggcgcagcgccgcacgtccgccggcggcgagtggaccaccatctccgcatacgacggctcgtggccgaacaccgtgtacgaccagtactacggtgtcggcgtcaacggcaccctcgccgaactctccggcgaccgcaagcagacgcacggcctgctgatcgacaagcccggcgacggcctgcccacggccatggcgtggaaggcgccggagtccggcaccgtcatgctgtcgctcaagacgttcgccgacaagatcgctgaaccgtacctgcgtcagaacgcggacaacgccggcaagaaggtcacattgtcgctgatgcgcaacgacgagacgctctgttcggccgacgacctgtccgtctatcagaagtcctccgaacagttcgcgcagtgcctcgccgagcacggttcgatcgacgtgcaggaaggcgactggatccgcatcgtcgccgacgccgagaccggagtcaaggcgccgtcgctgcacatcagcccggtcatcacatatgaggacaaggcgcccgccgcgccgaagcagaacgtgcgctacgacgtctcgtacgccgcgacggacgccgtcgtcggcacgcagtcggccgtcgccgccgcgttcaccgcggacggcggcgaggccgacgcgccggacggcgtcgcgttcgccttcaaggacggcggcgatgagggcgaggcctcgcccgtcatcgacgcgtccaccggcgccgtcaccttcacgcccgccgccggacagtacggcgcgaccgtcacccgcaccgtcgtcgtcacgtacgcggacggttcgagcgacgagacgaccgtcacgttccgtgtcgcgcaatcgcacgcgcagcgtctcaacgtgctgtacccgaccgtgcgcggcgacgccggcacggacctgaagcgcacgccgaagttcacgctgaaggcggacggcgcggccgcgtctgtgccggaaggcacgacgttcgcgctcggcgcgaacgcgccggccggcgcgagtgtcgacatggcgaacggcacggtcacgctgaacagcagggtcggcggcaccgtcaccgtgcccgtcacggtgacgttcgccgacgacggcgccagcgtctcctccaccgcccgcttcgaggtgaccgcgcccgccgcgctcggctcgtccgagttggagaccgcgactgtcgacggtgtgaacgtcgtctacgcgccgttctccgccgacagtccgatgaccgtcgcgcagctgctcgccaaggtgacggccgaaccgtccggcgccgataagggcgtgtaccgtgacggcgtgcggttggaggccggcgcagaactcgccgagaacgacgtgctccgcttctccgcgaaaggttccaccgtgtccgacgactacgtggtgaagtcgaagaccacgtgggattgggtgaacgacttccaggtgcgcgtgcagggtccgatctggtacgggcagcgtcagaccgaggccgacggcgtgtggtcggatatcgccgacttcgacgcgacgtatccgaactggatgtacgagacctactacggtccgggcgtggactacgcgaaccacagcctgcccaccgaccgctccgccatccatggcctgatcagcgattcgcccgcgtccgctggtggctccgccatggcgtggaaggcgccgaaggccggcacggtgaaggtgtccatccgcgaggacgagccgtacctgcgccaggacggcagcaacggcaaggcgttgacgcttcgtctcatgcacgacgacaaggtggtgtgcttcgccgacctgaccgtctccaagcagcgttccgaggagttcgccaactgcgtcgccgacaagggcgagatcgcggtcgaggcgggcgattggatccgcgtcaccgcgacgtccgcgtccggcatgaacaagccgtccgcgcacatctccccggtcatcgcctacatggccgcctccacgccgggccccgaacccgttccggtggacaagtccacgctgaaggccacggtcgaggaggctctgggattggccgagtcggactacacggatgagtcgtgggccgcgctcgtcgccgcgcgcgacgccgcgcagaccgtgctggacgacgatgccgccaccgccgaacaggtcgagaccgcgcagaacgcactgcgtgacgccatcgacggattggagaagaagccggtcgatccggacccgaacccgaaaccggatccgaaccccgatcccgatccgacgcccgacccggaccccgaccccggccccgacaccaagccgggtgacggttccggcaacggttccggcacgggcaacggttccggcacgggcaacggttccggttccggcaacggttccaccggttccggcagcgacggcgcgaccaccggcggcaagctgaccgccaccggcgccgacgtggccggcgcggccgcgatggtcgcgctgaccgcggccgccggcatcggactggccgccgcggcccgtcgccgcaggtgaccgatgccacgtaggcaccggttcgccgccgccatcgccgcagtcgcggtggcggcggtcctgctcgtcacattgaccgtcgccgtcgtcacgcacggcgacggcgccttcgcgcccgcaggcacgcctgcgggcgcgggcgcatccgccggcatcggctccgataccggctccaatgcaagcgaggattccgacatgttccccaccatcgtcttcggcgacaccgtcatcgaacgcaaggagtacgtcgcggcgctcaaggcgcaacacggcgcggcgcggctgtactttcggcagacgtacggcgtcgacccggccgaggacggctgggataaggcgcacgacggcgaggtcccgtgccgttggctcgcgagccgtgccatcgacgaactgcgacgtcggcacgccgcgtacctcatcggcgtggatctcgggcaggtggccgacgactcctatgcgagcatcgtcgcgcgcatggaggccgtgaacagcggcaacgcggaactgaaatcggacggcggcatcgtctacggccgtaccggcttcgacatcgacagctacctgagctacgaactgtccgcgttgaagaacgcctatacgggcgacgagtcgaaccccggcatgagcctgtccgacgacgaggtgcgacgctactacgacgagcacgactggacaaaggacggcgtcgacgggaaggctccgctggacgaggtgcgcggcaacgtgaaggcgcagatgcggtcggaacgttacgacgagctcgtgagccagcgcgccgaagcgatcgacgtgaccgacctgccatgggacgcgctgtaccggttcacggcaggcaggctcgggtaggacgggtgtgaccggtgccggccgaaaagcaccagaacgaataaggcgggtgtcccgttccatacggaatgggacacccgccttgtcgtaggccgcagaccggtttgcccggtctgcgccggtctggtgccgaccgggcgtcggttggacgtcggtttgaggtcagtcggcggcagtgaagccctgcggctcgtcgccgtcggcgaacttcgccttgtgcgccttcttcgcggccgcgatcatcagcttgatgcggttgagctggttcgcctcggaggcgcccggatcgtagtcgatggacacgatgttggcctccgggtgcaggcggcggatcttgccgaacatgccgcggccggtcacatggttcggcaggcaggcgaacggctgcgcgcagatcacgttcgggcatccctgttcgataagctcgaggatctcggcggtgagcagccagccttcgccggcctgcacgccgatcgacgtgacctcggcagccttctcgacgagttcgggcatcggatcgtcttgcttgaacttgccgtgagaggtggcgatggccgccttgatcggcgcgttgtagcggtcgaggctccaacgcatgagcgcgtacaacgtcttgttgccgccggtgccgagatacttctcgttccagtcggtgatgtacgggcgcgtggtcatgaactccatgatgccgggcaccacggcctcgcaatcctgcgattcgatgacgtcgacgacatggttgttcgcatccggctggtatttgacgaggatctcgccgaccacgccgacgcgcaccttgcgcggcacgtccttcaacggcagagcgtcgaagctcttcacgatctctcgggcgagcacggggtacggcaggtagcggcgcttgagccacggggtcttcgcggccgtcttcgagaagccgtggtgttcgagcgcctcgcgcacgatcacgtcccactgctcgtacaggcggttcgccgcgcccttctccacctcgtacgggcgcacgcggtacaggcacttcatgagcaggtcgccgaggatcagcgccttgacggtgcggtgcagcagcgcgggcgtcaccttgaagcccggattgtcctccaggccctgcgtggagatcgcgatgaccgggatctgcgggtaacccgcgtcgatcagggccttgcggatcaggccgaagtagttggtggctcggcacatgccgccggtctgcgtaatcgcgagacacaccttgtctggatcgtatttgccttcgagaatcgcgtcgatgagctgtccgatgaccatgatggccggatagcaggcgtcgttgttcacgtatttgaggccagtctccacgtcttcgcgcgaggcgtgcttgaggatgtcgaacttgtagccgccggagcggatcaccgattcgacgagggagaagtggatcgggctcatctgcggggcgacgatcgtgtagtccttcttcatgtccttgacgaacttctcacggtgcgcgtaacgggacatgatcgcgttgttgtggccggacttcgacttcgcggacttcgacttggcgttcgcggcatcgttcgtggtgccgtcgccgagcgcggcgagacgcacatcggcgatgtcgcgcttcgcggcgcgcttggacgcgtcgcgcatcgccttggtgagcttcgggttcgcggccatcgtcgcgtcgagcaggacctgacggcccggcgtgggcgccttggagccggtcttgcggaatccggtggacttcggcgcgttcgcgggggcggcggcgtcgctgccggcatcggccgcgtccacgggcctgtcggcggccttaaccttcgcttcggcggcggcgacggcggcctgcgcttcggcgagcgcggcctgcgcggtggcgagatcggattcggcctgctcctgcgccttgcgggcggcggcctgcgcggcggcgtgagccgcgttgcgcggggcgtcggactcggcggaaccggactcgtcggacgtggcgagcgcggccttggccatgcgcgccttgttcgcctcgcgttcctcgacggcggccttgagcgagcgcaggcggatcttcgccgcgccgaggttggagacctcgtcgatcttgagcagcgtgtacacgtcggccttgtcggcgaggatctcggccacctggtcggtggtgatggcgtcgaggccgcagccgaacgagttgagctgcacgagttcgaggcccggataggaggcgacgaagtgcgcggccgcgtagaggcgcgaatggtaggcccactggttggtgacgcgcaacggcatgcggttgacggtgaccttgcggtcgtcgacgtggcggaatccgttcgcgttcttcttgcgcgggtcctcttcgccttcggacaggaagtcggtcaggtcgagcttctcccccggctgcagttcgcagatcgaatcctcggagaggacgaccatgccgagcgcgcagatggtttcggggatgccgtggttgatttccgggtcgatgtggtaggggcgtccggcaagcacgatgccgcggcagtcgtgctccttcatgtaggcgagggctttgaggccttcctgctggacgtcgtgtttgaagaccttgtcttcggcgtaggcggccttgacagcagtttcggcctcttcgcggctgacgctcgcccatgcgaactcctcgacgatacggtcgaccatgagctcgtggttggcgaggttgaagtacgggtgcatgtagcgcacgtcggggtcacgcagttcgggcatgttcgcgccgacgacgagcggatagttggcgacgaccgggcagttgtagtggttgtccgtgttgggcacgaggttgtcctcgtaactgacgcacgggtagaagatcgtcttcatgcccttgttgagaagccatttgatgtggccgtgcacgagcttggccgggtagcagatgttctcggaggcgatcgattcgatgccggtttcgaacagttcgtggctggaacggccggagatcatcaccttgaagcccagcgaggtgagcagcgtgaaccagaacgggtagttctcgtacatgttgagggcgcgcgggatgccgatttcgcctcgggtggcgttcttgtcggtgaggcggcggtaggcgaagcaacgcttgtacttgtagtcgtacaggttcggacggtcggagcgtttcttcttggcgtcgccgccgcgttcgcagcggttgccggtcacgaagcgcgagccgtcggagaacgtggtgatggtgagcttgcagtggttctggcacagcttgcacacgtcgcgttcggtggtcatcgacatttcgttgagggcttcgccggtgaggattgacgagacggtgtggcgcacgccgtcgacgacgatttcgccggcgtgcgcggcggcgttcggctcgtcgccggcggcggactcctcagccgccgccgcgtcgacggaacgcccgtccgcgccgacgtgcgcgttgtcgtcgtccgcgatgtcctcgtagtgcatgcgggcggtgagggccgcgccgaacgcgcccatgaggccggcgatgttcggtcgggtgacttcgcgttcggtgagcagttcgaacgcgcgcagcacggcgtcgttgaggaacgtaccgccctggaccaccacagtgtcgccgagttcgccggaatcgcgcagcttgatgaccttgtacagggcgttgcgcaccacggagtagcacaggccggcagcgatgtcctcgatggaggcgccttccttctgcgcctgcttgaccgaggagttcatgaacacggtgcaacgcgaaccgaggtccaccggatgggtggaagccagagccttttgcgtgaattcctgaatcgtcaggcccatggacatggcgaaggtctgcaggaacgaaccacagccggacgagcaggcctcgttgacggcgattgaatcgataacgccatcggtgatggccaagtacttcatatcctggccgccgatgtcgatgacggcggtgacgccggggctgaccatttcggcgccacgatagtgggccatggtctccaccacgccctcgtccaagtgcaggccggtggtgatgaggccttcgccgtatccggtggcgcaggagcgtgcgatccacgcgccttcgggcagctcagactgaatcttcttgacgatgttgatggcggcggtcagcgggctgccttcgttgttggcgtagctggaccagacgatttcacggtcgtcgttgacgagcgtggccttgatggtggtggaaccggcgtcgatgcccaggaagtgcgggccatgcgcgccttcgagggtgccgatgtggatgtgttccttgtggtggcgcttgttgaagtcctcgcggtcggcctcggtggggaacagcggcggcatggtgggcgtgttggagggcaggttcttcagctcgtccaaacgcttcaggatttcgtcgcaggtgtaggcctcgaaatggtggccctgatcgtcggaatccgtgtcggcctgcaatgccgaaccgtaggccacatacaggtgggcgtcggtcggcacgatgaactcgtcgaccttgccctcaagcgcgcgctggaatgcggcgcgcagctcggacatgaagaacaacgggccgccgaggaagatgacggtgccgtgaatcgggcgtccggaagccaggccggcgatggtctgcgtggccactgcggtgaagatggaggcggccaaatcgggcttggcggcaccatcattgatgagcggctgcaaatcggttttggcgaacacaccacaacgcgaggcgattggatacaggttctcgtagctcttggccatctcgttgaggccggcggcgtcgatgtcgagcagcgtggacatctggtcaatgaacgcgccggtaccacctgcgcacgaaccgttcatgcgttgttcgggcgtgggtttcaggtaggtgattttggcgtcctcgccgccgagctcgatgatgacatcggcctgcgggtattccttgtcgattgcctcggtttcggcgatgacctcctgaatgaaaggcacatgcagattgtcagcaagcgccagaccgccggaaccggtgatagacaggcgaatcggttcgtcgccgcgtccgaggtccacaagcttcttgtggatgtcgaccaacaggccggccacggtggcacgcacgttggcgtggtggcgtcggtaatcggagaagagggtgtctcccagggaatcggactgatcaagcaccacggccttgacggtggtggaaccgatgtccaatcccacacgcaggggcttcgggtgtgaagcgggctttacgctcgcgtcagtggcgatgtcaaccatgtgttcctcttaattccgacttccgggagtgcacgctttgaggcatcatgaaccgtttcgggacggctggcagataccctgcggacggcttcgcccggctacttcttatggaatattagtccgaccacctgcccaacatggcacgaggcgaggcgatttcgctcacgggaaggccttttcccaacagttccaacgatattgctgagtgcggcattccagaactgctactacgaggcctgttggccttcgccggcttcgcggtctttcaaatagatttcggggatatctcgttcttgatcgtggagcttggcccagatgaccggttcgccggcttccagagacttgggcacatcgaggatgcgctggtttctggagccgcggaattgcagcagcgagtccttctggtctctgaggtagcggccgtcgacgagaatgtcgatgagatgtagcaattcaagcttgtctggggtttctccggggcgcatgagttcttcccatgtgtagccggtccacgaccagatatctttggtatgaccgaattcctggcggatacgttgtgcgagcggcaccagcacgggagtgttgaggaatggctcgccgccaaggaacgtaatgccttgcacccatggggctttcagatcttcgatgattttgtcttcaagtttttgcgtgtattcgtggccggcttggaaatcccagatggaggcgttgaagcagtcgacgcagtggaaggggcaaccggagacgtaaagggagttgcgcacgccttctccgtcggtgacaatgaaggttttgtagtcggcgatcatccgcttggacatgcgccggccatcccattgaccggctttcggatcgttggcaagaccgttggagggtacggaggggccacgcccggtctcgccggccgcaaagtcatggcgcttgggttcgggcttggtcgtatgcagctccggcatgattccctccttacggaaagcattagctcccgctggcgggagctgtccgtcatcagacggactgagggtggtcaacaccataaaggatgaccgccctcagtctcgcttacgctctacagctcccgtcagcgggagcaagtataaaccctacttggtctcttcgaaccactcgcgagtggttccgtcatccagcgtcacacgaccggtttcgccgctcatgtgcttgactcggtgggcaatttcctcgtgacggccgtgcaccatcgggcgctggaccgggctgccgagatagccgcaggtgcgcttggtgacgttgcacttgtccgggttggagttaccgcactccgggcacttgaagccttcctcggtcggctcgaagtcgccctggaagccgcacacgaagcagtggtcgatcggggtgttggtacccaggtagccgatgccgatgttgtaggcgtaatcccacacggcttcgagcgccttcgggttgtcctgcaggcacgggtactcgcagtagttgatgaagccgccggaagcgtagtacgggaagtccttctcgtagctgagcttctccatcggagtgggctgcaaccacaccgggtagtggaaggagttggtgtagaagtcgtgatcagtcacgccttcgatacggccgaacttttcacggtccatgcggttgaagcggtcggtcagggattcagccggagtggagtacacggaatagtggtaaccctccgctttgctccactgcttgcacagctcgttcatgcgcttgacgatggacagcgcgaactccttgccttccggatcccagccgtggtcgcgaatccagttcttgccatagaagaccgcagtggtctcggcaaggccgatgtagccgagcgacacggtggcacgctcgttcttgaacagctggtccacgttgtcgttggcaccaagacgaccaaacgcaccaaagcggaacagggtcggggcgttgaccggggtggcttccttgcagcgcatgatgcggaactggagggcctgatgggcgacttccatacgctcgtcgaacagcttccagaagcgagccttgtcaccgtgggattcgatggcgatacgcggcacgttgacggtgaccacgccgaggttcatacggccgtcttcttcatccttgccggtctccgggttgatccaaccctgcaggaaggagcggcaacccatcggagccttgaaggagcctgtgatcttgacgatgttctcgtagaacaccacatccgggtacatgcgcttggtggcggactcgagggcaagctgcttcagatcgtagttcgggtcacccgggtcggcgttcacgccgtgcttcacagtaaagacgagcttcgggaagatggcggtgtggtgttccttgccgaggccgcgaatacggttcagcaggattgcgcgctgcacttcacgagagaaccagtcggtgccgagaccaaagccgacagtcacgaacggggtctggccgttggacacacggttggagttgatctggtattccatggtctgcatggcatcatagatggccttgcgggtacgaatcttggcgaggatttcacgctcttgctcaagttcgtcaacgtcggtgtggaacggggtgtccatcggcagcggttcacgggaaccgaaatgcagcttggcgggctcgttcttcttggcgctctcgacctgacgacgggcgaattcaaccggcatgccgtcggggatggtctcacgagcttcctcaaggaacttctcgtaatccttcttggcatactgggcaagatgctcgtcggcacggttggcggtctggccaccatactggctggaggccacgtccttcatgatctgggtaatctgggtggccgcaatggcgatggacttcggggaagccatcggagcgttgccaagagtgaagccattggccaacatgtcccagaagttcggcaaggagcagttggactgggcagtgaacggcgaatagtcggcatcgtggaagtgaatgtcgcccttcatgtgggcgttggacaccgccggcggcagcatgttgaacgcggcggccttggacacggcaccggccagcagatcacgctgggtggagtagacgttggaatccttgttcgcgttctcgtgaatcagggtcgggtcatgattaatgaagcgagcaacggcctcgttgacatcagtggccttggcacgctgaatgtctttgtcgagacggtaattggtgtaggcgcgagccacatcgtacaggtgggcgtcaatgagggcgtgctccacgagattctggatgtcctcgattttggcggggccggtgtaacgccccttgatttcgccttcgacttggttggcgaaaccacggatcatggcatcttcttcggggccgacttccttgttcaggtcgccgaaagcagacttgaccgcagagatgatgttgatggggtcgaagtcgaccacacgaccatcacgcttctcaacgagcacggtggaggccttggcggccaccttggtctcgttatcggtgacggtttcctccagcacctgtgcgcccatcgggcacccctttcctataaggcgaacactctcctgagttccgcattttggccgcactcgacgtgggccacacgaaattacattgatatcgttttcttgaacctctagaagaatacggcatccccacccctatatctagtgctcaacagtggtgtgtcgaactatttatagggtttttcggctatttttcgccaaaactacaagtgtgtgattagcgtaactgttttctgctcgcgtgtcgcacagcgagctcactgacgactctcaatcgtcagtgcaacgcatatctcactcctcttcatagcacccgtttcttcgccataatgactcctttcttctgatgcaccagaccatctccatcatcggctgatacatcgcttcgtacggttcttgcattcatcatcacaccgttttcaggcgacggtaaatttttaccgtcatcaaccaacgcacttatagtggagtgcatgactactgcaatgggctactcatctaccggccgtccaccgaccgccgcttcactggcctcgtctggctttgagccgggtcaaggcactttcgcgcccgatcggggcgccatcaatctgccgaatgagcctcgccctatcgatcagctgcctgcacgcgccgctgaaaccaccgcgcaaaatccgtggccggtaagcgtgctgagccagaagttctacggtgccgtggaacgatggccgtccgcgtgggtcaccggccagatcacgcagatcaatacccgtcgcgccggctcggcctacatcacgctgcgcgacgacttcgaggatatcgccatggaagtcaatggcttcggcaggttcgcggccgcagccagccagttcgttcagggcgaccgcgtggtgattcacggcaaaccgaacctgtggatgaagcgcacttcgctgtcgttgcgcggggacacgattctcaaggtcggagccggtggcagcctcaaggccatgatcgacgaattgcgcaagcagcttaagggcgagggcctgttcgatgccgatcacaaactgcctctcccggagtttccgaagactattggcctgatttgcgcacctcaggcacgtgcggaaggcgatgtgatcaccaatgtgaaccttcgttggccttccgtaaccttcaaggtggtccatgtgcatgttcagggcgagcaatgcccggccgaggtggttcaggccattgcacaactcgatgccgacccgagcgtggatgtgatcatcgtggcccgtggcggcggctcgtttgaggatctcatcggtttctcggatgagcgtgtggttcgtgcggcgtatgcctgcactacaccattaatctcctccatcgggcatgaggatgactggacattgctggatctggtcgccgatctgcgcgcctccacccctaccgatgcggccaagcgcgtggtgccggatgtgcgtgagcagtcgcagctcatcgaaggtgccatcgaccgtatgcgactgcgggtccgttcgcgcgtggagaacgagattcgacttatcgagggatatgcgaaccgcccgagcctgacacagccgcacaccatgcttgagcctcatcagcgcttaattgacgactcgttgcaacggctcgatatcgggctgcgacgcatcgtggacgatgcccagctcaccgtcgagcgagctcacgcctcactgaccgcactcagcccgcaatccacgttgaaccgaggctatgcggtggtgcagtccgccgatggccacgtactagacgatgcttcgcaggtaagccctggggatggcatcaccgtcaccttgaagaagggtgtcattaccgcaaccaccacatccgcaaccgcgtgacacgccatacgcagccacgcatatataccgtatatataaggagaacatcatgaccgaaaacgccacatccaccgacatgaacacccccgccacgtccctgacggacaaggaacgcgagctcatcgcccagatgccatatgaggaggcgcgcgacaagctgattcaggctgtccaggcactggaaaccggcggcctcaatcttgaccagtcgatgcgtcaatgggagatcggcgaggccttggctaagcgcgcccagggtctgctcaacgacgtccgtgccaagctcgaccaagcacaagccgagcaagccgccaacgaagccaccgcaggcacgcagtccaacctcgactgagttgcctcccggcgcggcatcccgcggctcgcacctgagtccggactggactgagttctgcttcccggcatacgatagtggtgattaggccacattggcagcagtttatagaagggaaatcccatgtcaacgttgattcttgtattccatccgcatcttaaggacggctcgcgcgtgaacgcccgcctgctcgccgaactcaccgcacagggcgaggacgacatcatcgtgcgcgacgaatacgccgaatacccgaacttctccgtcaacgccgacacagagcacgagctgctggaggctgccgaccgcgtaatccttcagttcccgttctactggtactcctcccccgcgctactcaaggaatgggaagacgaggtcatcaccgccggctgggcctacgccggagcccatgcgttgaagggcaaggagctcaaactggtggtcaccactggttccgacgccgccaagtaccgcaaggacggcgagtacagccacaccatggaggagctgctaagcccgtttgaggtcgtggcgtacaaggtcggcatgaactatgctgagccgttcctggtgcagggcaccgccaccatcggcgatgcggagctggatcaggccgccgccgattatgtttcgtcgattttggactgaataagctgaggccgggtgcaagtcgcacccggccttgttgtttcgcgggctagccgcggtctctcccagtcagcctgcggctgacagttccctcgtcagagagagcttattttttggatcagagggagttgatagctacttcttcaacggcacgtagatcacgtcgtcaatgagctcgcgatagtgctcaacgatttgcgcgcgacgggtcttcaggctcggggtcagcatgccgttggcctcggtgaattcgtctggcagaatctcgaacttacgaatcgactcggcgcgggaaacgccctcgttggcggcgttcaccgcacgctccacctcagcgtgaacgatggcgttcttggccagcgaggccagatcgggttccggtttggcgccctgggattccagccaattgttggcatccgccagatccagcgtgaccagagcggccacgaacggcttcttatcaccaataaccaagcactggttgaccacaggcgaggtcatcacggaagcctcaagcagacccggcgacacattcttgccaccagcggtgatgatgaggtctttcttacggccggtgatggagatgaagccatcttcggagatatcgcccagatcgccggtgtgcagccagccatcagtgatctgctgggcagtgaccccagggttgttgtggtagcccttgcacaccagcggtcctttgaccaccagctcgccgtcctcggcaatgccggcggtgataccgcacatcggcatgccgatggtgccgatgcggttgtcctctggcaagctcacacacaccgggccgcaggtttcggtcatgccgtagccttccagcaccggcatgccgatgccgttgaagaagtgggaaagctcggagtccatcggagcgccgccggtgatggcgaagtcggcgttcggaccgaaaatcgtgcgaatcttcttgtacaccacctgctcgtagaaggcgtgggcgatgcgtccggtaatcggcagctgctcacccttctgctcggccttggaccattcgcgcgcgttctcggcggcgcgcatgaacatcttgccagcgaatccggtgccggcgcgctgggaggcggcattgtagaccttctcgtacacacgcggcacggcaagcagcagcgtggggccgaaggtctcgaagtccttgaccatcgtcttcatattggagctcaaggccagcgaaatcgtgccgccaaaactgaagaattccaggaatcgggcgaacacatggctcaacggcaggaacagcagcagacggcggttgggccatgcgccggcacgaggcatgtactgcaatgcggagagtaccaggaaagcgaagttgcggtgggtcagttccacgcccttcggggtgccagtggagccggacgtgtagacgatggtggcgcggtcgtcgccgtgggaggcttccttgtattcccagaattcggcatcggtgacgctttcgccataggtcttgatggcgttcaggccgccggcctcgattacgaacacgttgcgcagggtgggtacctcgctgcgcacggattcgatcttgtcgcgctgtccgtcatcttcggcgatggcgagcgtgactttggaatcgttgaaaatccagctgacctggctggcggagttggtctcatacaccggcacagtgagcgcgccgatggacataatcgccatatccagcgcggtccattcccagcgggtgtgcgagacgatggcgactgaatcgcccttattgacgccaagtccgatcaggcccttggccagatcgatgaccatgtcacggaatacttgggcactgtacgggtgccaagtgccatcatcgcccttgtattcgatcatggcaccttcgggatcgcgcttggcgcggttatcgagcagatcgaacaggttgatgtcgctgtcaatcggctccttgacgggattggtgaactgcttgacgatacgagtatcgtttatggccttatcagcgatgttttcagtcatactccccatgtaactccacggatgctacaaaacacgccgcgaaacaatggattgtccagaccaaatggccccggcaatccgttatttcgggcaaaccaggtaaatctgtcgcaccgtacattcagcagattactcggcggagtcattggcctttttcagctcgtcgcgaatctcctgcaacgtggcgagagtctgctcttcaacgctaggcccctgttcttcagcgtcagcctcatcctggatagcagtaaagatcacgaagcttattaatcggcagaatcacgcagaaatacaccgccacgccaacaagcaggaagttaatcagcgcgttaagaatcgcaccaaatgaaacagtcgagttgttgaacgtgatggtcagcagtccggaaagatccggtacgccgccaatcatgccgattaatggactgatgagattgtcgacgatggaattgaccacagcggtaacggcagagcccatcaccacacctaccgccatatcaatcatcgatccgcgcgacaggaatttcttaaagccattcaacggacctttatcggtcaaagcaacaactttgcgagcggttcctcccgtggccttggcaaagtcggtggcaatattcatgggattgtggttactcataacggcactccttacgaaattcagacacttcacttgtatccgactggttttcccacgaccccattatgccgcttgttggaatatccctataccactgcggcgttcccgtacatgactatgtacgagaacgccgccaaccctgcttgcagagaacctgttagagctgtttagaactggatgtaatcgacttccgtatgctcgccggtttccaagtatttcgccacatcatcaggaccgacgaacaccagttcgaccgcttgcgcaatcatcagattgacacgatccattggcgtaaggttttcgaaatagccgtacaccgggattcccagcgcatgcgcatatccgatttcgaacatcgtgcccgggtcctcgtccataagattggcgaccacggctttagcagcattaatgccatggatatcgtccgcaaagcatccttcagggcctacttcttcgatctggctgacaaaccgcggcttgaacagtaccttgccatggtcttccaatatcttttccaaacgttccatacttgccgtttgttcaggatcaaagaacggaccggccacatagaagtcatactgtttgtcttcactcatggtctctagtcatagcgcagcaacgtcgaacgtcagccgttattttcactgtatggacaaggggtcgtattgtgaacattgctacgggataaccgtcaacgactacgtacgttgcccccgatcagcacactccgccactttcgccccctcccgtatcgtcgagcacgcgaaccaagccgaccaaatagccgccatcccatgcgctgattaccgtatccgaatgctgcaatgccttgaacaaccgttcgggccactgcgccgattcccaaccaaccgacttgaacagcgcctcaacctgttcgacagtaaaccgcttctcttccgtgtattcgatagccatggaccctcacgatgaccgtgaagccccacatgtctttgcatagtttcacatgacgggatgatggatagtggaacctatacgtttacacatgcctaatgcccatggctcatcaccgatgaatagaggctgagataccgtcatgtttccgaagccaagtgcccgagatcggattcgaaccgacgacacccgctttaggagagcggtgctctatccactgagctactcgggcaacgacgtttcattgtacacggccacacgcccagtcgcatcatgttcgcgtggcagcttgcgcaagccatccggcaacctgagcaagccacatggaggaacccgacatcaggtcatggcccggtctttcgtgccagtttggtgcgaactgctcttgcgcacggcgaaaagacactgaaagacaagccgtacacggtacagtggcaaatcgcacgaaaagcaaagtaacagtaaacaagccggaggaaagggcagcatggcaaaggcacggagtactaccacaggcgcaagcgtacgagctcgcgccgctgccaagccacgctctgccagagccacggcacgcccagtatccaagtctgccgtgaagccacacaaacggcatcgtctgcttggttttctcgccacgatgttcgcgcttcttgcccttgccggcgctgccgcccgcgcgctgcctgccgatttacaggaactgccatttgcgccgattgtggtatcggcaacgccatggttcacgttgcttggcttgattgccctgctgttggccatcgtgtcgcggcgtatccttgccgcactaatcgccatcgccgcaatcgcatgcaatggctattggcaatatccgttcttctactcgaccgatccactcccccaagccgcgcagaacgccgtggccgcagcctcccccaacaccagcgatgcctacgcgcgcgtcatgaccttcaatgtgtataaggggcaggccgacccgcaagccatcgtcgagctggttcgcgatcagcgcgtcgaagtgcttgctttgcaggagaccaccgaggatttcgtcaaaaaactcaatgaggctggtattgagcattatctgccgtatgcgcaggtctcatcgtctgacggcgtattcggtaacggcctctggtcggccacgccacttgccgatccgaccgacgatgacgtgaattccagcgcctcattcatgcccggcggcacggtggatatgggtggccagcagattcgattcgtatccgtgcacaccaccgctcccgtacccggctactggcggcagtggaagcgatcgctggatgagttgggtctgatgcgcgagcatacggatacacggtatattttcatgggcgatttcaacgccacttacgatcacacgccattccgtgattttcttggcgaccggttcgtggatgccgcacgtgaatccggacatgggtttacgttctcatggcccacgaaccgtgcggctgtgccaatgttcgccggtattgaccacgtggtgcttgatcagggcatgaaggccggacaatgcaaggtggtcaaagtcgagggctctgatcatgcggcattgttggctaccgtggcggttgggtgattcccctcaataggactagaaaccgaggcgggtgcggccgaattggtcgagccagcgcaaaatcgcgccttcacgcagcgcccacgggcagatctcgacttcctgaatattcagggccttcatgatctcgtcggccaccacgccgccgcccacaatctgcatcgtgcgttcaggcgtgatgccgggcaaagccacgcgctgctcaggcgcgatcgccgccaaacgaggaatccagtcttccaactgctcacgagtcataatccatgaatcttcgcggcccggcgcacgcatcaccgcaccgcacaggcgagccagcgagcggaaggtcttggaggtgccaactgcatgattcgggtgcttggattgcgggaaaaccttgaccatcggctccagaatcttgcgcacgttcttacgcacgtcttccaactcgtcgggcgtggccatgccggaaggcagaaattcagtggtgacgcggcccgcgccagccggggcggaaagcgctacggtcggctcttcgtcggagcccatcgccacttcgagcgaaccgccgccgatgtccagcaccagcagtcggccggcatcccaaccataccaacggcgggcggccaggaaggtcaggcgagcctcatccgtgccagacagcacagtgacgccctgaccaatcagttcctcgatcttgtgaatcactttgttgccgttcggcgcctcgcgcagggcggaggtggccataaccagcagctgggtgatttcgtattcctcggccagccgcatgcactgggacacggcttccagaatcgcctcgatgccggacttcttgattgagccgtcgtcctttaaatacttcatcaggcgcactgtggatttggtgctggcctcggggtcagggcgagcgccgggggcggcgtcgacgataagcatgtggatagtgttcgaaccgatatcaagcacaccaagtcgcgtggtatgcgaacgcagattgaccatgattcctattcctgaccttacctaacccgtgatggccgaacaacgggccgaccatcgcaatcagccagccgtgcgccaccatggcgagtcgttcggccggcaaccaacaccgtgaggccagccgaacatcacacaaactcgactactgtacaacaatcacaccggctgccgcgccgttcacagcgattcgacgaacgttccgagacgttccagcccctcggtcagggcctcacgtgaggcggcatagctcaggcgcacatgcgtatccgccgtggccgcgccgaagtcgcggccaggagtcagagccacatgggcttcatccagcgcgcgttcgcagaacgtccaggcatccagaccagtgcgggagatgtcgaagtaggcgtagaacgcgccattcggctccacctcaaccggcaaaccgatgcgcttgagcccgtcaatcacaatgcggcgacgggccagcaattcctgacgacgagcttcgcattccgccaagctttccggcgtgaagcaggcgagcgccgcatgttgcgtgggcgtgtgggcgcacaggtagtagttggtggccagatcgtcaaccgcttccagcacagtgggctcgtccggcagaatcgcccagccgaggcgccagccggtcatgccgaagaacttggagaagctgttgcatacgatggcatcggggtcgcaggccagtacggacttgacttcggtaccgtccggctcccggtcagccaaatcaaggtaggtttcgtccacgatgcgccatgcgccgcggctggcggccaacttgcacacctcgtccaatacgttgaagtcgatggtggtgccggtggggttggacggcgacgtgatcattacggccttggtcttgctcgtccagtactggctgcacaggtcggcggtcaggtggaagcgggtggcggccgaggtcggcacatcgatgacccggccttcaaacgaccgcacaagttcgcggttgcatgggtaggaggggtcggccacaatcacatcgtcaccggggtccacggtcagcgcggtggccaacagcagagcggccgaaccgccggcggtcacgcagatacgcttggggtcgatgtcaaggtcatgacgctcgcggtagaagtcggcgatggcctgacgcagttcaggtaggcccatggcggcggtgtacggcagggcccggccgtcgtactgttcgcgcatggcgtcgcgtacggcgggcggcgcgccgaaatcgggctcgccaaggcttaatttgatgacgctggtaccttgggcgatcatcttgtctgcttgttcgccgaataccatggcacggaagggattggcctcacgcgctcggcgggacatgactggagacgcggccggagattggggctgctgcgctgcttcgttttccatatttcggttctatccgcctcacgggacaaggtttcttcttctataatcactgtaggtcgattgagtgcaccaacccgcattcaaggaggaataatgagtcgattcaatggcaagcgcgccgagttcgaggccagcggcgaaaaaatcaacgtcgcgattctgggtgcgggccgcatagctcacaccatggccggcaccctgacccagatggctgaagattcactgtattcctcatggattcacccgtatgcggtagcggcccgtgatattacgcgcgcgcaggcttttgccgaccaatggcattttgacaaggcttatggatcgtatgaggagttggtggcggacccggatgtggatctggtgtatatcgccaccccgcacagtctgcacgccgaacaggcgatcctgtgtatgaaagccggcaagaacgtgctggtggagaagtcgttcaccgcgaacgccgggcaggcacgtgaggcgctggccgtggccgaggaaaccggcatgctgtgcacggaggccatctggacgcgctacatgcccagccgcaagctcatcaacgaagttatcgagtccggcgagatcggcgaggtgaaagcggcgagcgccaacctgtgctatccggtgtccggcaaggcacgtatgaccgatccggcctgtgccggtggcgcgctgctcgatgtgggcgtgtatccgctgaacttcctggatatggcggtcggcgccgaccatggccgtacacttgatcatttcgatacgtcgatggtgcccgccgaaaccggtgtggatgcgcagaattccaccacgttgtattacagcgacggcacgatggccgtgtccaccagttcgatgctggtttcctccgaccgcggcggctatgtgtggggcaccgagggttatctggtggtcaccaatatcaacaatcccgagtccatcgacatctatgacaatgcccacaagcccgtgcgcagcattgcggtgccgccgcagttgaccggttatgagtatgaggtggccgatgcggccaacgcgctgctggacggcaagatcgaatgcgaggcgatgccgcacgccgacaccatccgcatcatggagctgatggatgcgattcgtgaccgttggggcctgaagttcccgtttgaatcctgatttcagctcccctccagaggggagctgaaattattccgctgaatctgcatctccttcaacaatctgctcatacagccgtacgaggcgttcgtcgcgcacggctttcgttaattcgcactcccatacggtaattacacgccagccagcggcctccagttcggctcgctgcgcgatgtctcgattgtgattgcgcagtagtttcgcctgccagaattccacgttcgatttcggcatcgaatgtttggaacatccttcatgcatgtgccagaaacagccgttgacaaacacgatggcgtggtatttcggcagtactacatccgggtgtccggggtaacgcttgtcgttcttgcggaatcgcaaccccttgcgaaacaggtagctgcgtaccagtacctcaattttggtgtctttgccacgaatatgcgacatcgtgtacgaacgggtaccccgctcatacttctccactggctgtttcttgcgattcacgcactccagactaccgtgacgttgcggcgagaatgagagcctgaacgaacgatcacccatcttgcccgtccgtgtctcttatcgcgggcaacaatcatctgccggtcgagactgcccgattagactgagttcaatggatgacatgacgattcgtagggccacggcggccgatattccccagatcgacgaactgctgcggcaggtgctcgaagtgcatcatgccggccgaccggatctgttcaaaggcggtgtcaagaaatacacggacgaggaattgaaggcgattctggccaacgatcagacccctgtgttcgtggcggttgcgccatctgccaatgacggcaatgacgccgaacataacgccgactcccccgccaccgaccaagtgcttggctacgcattctgcgtgttccagcagcacctcaacagcaatatcctgaccgatatcaaaaccctgtacatcgatgatctatgcgttgacgagcggtcccgcggccaccatgtaggctccaccttgtatcgctacgtgctcgacttcgcccgtcaatccggctgccacaacgtaacgctcaacgtctgggcctgcaaccccaaagcccaagccttctacgaacgcatgggactcactccatattacatcggcatggagcaggtgctgtagcgccgccgtttcagcagcacgatgatggcgatgatcgcagcgaggctgcatagggccacgccatatacaaagcccggagttccgaaattcatgaggcagattgtgatgttaccggtagtggttaccgaaaacacgacgataagcgcgacgatacgaatcatatccagcagtccagctgcttgagccaacagacgctccggtaccaccaatttggccgccgtgcacagcaaagtcgcctgaacggcgagcagaatcgcccattcccagaacatggacggttctttaagcaacgtggtctccggaaacatagacaccacctcattgataaaccacggcgccacaacaatctccacatatgcgagcccaatacaacacacgacaagcaccacggcaatggcatagcgccaagcgacgtctgttttgcgagatttacgagaaatgaatgcgataccagcgttcatggctatgcttcttaatccaatatcaatggatgaacctgcactgcaccgtatgccaccatcataatatatcgaatatcgatataaaaatatcgaaaaacactttcaccattcacctacacatccgcaaacccatgaatacacatgttcttaatcgggatggggagtgcacaaagaagctctgtcaccccagcagattgaggagatcgtccttggtgagggtggcgatggaggcgggggcttcggtgagggcgctggcgccggtgccggcttcgtcggcaagcaaggaagcgtcggtgaactggcgggcgagctcgctcttagtatgctgaagctccaagatacgttcttcgatggtgtccttggccaccacctgatacacgttgacgtcttcggtctggccgatacgatgtgctcggtcggtggcctgatcctgtgcggcggcgttccaccatgggtcggcgtggatgaccacgctggcaccggtcaggttcagtccggtgttgccggccttcagggaaatcaggaaggcaggcgtatcgtccgcattgaactggtcgacgagttcgagacgcttcttcttgggcgtggagccggtgatggtgtagtagcgcaggccttgcgcgtcgaaacgttcggcgatcagatcaaggaagctggtgaactgggagaagatcagcgccttcttgccttcgttcacacaggtttccaccagttcggtgatggcggcaagcttggccgattgatccttggcatcggcgtacagcagcctcggatcgcagcagatctggcgcaacttggtcaactcggcgaggatgcgaatcttcgacgtgttgaaatcggcttcttcgctgtgttcgagctgcattctgagccgctgctcgtgagccgcatacagtttgcgctgttcgccggcaagccgcacggtcagcgtggtctctagcttgtccggcaaatcggtcaacacctgggacttcagcctgcgcttgatgaacacgcccaccaacgactgcaattggcgagatacccgagcggcctcaggattgacttgtgcggcggcccgaccttcagccgtgctgccatccgcggcccgggcattggagatgggcaactcataacgctcatggaatcgcttatatgagccgagcagccccggcatcaggaagtcgaaaatgctccatagttcggagagtcggttttcgatcggcgtgccagtcaaggcgaaacgatggtcggcggccacggccttgaccgctttggctattttcgtggtgtgattcttgatgtactgggcttcatccaatgccatgacattgaaacgttgctcattggcggtgtaatcatcgacatctcggcgcagcaggtcgtatgaggtgatgagcacggtgggttcatccgcccggaacgcacggccgatggcggtacggcgctcggctttggtaccggccaccaccacggcattgaagctcggggcgaacttggtgaattcggcaccccagttgtacaccaaggacgccgggcacacgatcagcgatgggccaaggctgccgtcgcccatctcgccggtattccgctgatatcgagacaggagcaacgcgataagctgcacggatttacccaagcccatctcatcggccagaatgccgccaaaacccttgtcgcacaacgtgttcagccattgaaagccttcgacctgataagggcgcagaatatgcttgagactatccggcacttcatacgacttagggtcgatgatcttgagatcgtcgatgtattcggtgaacgaagcgtccttgactacatcggagccgtcatccggcagctcaccatccagtaggaatgctcgaccgcccggcaactcgatcagtccggagttgagctgctgctcgctcagatcgaggtcgctggccaatcggtccaacgtgctgagattcgcgccgctgagtttgacaagcgtgccgtccttcaactgatggaatcgttgacgccgacggtacgaagatagcaaggcacccacttcgtccggcggcacttcatcagcgaggggtgatatctccaccaagttgcctttgatggacaatccgactttgacgcttggtggcttgggcgcgatcagccggtcaaaagccggtgtggtgaagacctcccccacttcctttagtgccggcaatccctcgtcaaagagacgaacgatctgcgtggtgtcatcgcgatcgatagtggccgcatcagacacgaattttttggtggcctttcgcgcggccggcgttcggaacccattcaccgtctgatgagtggcggccgcaacgcgcttgcgctggtcaggcatggtaaagaattcacgcactacatcaatcgcaagatgctcagcgtcgaaatcacgcccaatcacgccccgagacaaggggatggaacgctcgccctcagcatgcaccgtcgggccatcgggtagcaacgggacaatggcatcgccgtagcgtgccttgacctcgcattgcacaccatgctcatcacgatccagataaaactggaggctgcattccgtaggacttaattcagccagctcgcgaggaatctcactggcctccaacagtccggcaccaaccagctgaggcaatagcgtgcgtgcgaatagggcgatgtcatcgccggcaatgacctgtccctcgccatcgggttcaaacaggtctcccaatagtcctcgcaacggaatcaatcgtttcgggcaacggacgaatcggcatcctgctgcgcttttacgctgagagcccgccaccatggcggataccgcgccggccggattagtggaggcgagcaacagccatacattcttgccgccgtcaatcacggtttccaccgctggcactccggtaagcaggtatccggcatccggaccatacgtattgaaatcacgccgcgcaatgcgcatgagaaaatctggctcgccaccatcaactggcaccgatgcaggctgcccggagaaccatgtgttcagcacgagctgtacgcctctgccctcacgtacggacagcaaccgggccacttccggtgctgaaagcgtcagatgacggtcgatggcgatatgcccgtaatacctgtcctgctgctcggccgcacgacgcacggccatcgcatcatcaaggacgtccagcagggggcgcgaatcatcatcgagcatatccggcgtatgaataaaggcaagcttctgcccataatccgcatagtcgccgttcgccatggcaagcacaaattgcggaatcgatttcagcacatagctggacccattggaagccgagccgatcttgaactccacgctccacacgccgtcgatgaaactcaatatcgggacaagctgcacctgccccaagcccacagtctcgctgtcaccctgatacccgccgcctcgggtgccggcacgagagccgtatccgctttttgtacgccgagcatttgcaccgtttttcccttgcgtggcatcaaaccgacgcataaccgcattgcgacgacgaattttggcttgagcgtcttgcctatcggcgtgctccatatagtcaatcagcgtccgagacggtcgtgcggccccggcacggtagccttcaaaacgctgcggatcatcgcagaatatgaaggcgagcgcaatcatgtgcttgcacatgccatagccacggccgtaagccgggcatgagcacttgccaccgacggcttctcccgtatcgaggtcgaattgcacgctggtacgatacctactcgatgggctggtggtgccacgtagaataccgtcaagctcggcatacccggttcgatgattttcgctgtataccggattgataaccatggtggccgctttgcgcgcaatgctacgggcacgagcgagcacggcattcgacgatgacgattccacatcgttgcgtaacgcaaggatagggacggcatgggcttcggcacgcttcgcagacccggcgaaatggccttcgtcctcatcgtcgaaccatacggaacgtccttgcctgaaacgatagggcatcaccgcatcggcggcggacaaactgtccgttccaccaaacgttacgtctctgctgccggccgcgcctgagctaccaagtattccacccgtctcaccagaaatgccgcctactccgccgcttttaccggcatagatgcccctgcccccattagtgtcatcagtgtcatctatgtcataccgaccgtcgtcgtaatcggcatcttcgtcgtctcctcttttccaaggattgcgacgacgcaacgcatggccccaggaaacgccggaatcatcatcctcataaggcaggaggccatcgtcatccgcattatcgggaacatggccaaacacaccataccctttgctcatgggcgagcctcctttccagcgaatgtatttcaacccaacgtttccatcctagacgaagcgcgcggtagccttaatgtatggatgcagacaagccggcgcaacgcaaatcctatgcagggaacaccaccctcgaaatcttcgaggtgctgtggcgtcacagttactttgggcatggcctgaccgtgcggcaaatactcgatgagcttgcccgtaaacaccagctggaagatccaagcgagctgccgaccgagaagaccatacgaaaccagctcaaaaagctgacctccacggaatttctcggcagacatatcgggcatctcaccgaaagcgaccttgccggcatcgaatgcaagaatccacaacccggctggtatcttgatgcattcctgtccactgccgaaatgcgactgctactagacagtcttaccctatctcgcatcagcctcgacaccatggacgacctcatcggtaaaatccgcgagctcgcaggcgccgccgggcaggcagtaggctacctggaccatgtggccacctacacgcatatcaacggtgagttcctatccactatcgaccagctgaatcaagccatcgaagaaggccacggcgtaaccttccaataccgtgattacggaccggatggcaccttgataccgcataaaagccgtacgggtgcaggccgaattacctacaccgccgacccttaccagatggtgtacaagaacggacgctattacctcatctgccacctgcatggcgaagacaacctccgcattttcgtggtcaaccgaatcgccaacgtcagcgccaaaggcaggaacggcacagtgccactggaaaaaccagcaccagctgattttgacgcagtgaacttcatgcgccaccgtccataccccgtagccgatgccccgattcgcatccgcatggccgtacgagacgaatccatgctcaacaacgtgttcgaatggttcgacgaccctcaaatcaaacattcaccggacggcacacagttcgaagtcatcgtcgatgctcccgaacgcgctgtgttctggtgggcattgcagtattcctgggatggccgcgtagtgattcttgagcccgattcgctcaagcgcaaactctatgatgccgggcgtcgcatggccacagcctatgctcccgaatgatgcaacatcacatcgcacacctccttgtcgagttgttcaccagcgaatttcaccggagaacctatcatcccatcgccaatcacactcggtaattttttaccgggaaatacgatttcaagccatttcgcgggcatcgtccctcacctaggcgcacataaggctaaggtgggaatcattaatcgcatcgcgcgtccacaagcgtgcactagcgcgtacaacaataaggagcaactatgagcgaagagcgtaccgcatggggctggggtctggccagcgtagacgccgccggcaccaccctggacgtctggtaccccgaactgaatctcggtgaggcaccggccgagtccgatcgcccgaaccacaatttcggtactttggctcacgatgaggccgacgcccgtggcattcgccgcgtgccggtattcgtcgtcagccagttggacgagccgatcagtaatgccgcggacgcttacctgaagctccatttgatgagcatgcgcatggccaagccgaacacgctgaacctcgacggcatcttcgcccagctcgccaatgtggtgtggaccaactacggccccttcgccgttgaagacttcacgctgcgcaaggccgacgtcgaacgcgcctccaccgaagccgctctcgctttcgcctcccaggccggactgcctgccgcagctcctgccgccactgtcaacgtgttcggtgtggataagttcccgcgcatgatcgattacgtagtgcccaccggcgtgcgcctcggcgacgccgaccgcgtgcgcctcggcgcttacttgtcttccggcaccaccgtgatgcacgccggattcgtgaacttcaatgccggcacgctcggcgtctccatggtcgaaggccgtgtttcgcaaggcgtggtcgtgggtgacggttccgacatcggcggcggtgcctccatcatgggcaccttgtccggtggcggcaagctgcgcaattccatcggcgagcactcgctgctcggcgccaacgccggtatcggcatctctctgggcgataactgcaccgtcgaagccggtctgtacatcaccgccggcactaagatcaccatctgggacaaggccaaggccgccgctggcgaaccgctggaagtggtcaagggtgctgagctctccggcaaagacaacattctgtttatccgcaactcggtgaacggccgcatcgaagcccgctaccgcaaggtgggaattgagctcaacgccaagctgcacaagaactgaaattgaaataatggagcgttatcttcgttgcccctcggtcgacgtaccttcgtacgccttccctcggtgcgcctcgataccgcacacattatttcaatttcagaactagccctgctagttcttatgcagccgtcgcagcatagctggtttgcgctgtacatatagaaagcgcctcactggaatctccagcgaagcgctttctcaaaccaacaatcaccgctcgtccatcggcacgaaatcgcgctcgaccggaccggtgtagacctggcgtgggcggccgatcttggtattcgggtcggccaacatctcacggtactgcgcaatccaaccgggaatgcggcccagcgcgaacagcgtggtgaacatggccggatcgaagccgatcgcccgataaatcaagcccgtgtagaagtcgacgttcggatacaggttgcgcgatacgaaatattcgtcattcagcgcaatatcttcaagctcggtggccacggcgaacagcgcgcgctcgtcagacggcagcttctgcgtatcttcgcgctccatgatcttttccagatacttcctggcaatcgccgcgcgcggatcatacgacttgtatacacggtggccaaggccggaaatcttctggccattctccttggcatcacgcacgaactcggccacagacttgccggaatcacgaatcgccttcaattggcgcagtacggcctcattcgcaccaccatgcaacggaccggacagcgcattgacgccagcggccaccgccgaatacaggttggcgtgggcggaaccggcgatacgcaccaccgaggtcgagcagttctgctcatggtcggcatgaataatcaacaaacgacccaaagcatgcacatacagcgggtcggattcaaacggctcgtacggcacagcgaagcacatgcgcaggaagtcgtccacatagccgcgcgcgtaatcggggtacagcatcggctcatcgcgacgacggcggaagatgtacgacacaatcgtacgggccttggccatgatgatcttggcggcctcatcaagctggtcgttgtcagaaatatcggtggtgtccgggtagaacgtggccagcgcattgatggcggaggcaagcacgctcatcgggtgagcggagcgcgggaacgaacccatgaaggtacggaagtcttcgccaaccatcgtcttgtgattgatgtccgcacagaactgctcatactcagccctgctcggcagctcgccgtggcgcagcagccacgccacctccagaaaatcggagttctcgcacagttgctcgatggggtaaccgcagtagcgcaaaatcgaatgcttgccgtcgatgtaggtgattttcgattcgcactgcgcggtggtgaggaatccgggatcaagcgttacccagccatcgttgcgcagtttggaaacgacgatgccatccggccctgcactagccttaaccacgggcaggttgaacttgttcgaatcgacatcaagttgtgccgttgccattcgcgcaccttcctcttcatgaaccacttaccccaaacattaacgttcacgcgttcgcgaacactagtgttcggtactctatgtcttctgtgttaccgctggcgaatgccggtcgatacacgaaagccgaagtgcgctcatgctatcaaagcaaacgcacttcggcttgttacgtctcgaattcgcgggaaaaccgcgaacagacggacggctaatgagacgctgatcgcccatcacaggccaatcaggcacctaccatacgccaaacgccgatcagaggttggtgcgatcggtgaagacgatcgggccgttctcggtgatggcgatggtgtgctcggagtgggcgccgcgcgagccgtcggaggcacgcagggtccagccgtccttcggatcctggaagatctcgtcggtggtcttgaggaaccacggttcgatggcgatgaccaggccttcgcgcagcttgtagccgtggtgggcgcggccgtcgttcggcacgtgcgggtcgccgtgcatgatgtggcccacgccgtgaccgccgaactcgaggttgatcgggtagccgtattcgcgcgcgacgtcgccgatggtgttggagatgtcgccgagacggttgccgggcttggccacgtcgatggcggcggcgagcgcttcctcagtgcacttgatgatgcgcaggtcttcggggtccgggtctttgccgaccacgaagctgacggcggaatcggccacccagccgtccacagagatggcgagatcgagggagacgaggtcgccgtccttcaggctgtagtcgtacggcacgccgtgcagcacggcgtcgttgacggaggtgcagatgtagtgggcgaacgggccggtgccgaagtcaggagcgtagtcaacatagcaggattcggcgcccttgcggtccacgatcttcttgtggacgaactcgtcgatttcgagcaggttggtaccaactttggtggtctcctgcagttccttcagaatgccgccgacaaaacgaccagccggcttcatttcctcgatttcacgaggggttttcagttcgatcatgagattctttctaccttgttgagacttgttctcaactctagaccagcccgaggtcaaccgccagaagcctacctgaaatccactcgcagcccattaatagccaaggccgagaaaaagcgcccggcagcacatagcctgcacgggcgctttggattgattgtctggggactggttgcatgaagcgtgagattacttgcgacgcttgccgaaagtgaacgcgcgaatcactgaagtaatccccatcaccaccatggcgcatccgccgaagataatcatgaatacggcggagctcagcgggctcatcagcaccacgaagccggcgataatcgagatgatggcataggcgatggcccagccggaatgcgggatacgccacgattcaaccagcgacagcacgccttccataatccatccgaaaccgaccatcaaagtaatgagtaatgccagcgtctgaccggtcatgccgtagttgcgcacaaccaccacgccgccaaaggtcagcagaatgccgacgaacacgtccagcacacgccagccgcccggcagacccggctccacgagagcgctgacgatgcgcaccacgccggaaatcacgaaatacacgccgagcaacaatgcggccaaagccagcgtcttgttcggcaccagcaacagcgcagcgcccaaggcgatggcggccacgcccaccacgccgtaaatgatgcgaatcttggtcttggctttttccggcagccattcctcgatcaggcggaatggactgaaattgccgacataccagttggtctgctgccagccgggttgactttgatcgccccatggaccattcggctgcccgtccgcttggctattcgattggccgtccgcctgataccgccgaccgtccggcccccatgccggctggccgttcgggccatagttcggattgtaggcgtacgggccgtagtacgggttctggttcggttcgccttgtggctggccgttctgcgcatgctgattctgagtgtcttgcgctcccggcgcaccttgcggaggatattggccgccatgattgctgtcatacgcaccatactgcggttggcccggttgacccgccggattcggctggttcggctggctctggttgggctggcccgtctggccattccactggtcctcgttcggattgctcatcgtaactccttagctcaaggtccatgttcagattccacatactatgatagacaagttgtctaatttgaaccatcaccacaattaggcaatctgtctagttcactgacagcgcaatgcccataacgcaatatctgcaccatcaacgcttctcccccgccgcgattaggcttagggccatgaccaacgaaaccgaaacgctgacgtcgggcatcgacccggcatcgttctcctccgtcatcaagccgaccaacgacctgttccgctacgtgaatggcccatggatcgacacctaccgattgcccgacgatcgttcgcgctacggctccttcgacaagcttgccgaagacgccgaaaaccaagtacgcgacatcctcgacgccgacgactgcccggctgtcaagtctgaggccctgtaccgctcattcctcaacaccgacgccatagaggccgccgggcttgacccaatccgcgacgagcttgacctcatcgattccgccatcgacaaggccgcactcacgcgcgtgctcggcacgatcaacccagccggcggccccgatctgttcggcttggccgtttacggcgacccgggcgacccggaccgcaacatcgcccaccttgagcaggccggcctttgtctgccggatgaagcctactatcgcgaggatcactacgctcccgtgcgcgaagcatacgtggcgatggtcgccacccagctggtgaacgccggatacgcgcccgccgccgagtccaacggtggcgatgagctgccgtccaacaccggcgatgacgagagtaacgctcccgccacggttcccagcgaagccgcgctcggcatggcccgccacttccttgccgtggaaaccaagatcgccgccaaccattgggacaatgtggccacgcgcgactcggtgaagacctacaaccccaccgattacgccgatctggccgccacgctgaaaaacttcgatctcggttcttggatcgacgcttggcagaccgcttatgacgccaccgaagccgccaaggctcagccgattgatttcaagtctgtgttcgcgcgcgtcattgtgcacgagccgagcttcctcactggtcttgatgcgttctgggccgaggccgatctggccgaccttaagctgtgggcccgtgttcacatgattctgggcttcgcctcctccctgtctcgcgacttcgacaccaccaactttgacttctacggcaaggtgctctccggtgccaagaagcagcgcgatcgttggaagcgcgcggtgagcctggtcaacggcatttgtggtgaagatgtgggccgcgaatacgtgcgcctgcacttccccgaaagctcgaagcgccgcatggaagagctggtcgccaatctgattgacgcctaccgcgtgtccatcaccaattccgattggctgggcgaggacaccaaggccaaggctctggagaagatctccaagttcacgccgaagatcggctacaccaaccactggcgcgattattcggcgctgagtgtttccgcggatgcgctgcccgccgagaacgccaaggccgcgaacctgtacgagaccggctatcagctggccaaggtcggcaagtcggtcgacaaggacgaatggctgatgaatccgcagacggtgaacgcctactacgagccgagcatgaacgtcatcgtgttcccggccgcgattctgcagcccccgttcttcgacccgaaggccgaggatgcggcgaattatggcggcatcggcgcagtgatcggccacgagatcggccatggcttcgacgatcagggttcgcagtatgacggcgacggcaagctcaacaactggtggaccgacgaggatcgcaagaacttcgaggcccgcaccggcgcattgatcgcccagtacaacagctttgtgccgctgcagctggcagagaagtacgctgacgagtctgataaggcgccgcacgtgaacggcgcgctgaccatcggcgagaacatcggcgatttgggcggcgtgaacatcgcgctcaaggcgtatgcattcgcgctcggcaaggcggcaggtaagcccgacgccgaagaagacggctcccccgccgccatcaaggcactgctcgataccgcccccgaaatggacggattcaccggcctgcagcgcttcttcctgagctacgcctccatctggcgcaccaagaaccgcgacgagctggccgaacagtacctgcagatcgacccgcattctccagccgaattccgcaccaacggcatcgccagcaacgtggacctcttctacgatgcctttggcgtgaccgaaggcgacgccatgtggctcgcgcccaaggaccgtgtgagcatttggtaatccccgttatgtaagagaaaaccgctgtgcttgcctcgattacaggcgaacacagcggtttttcatgatgtatggttggcactcagaattcggattcgctgggatcggaagattcggcgaaaccgtcgacgtaggtttgttgggctgcggactgtggctgattagcgccagcgtccggttgcgacatgacggcatcggccacggccgcggactcggttgatggcgacggcgattggccggaatcggaggtgaccccaaattcgacggggccagattccgacgaggtcgcatacgggtcaatacccacaccggatgcggcaccgcccgcgccatattgcgttggcctaacgtacggcgacgatgctcgttgcccgtttccgccatccataccttcgacggcaccgttggcattgccgttaccgttgccaccattgcctccgttcccattaccggcacgctgtggcttgatcagcgacgtggtgccgaaggtcaggtcatgcccaatgttggtggcttcgagaacggttctactgcgcggttcgccttgctcattggtccactgctcggtgatgagtgagccgaccacaatgatgcggtcaccgcggcgaaccgaactggcggcgttcacggccaaagcacggaacgctttgacgcccacccatgcggttccgtaatcctcccattgtctggtagtcgggttgagtcgactgcgcgtgctgcccatacggaatgtcagcacgcggaagctctcggttccgcctagtgtcggatcaccggccacaaagccggtgacggtcactgctgcttgttgatttgccatgatcggtcctttcctcagcctgctggcctgttgtttggatgtggaccgccggagcctgtctccggcttcattgccggcttgcacgccccagcggtacctccactgtgaggcatgacgtttgaagtgcacaagggcaactggcaaatgtggatactgtgacgcagttgaatttttaagaatgtggataagtttcggttatccacagcaaagcgccattctgcgactgggcagaatggcgcttgatgcgattaacgccgaggctgagtaagtgggactcaactgagggcggcgaagcgctcggcgagcgcgtcggcggcttcggcggcgggcacggcgaccttgttttcgccgttgcggtcgcgcagttcgatggtgccgtcgttgacgtaatcgcggccgaccacggcgaccagcggcacgccgatcagctcggcatccttgaacttgacgcccggagacaccttcttgcggtcatcgtaaataacctcaaggcccttggcttcaagctcggcgaccagcttctcggcaccttcaaacgccacggcgtccttgccggtggccaccacgtgcacggcagccggggcaatcacggacggccaagccaagccggcttcgtcgtggtgtgtttcggcgatgcaggccagcacgcgggaaacaccgatgccatagcagcccatccacaccggcacggccttgccgttctggtcgagcaccttcaggtccagtgccttggagtacttgagacccagctggaacacctgaccgatttccacaccacgctcgaagctcaacggaccggaaccatccgggctcatgtcgccgtggcgaacctcaacggcttccaccacgccgtcgaccttgaagtcacggccgtacaccaggttgtagtagtcgacctcgttctcatcggcaccagtgaaccaagcggaacccttgaccacgtgcgcgtcgatcaggtagcgaaccgggttcttcacgccagcagcctcggcctgcgggccaagcaccatcggtccgatgtaaccgggcaccagttcggggtgctgcttcaggtcttcctcagtggcttcctcaagttcggcgggcgcgaactgggcttccagtcgcttcatatccaccgtacggtcgccgggcacgccgacgacaatcacttcacgccacggctcgtcatgctcttcatcctcagggtgcttgacggtgatcaccacgttcttgaggatgtcggaagcctgccattcacggccatcagtacgcgggtggtcggcgttggcacgctcgatcatgttatcgatggtcttggcatccggggtggcttccttggaagcggcgggagtggtggaagcatcgatttccggtagttccggagtgctcagggcctccacattccatgccttgccggaaggtgccagcgcgaaggtatcttcgccgatcggcatcggagccaggaactcctcggatgcggagccgcccatcgggccggacatggcgaacacaggtacgtacttcaggtcaagacgctggaagatacgctcgtaagcgccgcgctcgtcatagtaggccttgcgcatgccttcttcatcgatggtgaaggagtaggcgtccttcatgacgaattcacgaccacggatcaggccggcgcgcggacggaactcgtcgcggtacttggtctggatctggtacagggtgacgggcaggtccttgtaagaggagtacatgtccttgaccagaagggtgaacatctcctcgtgggtgggggccagcaggtaatcggcctcgtggcgatccttcaaacggaagatgttatcgccgtactcctcccagcgatgggtggcctcgtagggttcgcgcggcagcagggccgggaagtgcacttcctgggcgccgatgccgttgatctcctcgcggatgatggcctcgatcttgttcagcacgcgcagaccgagcggcagccaggtccagataccgggtgcggccttgcggatatagccggcgcgctgcagcagcttggctgaatcgacatcggcatcagcggggtcctcgcgcagggtgcgcaggaacatggttgacatacgaagggtattggaagtcatgtgttccacgatattcgcgtgaaccgacaagcccgcctgctattcgcactattccgaccttcatcttggcattcggactcactcgtgcaacaatgacggctagaagggtagaagggcacgatgacgcaaccgaccgagcaacaggggaatcagccggaatcctcggagcagccggtgtatcaaccggccccagcatgggccccgcaattttctgctgcagcccccgcaattcccaacggcagttccacaacaagcggtatcgcaacagccaatggccatgccaccgtttgcgcaatcgcctatgtcggtcccggaacaagcggcctgcccgtatcaaccgtaacagccgggccgggcctatgcttctccctgcccctacccgaatccggcaatggcccagccgaaccaaccatcagtcgcgcaagagcgattcgggcgttcgtcgggacggctgaccgcatcacaggttattgagacatgcgccaccattcttgccggcgtaatactcctcggtcttgcatggaccaacccgcaaccgtatgccccggtggatcttatcgccggcctgtccggagcggccgcgctgattgtgggtgtgcgtttgccgcaagtacgcccgatgctgcgtagctggccggcattgtggcttgctttgggcggcatcattctgattgtggcagccgcgcgctatgaggcgagcctcaaatcgatgaggacgattgccgcgcgtattggcgatctgcggtgaatcgcgcgggcgacctgaggcagattaccaacgtccggcgatagcagtcctgcatacggggcagtgcccattgccaccgtatccggcagataaacgattggcaatgattcgataccaatcgcgttccacgagcttggcccggcattcagggtttgggcaatacgtggtatcgccttcacgatcatgcacgttgcctgtgtacacataattgagtccctcttcgagggcgatgtctcgggcgcgggtcagagtctcgtgcggggtgggcggtacgtccatcatgcggtaactggggtggaatgcggagaagtgcagcggcacgtccggacccaagtgctcgcgtatccatgtacattcagcatgcagctgggcgtcgtcatcgttgaatccagggatgagtagcgtggtgagctccacccacacgtgttcgccttctggtgtgcgtgcctcgttgaccgcatagtcgatggtctcgagcacatcggccagatgagtgccggtcactttccaatagaactcttcggtgaagcctttgaggtcgatgttggcggcgtccatggccgcgtagaagtcgggccgggcttcggcgctcatgtatccggcagtcacggcgatgggatggatgccgagcgctcggcaggcttcggccgtgtcgatggcatattcggcgaacacgatcggatcgttataggtgaacgccaccgaatcgatgccccggtcggccgcgacctgcgcgattttctccggactggcttccatgccgagccggtcgaagctgcgggctttggcaatatcccagttttggcagaatcggcaaccggaattgcagccagccgtgccgaaactcagcacactggaaccggggtggaagtggttgagcggcttcttttccactgggtccacggcgaagccggagctgcggccgtaggtgtcggagacgatgagtccgtcgtggtttgagcggacgaagcaaaagccgcgttggccgggcttgaggacgcagcggcgcgggcatagttcgcagcgagcgcggttggtaccgtcgtggaattgcgtttgccagcgggctatggcggggttacgaacatctgtgactgacgccgtatgaccgcacgattcccgatgaccaccctccggcgcttcgcgccacctcttgccagcgggaggagatatggttgctgcgttaatgctcggcataggcggtcacctcgtagcgttgacagtcgatttcgctatcggtccagtcgtaggaagggcggataccggctttggcgagcaggtgagcgacgaaatcgtgcggatcgggcagctcatcccacacttgtggcaggaatgtggcgctgcggccacgacggtcggcgagaatcagaccgtctttgccggggcgtaatacttcctcaagttcagtgcgcgaacgtaccgggcgttcgacgttgctgccgtcccgtttgacggcgtcggtctgaggtccggattgcagcgatgccagagtcgcggtcttcgagccggtaccgcgcgaatcggcgtcacaggagttcactgtaatcggctcgggctcacccaagacggatacctccacgttgagcagcgggtattccgcggcggtgaccggggtgaaacgtgggtcgtgggtggcggcatccactgcgtgctcggccacgtccttgccgagcgagcggtgggcgaccagcgaaccaatgcacccgcgtagccggccaccctcggtcagggtgacgaaacaggcaccgggctcgttcagccatgggtttgcggcaagaatggacgcggtcgaatcagcggcggtcggatgctcgatatgcagccgttcccggatagcggcacgggcaagtttcagcagcacctcaccgtgggatggcgtacccgatgtgcctaagtcatctgcaccggctagagcatctgcttccggcttggattcccacgcggcaaacgagacatatcccactaccggctcgtcggcgtctcgcattgcggggcgaggttggccggcgagcgccaccacgccgtcgtcgccggaagtggaacagccgagctcgaagagcctcatgtccttgcggccttttaacacatccagaaggccgttgatcgggtatgcgccacaggcccggcgagggtgaatcggcagatgcaaagccgcaatgtccgcaatggtctggtcatccaacgcgcgggcgacttcgtgcggatgatagtgcgagagatccgaactaatcacgatgacggtttccgggccaccccacaaagcacgcaacacatcacccacctcttgtggcgtggcatcgcccgcgttcaacggcacgatagtgaggtctgggccgagcacggtctgcaggaacggaatctgcacttctaccgcatgttcttgtgcgtgggttggggcattgacgatcattgcgggagccggcgcgcccggacgggcatgtgtaccggagcgcaatggctcattgacagacaggcccagagccttacgctcggctgcaatgtctaccggcacagtgcccagcggcgtttcaaacgccgctgccgtggaacaggcgacgcctcgcacggccacgcggtgagtcggccctacgattaccgcgcgagtcacgctcccccgcccacgctccaagagcgcgtaagcgagcgcagctgccgtgccggaatatatgtatccggcgtgcggcactattaccgccctcggcacccccgctggaagtgtgggctccaactgttgcagaagctttcggccgtaatcgagctgctggttgattagctgtttgagcgcggtgcggtcagccggataaaacgaaccggccaccgctgacggacgtattgcgccagtgattttgccgctgccgtctgccgcgcttgctgcatctgacgcactagccacactgaccgtatcgatttgcacaccggctcgggcggcctcgcgaacctcattgtttccacgaaatatctcggatagcaccataactaccacctcttattccatggtagctgctacggagcgcttctaaagatcagaacaacgcgtcctgggcgaagtcatcgtcgggattggcaccgaattcgtccggctcggcgggtttgaacgcgtttgcaccttcatcggccaactggtcggaggccgcggccgaggcttcgcgcaggtcgccgtcgagcaccacggcatcgggcgagacgaggaacatgcgttcgttgacgccggccaaatagaggccgcccagcgattcgactcgggacagcgccacatatcccatgcctggcgcgaaggtgcgcttcaggtccatgaccgcacggtcaagcgtcatgccttgcgacttgtggatggtgatgccccacgcgcagcgcaacggcacctggaagacggaggcgagcacggtgtcgccgtccatcatctcccatgtggcctgtttcatggtgacgatgttgccgttctcgaattccacgatcggccagccgcccttgttctcctgtgcgaagccacgcacggtgccgagcgagccgttgacgtactggcgatcggtgtcgttgcgcagggccatgacagccgcgccttccttgagtatcaatcgctcgggggccaacatgttctttttgagtcggtcgaccaggttggcagggcctgctgtctcggcgtggaactcgtgtggatcaagcatgatctggttcaggcgcatgtcgttgagattgtcggcctgccggttcaccgggaacaggtggacggcgacctggccgggctcgggcagtttgcccagacgagtgacgagcacgtcacggtcggactgggtcacgtcgccttcgcgaatgtcggtgagcacggtcagcagttcgccggtatcctgacggtgctgttcggtcagatagcagatcaccgggttgagttcgggccataccagcgattcggtgatgaagccttcggggttcaagccggcacgggcataccgttcgcgactggcgatgaattcgggcgtgggggcgatgaggtcgcggttgcgcccggacaccgaaaccggcggcagctggaagaagtcgccggacaagacaacctggatgccaccgaacgggcgtggatcacggcgtacttcgcggcagacttggtcgaccatgtcgaacagccaagcatgcagcatggaaacctcgtcaatgacgaggatgtccgtggcctgaatcttgcgtttgcgccgggatttgatgagtttgagcaggctggcgctcagggcggtggccacgccgacgccgctccacgaatgaatggtttggccgttgatatgcgtggaggcgatgcctgtggacgcggtgactgctacactggcgccgtcggcccgagcctggcggatgaactcgttcaagacataggtcttaccggcaccgggcgcaccggtcaggaacacgttcgcgccggcgttcagaatggccagggcttcggtttggcgcatatcaacctctctagactcccctcagggaggggagccaagtacggcggactacttattgaggatgctggtggctacgatgtcggcggcgatggccttggatgcggcatcgtccgggccgggggcgggagccataaacgccttacggtagtagcgcagctcgtccaaggactcgatgatgtctgcgagagcacgatggccaccgttctttggcgggcggttctcgtacacggccgggtaccagcggcgggcgagctccttgaatgtgctcacatccacgctgcggtaatgcaggtggctcatgaggttcggcatgtaatggtcgaggaacttcttatcggagccgatggtgttgccggccagcagcgggcgcacgccttccggcgtgaagcgcagcacgtattcggtgaccttctgctcggcctcggccaggctcaggccattctcccactcgttgatcaggccggaacgggtgtgcatctggcgcacgaaatcgttcatatggttcacggccttctcggacggcttgatgacgtaatccacgccctcgtccagcacattcaggtcaaagtcagtgggcactacggacacctcgacgagttcgtcgccgccgaagatatccaagcccgtcatttcgcagtcaatccaaatcaggcgcgaatcctttgcgctgtaagtttctgcatcatggctgtcgaccatggtaagcctcttttcgtcatgtcacccgttattacaagaacagttcagactataccccagcgcatacaagctatctcgagccacatacgcgaaaagggcctgcataagcagacccttttcacaaggaatcaacccctaactagcgcaagctagcgggcatcaaccgatcagttgttgtggaagccggagtagttcggggcttcggtggtcatcacgatatcgtgcgggtgcgattcgcgcagaccggcgtcggtgatgcggatgaacttgccacgctccggcatctcggcgatgttgtgggcgccgatgtagaacatggactggtgcaggccaccgagcatctggtagagcacggcgttcagcggtccgcggtacggcacttcgccttccacgccttccggcacgaccttgtcgctggaggtcacgtcggcctggaagtagcggtccttggagtaggacttcttgccgcgcggggccatggcaccgagggagcccatgccacggtacagcttgtactgcttgccgtgcaggagcaccttctcgcccggggcttcctcacagccagcgagcgtgccgccgagcatcacggaggaagcgccagccacgagggccttggcgatgtcaccggagtagtggatgccaccgtcggcgatgcagggcacgccagcggcacggcaggcctgggcagcctcgtacacggcggtgagctgcgggacaccgacaccggcaacgatacgggtggtgcagatagagccggggccaataccgaccttgacggcgtccgcgccagcctcaatcatggcctgagcaccggagcgggtgccgacgttgccgccgatgatctgcacgccgtcgaaggcggagtcgtgcttcaggcgggaaatcatgtcgagtgccagacgggcctcaccgttggcggtgtcgaccacgagcacgtccacgccagcctccatcagagcggaggcacgctgccaggcgtcgccgaggaagccgacgccggcggccacgcgcagacgaccctgctcatccttggtggcgtccgggtactgctcggtcttgacgaagtccttgacggtgatcaggccggtcaggtggccttcctcgtcaacgagcggcagcttctcaaccttgtgctgggcgagcagacggtgagcgtcgtccttggaaatgttggacgggccagtgaccaggttctccttggtcatgacatccttaaccttcagggtgtcgtaatcctcggaggcgatgaagcgcatatcacggttggtgatgatgccgacgagcttgttttccttgtccacaaccggcagaccggagatgtggaacttgccgcacagcttgtcgaggtcggccagagtgacctcggggttgacggtcagcgggtcggtgatcataccggactcggaacgcttgaccacatcgacctgagcggcctggtcgtcgatggacagattgcggtgcagcacaccgataccaccgttacgagccatggcgatggccatctcggactcggtcacggtatccatggcagcggagaggaccggggccttcatcacgatcttgcgagtcagatgagtgctggtgtccacttcggagggaatgacatccgtctcgttcggcagcagcaacacatcatcataagcaaggccgagcttggcgaaaatcggaggaaggggagcatacgccgattgggcgttcaattcatcgaggtttgtagccatacaaacactatatgaacacgcgctgaccttcacgacacacgcttgtgagcgctcacttatccgctgccgggtcctgcacctcacccgcctgcgagtcccgcgaatccgcaggcgaatcagtcatcgaatccgctgcctgagagccaatcgaatcccggctctcccctactgcagactgcgacttaaccgtagcatgctgcgcgttcttgcgtgcggattcgagcgtcaggttctcggcttggatctcgggaatacgatgccgcagataggggtacatcgtggctatggtcagcaccaccacggcgatgggcatgcccacggccacatgctgcgctttgaagaacagaatcgtcagcgaaccgaatgcgatcagcgcggcccatccccacaggatcagcacggcgccacgcaccgaatgcccgatcttcagcatgcgatggtgcaggtgcatacggtccggatgcatgggcgactggcctttggccaaacgccgcacaatcgccagacacatgtcgagcacaggcaggaacaacaccagaatcggcagcagaattggcatgaacaccggcagatagatgctggcatgaatcgaggccgggtcaagacgtccggtcatcacaatcgaagcgcaggtgatgagatagccaagcagcatcgaaccggaatcacccataaacagtttggcgggatgccaattatgcagcaggaagcccacgcagatacccaccatcatcacgtcgatcagcgtggccaacgaagcataactcggggaagaccgggcgatgatatacgaataggcggcgaacgctatgccaccaatcgccacgataccggccgccaggccatcgaggccatcaacgaaattgaccgcgttaatcgaggcgacaatcaggaatgcggtgatcgccatggacagactcggcgaggcggtaatcagcgaaccgcccaaaggcagtgagatgatctgcaatccgccccaagccacgaatacggaaatcagcagctgaccggcaagtttcagcatccaatcgagatcccacaggtcatcggccatgcccagcagactgatcatgatgccgccggcaagaatcacccacatctggtaattgccgttgaacaatcccgagagaaaaggcagccgactggcgaatacggtagccacggcaaaaccgatcagcatgccaaggccacccatgcgcggcgtgggaatggtgtgcacgtctcgggcacgcacctcgccaaccgcaccgatttcgatggcgacgtggcgaatcagcggagtcaccagccaggtgacgccaccggcgatggcggcaatcagtaggtagattctcatgcgccgagtccaccgccgttgaggtggagggccttgcgaatcacgttttgggcgatgacgccttcacgcaggatctcgatgccgtcgcgcgcgtacggatcggctttgacgacggtgctggagacatggccttgggtgggaccgccgtccagatacaggtcgacttcgctgccgaacgcgtcaaccgcctcctggacggtctgcgcgctttcgtcgccggaacggttggcgctggacgcggccagcgggccagtcgccttgagaatcgcgaggcacagcgccgaattggggatgcggatgccttgcgtgccggggcgaccatcggcggtgtcggccaaagtctccaacgtgcagtcgggccgggctacggcaatcggcgagaacgcgccaggcagaaacgccgccgacaaacgattcagcggggacggcaggtcgagaccgagctcatcaagctggtcggtggatgcgagcagtacctgcaacgccttatagcgcgggcgacgcttgagccggtagatacggtcgatagcggccttattacgcggatcgcacgccactccatataccgtatccgttggaatgacgaccaatccaccatcccggatgacacgcgccgcctgtgccagcgattcatccgtgactttcagcgttgttccgccttccacgctcacgccacctccgttcgcttgtgtattcacaatctaccattgcaccattgcgccccgacttgcatagttcatcatcgctcgtttgccgtactgccgttttccgattcgccccacacgcacagaccgtagatacaatgagtccatccatgctctttcgcgaaattacaggagtgttcaatgagcgaaatcaatgctgaatccaccaccatgcctcccgtcgaactgcgtatgccgcgcgccagcgagcgcgaggagatgctcgccggcaaactgtacaattcggtagaccctgaattgaatgccctgcgcgagaaggccggcgacctgtgcgcgcgcttcaacgccgcgtcgcgtaccgatcatgccgcccgtgccgcgattctcgatgagctgctgcccggccacggtgccggccttgacgtgatggggccgattttcttcgactatggctgcaacatcaccatcggagagcgcgtgttcgccaacttcaacttcactgtgctggattgttgcccggtgacgattggcgacgacgtgctgttcggcccgaacgtttcgctgctgccaccgatgcatccgttgcgttggcaggatcgtaacgtgaggcaggcacctgatggttccgcatacgactgcgagtatggcaagccgattgtcatcggctcgaactgctggtttggcggcaatgtgacggtaatcggcggcgtgacgatcggcgagggttgcgtgatcggtgccggctcggtggtgacgcgcgatattccgccgcacaccgtggccgtgggtaatccggcccgtccgattcgcgagattacggataaggatgcttccgcgctacagtattacgcgcagtgatatatgaatgctcccgctggcgagctgtcagcggagctgactgagggtggttgccggaaatctccgataaccaccctcagcctcacttcgtgaggtagctcccgccagcgggagcatagtaatgtgagacgtcacgcgccgaggtacgccttgcgcaccttctcgtcgtgcagcaggtcggaggccttgccctccatggtgatcttgccggtctcgagcacgtaggcgcgatccgcgatggacagggccatcttcgcgttctgctccacgagcagcacggtgatgccacgcttgcgcagcgtgacgatgatgtcgaagatctccttgaccagcagcggggacagacccatcgacggctcatccatgaggatggtcttcggatggctcatcagggcgcggcccatggccaccatctgctgctcaccgccggaaagcgtgccggccagctggcggcgacgttccttcaaacgcgggaagtagtcgaacaccatctcaagatccttacccagactggactggtctttgagactgaacgcgcccatctctaggttctcctgcacgctcatgcgggtgaacacgtggcggccttccggcacatgggccatgcccagcgtgacgatcttgttcgcatgcgttttgagcagatcgtggccatcataggtaatgctgccggatttggcaggcaccagaccggtgatggtgtgcagggtggtggtcttgccggcgccgttggctccgatcagggagacgatctcgccgtcgttcaccttgaggctaatgcccttgaccgcgtcgatcgcgccataggaaacgcatagatccttgatttccagcatcagcgcgctccttccgtcagtgtcttggcaatgcttggctccggttccgccttggtggtggaatcgccgtccgcgtcatcgttgttgtcgctgcccaagtaggcggagatgacctgcgggttgttggcgatctcctccggcgtgccggatgcgatggtgcggccatagtccagcacctggatgcgctggcatacgctcatcaccaggctcatgtcatgttcgatgagcaggatggcgataccgaaacggtcgcggatcgtgttgatacagtgcagcagatcctcggtttcggtggggttcatgccggcggccggctcgtcgagcagcagcagtttcatgccggtggccagggcgcgtgcgatctcgagcttgcgctgctggccgtacggcaggttggccgcctgggtggtggccagtccctcgaggttgaagatgcgcagcaagtcgatggccttctcgtgcatctcgttctcctgcttccagaagcccggggtgcggaagatggcgctgcccatgtggtaggtgaacgactcatcgaaggcgacgagcacgttctcctcgacggtgagctgcttgaacaggcggatgttctggaaggttcgggcgatgccggcacgcacgacctgataggtcttcttgccgttcatccgggttccgtccagccagaactcgccttcggtgggcttgtacacgccggtcagcaggttgaacaccgtggtcttgccggcgccgttggggccgatcaggccaatgagttcgcccttgttgatggtcatgttgaagttggacacggctttcagaccaccgaaggtgatgccgagatgttcggctttgaggatgggctgggttgcgtcgctcatcgtgaggcctccttcacggtcttgtcgtcggactggtcatgctgcttggcgctggccgcgggtttcgcgcccttgccggcggcgccgcggaacagcatgcggttgaccagacgcggcagtgagaactcccaggatccgaagatgccctgcgggcggaagatcatgacgagcaccagcaccaccgagtaggcgagcatacggtagtcggcgaaggcgcgcagcagctcgggcaggatggtcaggccgatggcggagacgatcgagccggtgagcgaacccatgccgccgaacaccaccatgatcacgtagttgatggagttgagccaaccggccatggtggggttgagcgagccgatgtactgggcgaagataccgccggcgatgcccgcgaagaacgcggagatcgcgaagacgagcaccttgaggtacgtggtgttgagtccggaggcgccggcggcgatctcgtcgtcgcggatggccttgaccgcacggccgtaacgggagcggccgaacatgaagagcacgaccacggtgaccaccatgatccagaacacgacgtacaggttggcggtgcgttcgatgccgatcagcgcctgtccggcggcgcccttgtcgaggcccatgccgccggctaccttgaggttctggatgatcacgcggatgatctcaccgaagcccagcgtgatgatggccaggtagtcgccgtgcagtcgcagggcaggaatgccgatcaggatgccgaacacgcaggccaccacgccgccgatcagcgtggtgagcaggaagcgggcggtggggtcgatggcaatgccggcggcgaccatgtatttggaggtcagtgcggccacgtaggcgccgatggcctcgaaaccgcagcatcccagcgtcagctggccgagcacgccgatggtgaggttcagggaggtggtcatgatgatggcgatgcacgcggtcatcatgatgcccttgatgtaggagtcggccaagccggattcgcacagcgccatcacgatgccgaacgcggcgaggatgccgatgaagcacacaagataggactgtttggtggaaagcattgtcttcttcatctgatcagaccttctccccttcgttcttgcccataatgccggacggtttgacgagcagcacgatgatcaggatggcgaacacgatggcgtcggagaacgccgaggtgatgatgcccgccgtgatggtgccgatatacgccttggtcaggctttcgatcagaccgatggccagaccaccgatcatggcgcccgggatggaaccaatgccgccgagcacggcggcgacgaacgccttcaggcccagcatggcgcccatcataggcgagacctgcgggtaggcggcgcagtacatcagcgaggcgaccgcggccagaccggagccgatggcgaatgtcagggcgatggtggagttcacgttgatacccatgagcacggcggcctccttgtcttcggagacggcgcgcatggccttgccctgcctggtgaatttgacgaacagctgcaggcccaccatgatgaccaggccgatgacgatggtcagcagggtgtctcccggcagcttgagcttgccgaacgcgatggacggcaggtggaagatggtcgggacggtctggaagtcggcgccgaagatggcctgtgagccgttctccagcagcaacgacatggcgatggcggtgatcagggcggtcatggagttgcccttttcacgcaccggcttataggcggccttttcgacgatcacgccgacggccacgcataccaggatggcgggaatgaccgccacccaggcgggcagtcccatggccacgatggccggaatggtgagcatgagcacgtaggctccgaccatgatgaaatcgccgtgggcaaagttgatcagtcggatgatgccgtagaccatggtgtagcccaatgccaccagcgcgtacacgctgccgattttcagaccgttgaacagctggctgatgaacatgatgatctgatcggtcatagctccccctttctatcaatgttgtggttctctaccgctgcgcgcgtagagatattcgtatgtcttgcgattgatggcgcgatacgcccgcgcctggcgatatccgcatatcgacggctgtccttatgcatccgagcccatgaaaacacgaaagggagaggaccggcaaaaccggtcgctctcctgttcatgcggaagtcatgctaggacatcgtgattatgcggtgggaattcatggaattcacttgggctgcacggtggtgttgtacaccggcttgccgtccttcatttccagcacggtcacggacttggtcggcgagccggacttgtccatggtgaacttgccggtcacaccgtcgaaggtcatgccggccacggcgttgcgcacatcctcacgggtggcgttctcgccagccttctcgatggcctgcttgatcatgtagatggtgtcgtagcccagagcggcgaacgtgttcggctcggcgttgttcttggacttgtaggacttgatgaagtcctgcaccttggtgttggtgttgtcgtcggcggagtagtgggtggtgtagtaggtcttgttgtactgggacttgtcaccggtgagcttgaggccatcgtatccgtcgggtcccatcacgtagccctcgaaacccacggagcgggcctgcgggatgatgtacgggccagccacggagtagtagtacggagcgtagagcagctcggcgccggaagcctggatcttctgcagctgggcggagtactcggtgtcgtcggcggaggaggagctttccttgtccaccacttcgaggccgagcttttcggcggccttggcgaaggcctctcccacgccggaggagtacggatcgccggtgccgtagagcacggccaccttcttgaccttcaggttctcggcggcgaagcgtgcagccacctcaccctggtaggagtccttgaagcaggtgcggaacaggtaattgccggtttcgatggagtcggaggtggcggccggggcgatggtgaccagcttggactggtcggccagcggggccacggctgcggtggtggcggaaatggtcgggccggccacggcgagcacgttgttgtcgccggcgagcttgttgtaggcgttggaggcttcggtggcgtcgcccttgtcgtccatggactcgagcttgaccttcttgccgttgatgccgcccttggcgttgatctcggagaccgccagctcgaagcccttgacctcggcctcgccgtaagcggcggcggtaccggagttggtggtcacggtgccgatggtgatggagtcgccggaggccttggcactggagctggaggaatcatccatgctgccgccggagcagcccgcgagggacaacgccataacagcggccgcgctggccgcaacgaacttagtggagaacttcacgttcatcctcttccttcttccttgggatatttcaacatcgttcatctgtcaaccaacgcgcgggatgtgcgcgtgagacgttccactcacataattcgcataccacagaactacatcacacggcttgtgaccgtcattcacgtctctctcatccgatgtttgtcgcggactgttataaccagaccggctttgaacccgcaataaattgttcttattatgagacagcgcaattacggaaacgagaatacaatcccaaggaaatgtgggattcgtggggcttaggacactgcaaacaggtagcggtcgcgacccgtccagtcctggccggtcgatgcggcagcgaatccggtggccctggcaaaggccacgagacgatccccctgggtcacgtcatgttccatgacaagcacgcccccaggcttgagaagacggcaggcccgctcgataatgcgctcgggaatcaacgtaccgtccatcgagccgccatacaaagccaattccggatcccaatcacgcacttccggctgctcgggaatatcggtctgcggcacgtaggggggattggtgatgacgatatcgacggtgccgtccaattgggccaatgtggcgaaggacgtggcatccgcgatttccagatggtaattcgaggcaatggatgggtactttttcgcggtttccgacagattccttcgcgtccattcggcggtgttcggcgacagctccaccgcccacacctggctgccgggcacctcgctgacaacggacagcccaatcgcgccggagccggcgcacaaatcgaccacacaaggatggatcatgccgttttttgtcagccagtcaaggccggcctgcaccacggtttcggtttccggacgaggaatgaacactccgggaccgaccttcaggtcaaggtagcggaaaggagcatgcccggtgatgtattgcagcggctcgcgcttggcacggcggtcgagcatggcacggaagacggcaagctgtccggttgtgccaagttcctcccccataagcagagccctgtcgacgtcgcgcagttcaacgcctgccgcctcggcaaggagcaacttggcatcatgctcaggcgtctcaatacccgcttcgcgcaattgcgaagaggcttggttgatgatgtcggtaataagcactggcggtctccgttgatcggacattaggctcccctcagtcagcttcgctgacagctcccctcacagaggggagccatccggcaaagtcatttctgattggccagacggtcggcctcgtcggcttggatgtcggaatcgatgacggcctgcaggtcgccgtcgagcacggcgtcaaggttgtaagccttgtaattcgtgcgatggtcgacgatacggttttccgggaagttgtatgtgcggattcgctcggagcgatcaagcgaacgtacctgcgagtgacgcatgtcggcggcctcggcggcctcctgctcatgcttcatggccagcaggcgggacttcagtacgcgcaacgcggcggcacggttctgaatctgcgacttctcatcctgcatgttcaccgtgattccggttggcaggtgggtcatgcgcacggcggaatacgtggtgttcacggactggccgccggggccggagctcatgaagatgtcgattttcaggtctttcggatcgatctcgatctcgtcgtcatcctcgtcggcctcggggaacacgatgacgccggcagcggaagtctggatacggccctgcgattcggtgacggggatgcgctgcacacggtgtacgccgccctcgtacttcatcgaagcccacacgccgtcttcgggagcgggcgtgcccttggcgcggatggcgatctgcacgtccttgacgccgccgagctcggtggtgttctcggactgcacgttcacgctccagccacgcttctcggcgtaacgggtgtacatgcgcagcaggtcgccggcgaacagtgcggcttcctcgccgccggtgccggccttgatctccatgatggtgtcgcgcgcatcatccgggtcacgcgggatcagcgcggtgcgcagcttctcctcgacaccgggcagttcgtcttcaagacgcttggcttcctcggcgaagtcggcgtcctcgccggccatctcctgagcggctgccagatcgtccttcacctgcaaccaggctttgtaggcacccacgatggcacccagttcggcgtgacgacgacccagcttgcgcagcttgtccgggttggacacgacttcggggcttgccatctgttcttcgatggactggtactcctcaagcgcggttgccgccgccgggaactgttcgtctgccataacacactttcttctgtatggtgctgttctgttcgattattcgattgcgcaggtcaatgctgcaacaaaacttgtcaaagaatacaaaaaacgccagtcctcgatcgggtatgccggagcatgccaaatcgaatcggactggcgtgaagtatgctacttgctcttcttgccgtagcgcttctcgaagcgagcaacgcggccaccggtgtcaagaatcttctgcttgccggtgtagaacgggtggcactgagagcacacgtcaacgaacatgtgatcttccttgccagcggtgcgggtcacgaaggtgttgccgcacgagcacgtcacctcaacggggtgataatcaggatggataccctgctgcattttacgtctcctatggattcgggggacccgggtcgtcatgcccctatggcaagacgtgaaccggaacctaagggattgtacacgcctatctggacgtgaagacgcgctgcgccgccgcaggagacgacgcaaaagagtggggccgcaggggcttgaaccctggaccgggcgattatgagtcgcatgctctaaccgactgagctacggccccacgttcgctgcgtaaaacagccaacttgccaaagtgtagcacgagcccgctaatgccggcacgcgcgccatgcacccataccatgcacccgccagcaacaagcagcatctcccggcgctacttctcccccatgtaccccaacgggttctcgatgaaccgtcgcaagcccatttcggccgcgccatatagcgagggatgcagcgccaccggcggcacaaacacgcgaatcttcacattcgggtatcccagaatttccgaacgcagccggccttcaagcacggtggccagctcgtcgccgaagtgcgtccacagtccgcccaacagcaccgtatcgacatccaccagattcacggcggaagcgatggcggaaaccagcgcatcggcggcctgatcgaccactttggccacatccgaatccccggctcgccaacgctggaggaacatatcgatggcctcgctgctggtggcatccccatcctcggcaatgccggcagcctcgaccaaagcgcgacggcccgcaaacgcctcaagacacccgtgacgcccgcagctgcacaacggcccatccatcgccacggacagatggccgatctcgccggcgaatccgtgcgagcccatcaccacttcgccgtcgcgcaccaccgcgccgccgatgccgatatcggtagacaggtaaataaaggagtccgtgcggtccaccacattcaggaagggcgcacgttcggtggcataccccggaatctgagcgatggcggccatcttcgcctcattgccggccaccacatccagccggcgcaccacgttgaaccgggtgaggttgacgttttcccaacccagattgcgggccaccaacagccacatgtcgtcggtgacgatgcccggcagcgcaaacccggctcccaccaccttgcagccgcgtcgtttgagccggctttccaacgggaaagtcatcgcatcgagcttggcgaagatctcgtacgggtcagtgccggtcatatcctcactcacccactcccggccgagagtgtcgccgttcagatcgagtgccaggcaaccgtaaccatcggtgttgatctgcaggccgatgccggcgatggatccgccgcgaatctccagcggcgtgctgggccgcccatatgtggtggaaacgaccggctcgccttcctgcaccacgccgctttcaatgagcatcgaggccaacagcgagagcgtggccttggtcaggcccgtctccttggccagatcggcacgactcatcggtttctgcgcacgcaataaggtgtcgagcgtcaccgacaggttatggttgcgcagatcctcctgattgatcctgcgtagatttgccattggcccctacctcctcgcacccctagtctcgagcgccgcacaggcgctcacatccgtctatcacaccatgatattgtgcgtcaaacgattgaatcggaccgcaccttcgcgtgtttccgtttgcaatcgaacgttgagatacagtatagtttaatcgtctaacttattggctatggcgcgccgaaacttttgagcgcgaccctcatcgaggaggaatgcatgacgagagtactggttgccggcgtagatacgtcaacccaatcaacgaaggtccgcatcacggacgccgccaccggcgaacaggttcggttcgggcaggccaagcacccggatggcacctcggtcaacccggaattctggtgggaggccttcaccaaggccgccgagcaggccggcgggcttgacgatgtcgcggccctcgcggttggcggccagcagcatggcatggtcattctcgacaagcagggcaacgtgattcgcgatgcgatgctctggaatgacaccagttccgccccgcaggccgccgccttgatcgacaagctcggtgcagctccggccgagggcgacgaaccggacgacgtgaccgcccgcggcaagcaacgctgggtcaaggccgtcggatcctcccccgtcgcctcctacacgctgaccaaggtggcgtgggtggccgagaacgagcctgagaacgccaagaagattgccgccgtctgtctgccgcacgattggctgagctggcgtatcgccggctatggcccggtggccgagggcgaggacgctcatctcgaagccctgttcaccgaccgttccgacgcttccggcaccatttactacgatgccgcgcatgacgagtaccgccgcgatctcatcgccatggtgctggcccctgccgagggcgaggaagccgccaaggcccacgccgacgccattgtgctgcccaccgtgctgggcccgcgtgaggcagccgccgtcaaggccgaccccgccattgccggcaaggacgttgaaggcggctgcatcatcggccccggcggcggagacaatgccatggcctcgctgggcctcggcatggccgtgggcgatgtgtccgtatcgctcggcacttccggcgtggccgcggccatcgctgaaaacccggtgtacgacctgaccggcgccatttccggctttgccgactgcaccggccactatctgccgctcgcctgcacaatcaacggttcgcgcattctggacgccggtcgcgccgccctaggcgtggactacgacgaactggccgaactggcgttcaaggccgagccgggtgccggcggcatcaccctggtgccgtacttcgacggcgagcgtacgccgaaccgtccggacgccaccgcctcgctgactggcctgaccctacacaacaccaccaaggagaatctggcccgtgcgttcgtcgaaggcctgctgtgttcccagcgcgactgcctcgagctgattcgctcgctgggcgccgagatcaaccgcatcctgctcattggtggcggcgcgaagtccgtggccatccgcacgctggccccctcaatcctcggcatggacgtgacccgtccggccaccgacgaatacgtggccatcggcgccgcccgtcaggccgcctgggtgctgtccggcgaggccgaaccgccgacctggcagctcaccatcgagggcgtggagaccggcgagcccaccgaagccgtgtacgaggcgtacgccaaggcccgcggctgatacgctgccagcaaatccatgagataacaactgaataacgattcctgatgaatgccgccatggcgagcatcgcgaagagccgctgttataccgcgctcctcgctgaagcacacatggcggcatttttcgtttcccacgcaatccacaaatacggctataatcaagtcgtttgaacaagtctggagatgatcctatgaacgaccgctcccgtatgatgctgtacgccctgaccgccgtcgcctgcgtgatgtggatatggcagtctgtcaaagagtcgatgaacgacggcacgatcatcagcacttcgaacatcatttttctggtatgcattggcatcgcggccatctactgcgcggccaacgcgctaatcctgtggtggcgccagcccggcaaggatgacgcggctgatgacgacgaaaccgacagcacggacgccgaggccgaagccgaacaagccgaagaaaacgaacacgacgacgttgccgacaccgcagacaccgacaccgcagacgccaaagaaaaccacaacccacagcactaaaggaacatcatggatgcaaccacattgtcaataaccctcagcgcgatattggccgtcatctgcacaccttgcggcctgtttctggggcttgttcccatgaaggccgacctggtgaccgccaagcagtcaaaggcctcgcagatggtgagcttcatcgttgccatagtgttcatcggcttgctggtcgcaggccatgatctggagacctgggccatggtaatcggtctggtcatcggcttcgccgttgccaagatccccgcactgcacgcctgggctttgcacaagtggccgttcttcgaacccaagaaaatggctcccacccccaagcgcgtcaagaaagccaggaagaagtaagctctggccttacctattcgctgaaagcgggatatcgacatcggtatcccgctttttcattggccgcacatatccgctgaggcacatcgccgaatcatattgtcgaaatacaccccaagtcagggctgatttcgcgaagaacgtacaccgggatccatccatcgcgacaaacggaaaagggacgctgcgtgcaacagcgtccctttcggaggaggaatggaactcaggtccatccccgtggccaccgggcgggcccggaggccaggtttagctcagcctttctttttcttggagagcaggtcgtaggcgacggcggcgatgacgacgaggcccttgatggtcttgacccaggcggcgtccacgcccatgatggacaggccctggttgagcacgcccatgatcagggcgccgaccatggcgccggggatggtgccgatgccgccggtgacggccgtgccgccgatgaagcaggccgcgatggcgtccatctcgaactcatgccaggcctgtctcgttaagtgtgtaactggcgttttcattgttgtgttccctcgcttggccagcggtcggcgaaggtgatggcaaaggcgttgagcgcgggcttccagcgcgcgctccatcgtatccgtcccttgccggtggggtccagcgagcggacggtcaggtacatgcacttgagcgcggcctgctcgtcggggaagtggccgcgggcgcggatggagcgcttgaatctcgcgttgagcgattcgatggcgttggtcgtgcagatcacgcgccggatctccacgtcatagtccaggaacggtatgaaccgttcccacgcgtccatccacagcctgcggatcgcgggatatctcgcctcccacttgtccagcatcgcgtcgcgggccgccgccgcggcggcggcgctcggcgcggtgtagatgggtttgacatcgcgtttgatggcgtcccagtccttcttcgacgcgtagcggaacgtgttgcgcagcagatgcaccacgcaggtctgcacgatggccagaggccataccgcgcccaccgcgtcgggcaggcctttgagcccgtcgcagatcaggaagaacacatcgtccacgccccggttcttcatctcggtgagcaccgacagccaatagcgtgcgccctccgcggcgggcgacgcccagatgcccagcacgtcgcggccgccctccagatccacgccaacggccacgtagaacgcgcggttggcgacctgcccgtcgcgcaccttgacgacggtcgcgtcgatgaacacggccgcgtacacacgatccaggggacgcgagcaccattcgtccttctcggccatgacccgctcggtgatgcgactgacggtctccctggacacgtccgccccgtagatctcctggaagtgggcgctgatctcgccggtggtcaggcccctggcatacagggacagcaccacctcgtccaccccgggcagccgccgctgccgtttcctgacgacgaccggctcgaacgagccatcgcggtctcgcggcacctcgatcctgaccggacctaccgaatcggtgaccacggtcttggcggtggtgccgttgcgcgtgttcgcggccctgccgtccttggatttcttgtgcttggcgcggcccaggtgctcggtcatctcctcgtccagggccgtctccagcacgcttttggtgaactgtttgagcagtccgtcgggccctgtcaggtccagtcctttttccttggccatgcacacgaatgtgagcgccgcctcccgctcggcgttgcgtttttccgcgtccggcttcttcgtcggtgtcatgtttccccttgtcccagcagacatcgtccaccagcctttccgaccggccacacgaccggccagttaaggccagttacacacttcgagagacagtcccgttcccagcggaaggagagaaaggagaaagaaggaatggaaaggtgccatgcgggcataacacaacaccgcacatggcgaaactatcgaatcagcccatcgggcgcactggcatcataattgatgtgtacacgcccgatggagcgaattcaatcggtcagaccgatggtcactcgacctcagccagggcatcaatgatgtagttgttgatggtggccttgacggactcgaggtgatcggacttggtggcggcgatgagctcggactgcggcttgtcgaggctgtaggcttcgaggtcggccaaggtgacgttgccctcgtcgatgtccttgccgatgccggagtcgtaggagctgtagcgctcggcctgaagattctggatgaagccgtcctggttcatcttgtcggcaaccagcaggccggcggcgtaggcatccatgccggcgatgtgggagcggaacaggtcctcctcgtagaaggaggtacggcgcggcttggcgtcgaagttcagaccaccgtgaggtccgatggagccggcctgcaggacttcccacatgacggcgacggtctcgtacagatcggtcgggaactcgtccatatcccagccgatgagcttgtcgccctggttggcgtcgagggaaccgaggaagccggactcgcgggccacgcggatctcgtgctggtaggtgtggccggccaggttggcgtggttgccttccaagttcagcttgaagacgtcggtcaggtcgtggttgcgcaggaactcgatggcggtggcggcatcgaagtcgtactggtgcagcgtcggctccttcggcttcggctcgatcaggaactgggcctcaaagccgatttccttggcgtaatctgcgcacatgtggaagaacttggcgatgtggtcggtctcgcgcttcatctcggtgttccacaggttctcgtagccttcgcggccaccccagaacacgtagttctcagcgcccaggcgcttgccgatctccaagctcttcttgagctggccaccggcgtaggcgtagatgtcggcgaacggagaagtggcggcgccggacacgaagcgcgggttggtgaacagggaggaggtgttccacagcagcttgacaccggtggacttcatattctcgtcgatcttgtcaacgaccttgtcgaggttggcgttggtctcgcgcagggtgtcgccttcgggggcgatgtcacgatcgtggaagcagaagtactcgacgcccagcttctggaacagctcgaaggcgtagtcgaccttggccagagcctggtccatcggatcggtgtacttgtagtacgggcggtgcgcggtgccggtgccgaacggatcaaccagttcctggttgaaggtgtgccaccaagcaacgccgaagcgcagccaatccttcatcttcttgccggcaacgaccttgtcggcatcgtagtaatggaaggcgaagtcttccttcggtcctttggcgcggccgacgtactcgatcttgtcaacatcccacagacccatttgggcgctcctttgcagtaggcgatattacggattgcaggaccaataataaaacgaacgaactaagtttgtcaaatgattgaattaatacgccgcgtctcagcgtgttgctagtcattgcaatggttttcgaatgcagtcaaggcacagatagtatgggcaagccaagaaagacaactcagccaaggaaacgagacttgataattgacgtcacgcaattcctcgccggccaccgctgaggccggctccaccaccccgccaactccaacagcaccacccccgccaacaccaccgccatggtcatcaccctgatgatcggctcgtttgtggccatcctcaaccaaacgctgatgatctccgccctgcccacgttgatgcacgagttcgacgtgcccagcagcaccgtgcaatggctgaccaccggattcatgcttaccaacggcatcatgatcccgatcaccgcgttcctcatcgagaccttcaccacccgccagctgttcctgtacgcgatgggcatatttgcagaatgatcttggcgttaatgcactggtgtccggtctggtgatgatgccgagcggcatcgccatgggcatcctgaacccggtggcaggcaagatgtatgaccgtatcggtggccggccgctcgccttactgggcttcgcgatcatgacgtctgcggctgtgctgctggtcaccatcatgaacacgcacaccgcggcggccatgcgcaccggagtgccggaagcggcggcatcggccattggcgtgcgggcttcgttccgcacggtcgccattgtgtgcgcggtctgtttggttgcgtcactcttcattcgtgatcgcggccgccgacttggacagcagcgttaggcgaatccttcaccgattgctggccttcttgatcagcgcgtccaaagtaccggcttggcgcgcggcttccacatcttcccagtcgagaccggtgtctttggccctcccgtagaaaaaccgcaccagaccggcaaagtccggtttatatccggtttcccggaatgaacgggccagcgaatcaccgatttgcgggtcatcaggccttcgtgcctcatagatcgggatggaacaggatcgccacacgcctctcacatgtgcgatgcgattgacgatcatgccgccgtgcgcaccatcgtattgcgaggcggcatgtacgtccgccacctcgtagacaccaccatgaatgatgtcctcaactgtcagacgacctttgaccgcgctggcatcgcgaatccagaacatcgaagcgaaattggtgtcatcaagttcgcgaaaatcacgtatctcgcgtgtgccgatacgttcgtccttgtcatacatgaattcggccaaggctaggaatggcgagatacctgcgcccggaccgtactgcaattcgatacgtaaatcttcggattcattgccggtcagtccaataccgctgacggcgcagtcataggcaaaccaatcccagaaccaccattcgatcctttgcagcacctgcttcggatactttttgcatgggttcagattcacttcgcgataatatatgcgtctcgcttcggcatagacggcgagattgcagcgtttgaacatctcggctacgtctttggtgtccagcattgctggcaaaccggcattttcggcagtagtagtgattgcggtgctcatggtgtttccccttcatgtgatgtggacggcgggctacgttgcccgccgtgaggcacactgtatgacgttcgtgcggtggctcgcaagcccacatggcgagatggtggataagtggaaaacccaatgattccaaggggtatggaatgtgcataacagtggctaccgtcggtggataaccgcactttcttgcaggttatccactgatcgcgcagctgttatccaccgtctctgggttatccacatcgtctctggcgtgtcgtccactgtcagcagtcgatttctgcttcgtttggcgtgtataagtgcacggtgaagtgtataactccgcgcattaggcatatttgctactgagaaaggtcccgaaatcgccttcgaacgcatagctacactcagcagatgtattcagcatggcaatagacccacttaggcaccagcgaatgatttccccccgcttatagagtcggcaaaggcccaacacctgtcccaacgccgacgctactgcactggcagcgtcggcagaggcccacgacttggcacagcaacgacgctaaaaccgcccagcatcgttacacgtccaagttttggccgctaacgacgcttaatgaacgcttagcgtcggcagcaggtcacgcactggttctccaccgacggtagcgctccttagcgaagccagcccgccactctttggcacatcaccgacgctgagagaacctccagcgaagccaaccagccaaccgctggcgacatgacaccacccacacccctcagcgaagccaacctgccagcgcatggcaccccaacaccgatgagaacacccaccccaccagtgcacaaaaaggctggtcatagcggttgcgatgtaatcgcatcgtaatcgcgatgaccagcctcgggagttgggctgcaatgagcaccgatatgaatcagataatgatgccgttgcagtgatcgacttcatgctggataatctgcgcagtccaaccggcgaaggtggcgtggcgggcgcggaaccgacggttctcgtagttgacctcaatacgtcgataacgcagcgtgcggcgttcgccggtcagggacaggcatccttcctgggtatcgaaggcaccgtccgaagcggtaatcacggggttgagcatcaccgttatgcgcccgccaaggtcttcatccacaaagacgatgatgcgtttgcctacgccaatcatgttggcggccatgcccacgcaccgtgaacggttggcctccagcgtgtctacgaggtcttcgatcacctgctcgtcgccgggcccggccgcttcggacggcgtgcgcaaaaacgaccgcgaagtcataataggacgttgcatgctggaatcacgcttcttcgtgccaatgggggttctggccgaaggtgtgaccttcggggttgtccattgcggcgatatcggccatgtcctgatcatcgagttcaaaagcggtcaggtcgaggttctgacgctggcgctccgggttcaaggacttcgggatggccacgtcgccgtactggaggtgccagcgcaaaatggcctggaccacggaaataccgtgcttggcggcgatacgcttcaggtccgggtcgcgcagcatctggttggcgcggcccagcgggctccatgcctcggtgatgatgccgtgcgcgttgtcgtaggccagctgttcgcgctgctggaagtacgggtgcagctcaacttggttgacggccggggtcacgcccgtatcgcgaatgagcagatcaatatggccgggcaagaagttgctgacgccgatatgcttgaccagcccacgttcacgggcttcgaccagcgcctcccatgcctcaacgaactggccttggctcgggttcggccagtggatcagatagagatcgatgtagtcgaggcccatacggcacacgctctcctcaatggtgagcagcgcctcgtcatgggcgtggtggcggccgggcagcttggacgtgacgatgatgtcttcgcgcggcacaccggattcgcggatagcgcggcccaccacgccttcattctcatagttgaaggcggaatcgatgagtcggtagccctgatgaatggcggacttgatggcgtccacgccggccaggccgttgaccttgtaggtgccgaatccggtggctggcagttcgaggccgtcgttggccttgcggatcggagtgaccggtggttcaagcatgatagttctcctgcttctcctgtgatggcatatctgttccatcataaagccaaccaatccgctgcgggcatactatttgacttccctcatttccggcgggcggcgagtggagaatcggaacatgagcgaggcgaggatcacgccgagcacggccatgccggcgaacaccatcatgctgcgtgggaaggcgatcatatacgaaccggcggcgtctgccccatcgttcgcggcgatgggccaccacccacacattgccggacagcgtcacgaacaccgcgtccatgattacggtgcccgcgaagccgatgatgatgaacttgggtgggaagtggctcttcagcacgccgccgaataccgggccgatggccggtgcagcgcaggtgaccagactgacgatgccgagcatcgagccgcgctgttcaagcggcgcttttccagaatgatgctggtgatgagcgacaaggagatgccggtgccgagcgacatgaccagtcgggcggcgagcagcatcgggaagttgaccgcgagcgcgcccagcagtgtgccggcggcgaagatcacgacggccatgatgaacagggttttggtggcgaacttgcgcaccatgaacggcgagctcgaaatcgatactgacagcaagagcagatagccggtggtgagccactgcaccaccgaagcgccgatggagaactcctccatcagcgtggagtaggcgatgttcagtgaggtttccgacaggatgccgaggaaggtcagaatcgcaagcgagacgaccgcgatgacgagcttgccggaaaagggttgtttgccgccgtgaggtagttgtgttgctgaatcagtcataatcgttgctctcctccattcattcacatgcttttgcgatgctgcgcgtcttcctgcataagccgcagggcttcggtcaatgtgcgcacagtggtttcgcattgttccacggtcagcccgcccaatagctggctaagatgcgcatggtattcctctacgtaaacgcggcggatatctagtccacgctcggtgagcgtgagcgtcaccgcacgccgatcggcggcatccatatgcttgatcaccagaccaagctccaccatctcgccaacgagtttggtaacgctcggcgtagtgacgccgagaaaggcgctgacatcgcttacccgtgcggtgccgatttcctgcccattcgtttcgttgatatgccagacggcatcaatgacgtgtacgtagcgcggtttcaggcctttgggcagtgccggcatcagctcggtgatagccttcgctttccagcagacatccaggaggctccgcacctcattcaccggaagcaagccggtcttggtatcggttcgggaatcgcacatcgctggcccaacctccaattagttaccaatagtcattaccataaataactatatgcaggctctagacaaacccaacggcctgcgcgcccgtgtcgagttccgtttcgacataaaaaagccagggaatccctggcttgcaatgcgcatatcgctgcagatttgccgggacctatatgtccccggcaacaacagccgtatatacgctaccgatcagtgctgccctcatcatccttggcacctgccgtggcggcctcagtctccttggcgttccacccggcgacggcattccaaccactccatccgatgaccactagcaagcacagcgagaagacaatagtggcccaattgaacagcgagccatcgttattggcctcgaccagtgactgccagagccagataacgcaggccaagcaggtcaatgcatacatacgggaggtggagcgcgcggtgagtttcatggcggaaaaagtcctttgattacaagaatgacggcagataacagtgtgggatccgcaccagcggcaccggcacgaatcccacatcgaggaggagaaaggggaaggtcagctcttcttgcgcttggacatgatgtccacggcgacggccagcaggagcacgaggcccttgatggtcttcaccacggcggtgtcaacacccatgatcgacagaccctggttgataacacccatcacgaatgcaccgatcacagcgcccgggatggtaccaataccaccggtaacggccgtgccaccgatgaagcaggcggcgatggcgtccatctcgaactccataccggcctgagcagttgcggaagccagacgggagagcatgcagacagcggccactgcggacaggaagcccatgtggacgaacagcaggaagtccacgcggcgggtgttgataccggagaggatggcggccttgcggttgccaccaacggcgtacacgtggcgaccgaacacggtcttggtcaggatgaagttgtagatgaagaccagcacaccgacgatcaccagcatgatcggggtaccaccctgatcagcgttaccggaggaagccagcaggtaggtgacgaaggcgatgacgaccgcggcaagcacaattttgaggacggtcaggctcatcggctcgggcaccaggccgaccttggccacacgggcgcgcttgcgcagctggctccaggcaaagccgacgatgcacaggatgccgagcacaatggtcagaccatcgaacggaccccaccagccaaggatgttgggcaggtagttacgggcaatgccacggaattcgagggaggtaatcggcacggattcgccgacgatcacggtggcgagaccacggaagatcaacatgccggccagagtggtaatgaagcccgggatgccgatgacggcgacccagaagccctgccagacgccgacgatcaggccgacgaccagagcgatgacgatggcgagcatccagttgactccggcgcgttccatcagcagtgcacacacaccaccgatgaaggctaccaaggaaccaaccgaaaggtcgatgtgggtggcgatgatgaccatcaccataccaatggccaggatgatcacgtaagcgttctgctgaatcagggacacgaaggagttcggcttcagcagcacgcctccggtcaggacctcgaaggccacgacgatgaccagcagtgcgccgacaataccgtattgacgggcattgttggcaaccgtggccagcaggccggtcttttcttctttctttgcaggtgttgcagttgcggcgctcatcaggctgccacctccctttccttggtcatacccttcatcaggtattcctgggtaaatccattcttctcaacattgtcggtgacgacaccgtaggacaccgtgtaaatgcggtcacagataccgatgagctcgggcagctcggaggaaatcacgatgacggccttgcctgcatcggcaagcttatcgatgatttcgtagatctcatacttggcgccgacgtcgatgcctcgggtcggctcatcgaggatgaggatgtccggctgcgagataacccacttggcgagcagcactttctgctggttaccaccggagagggtggagacattcacatcgatgtcatggcacttgatgttgaagtccttgcggtactgttcgacttccttgcgctcaaggttgtcgtccacaaccccgcccttgctgatcttggtcagggaggccagggacgcgttctctcggatgttctgcagcaggttcagaccgttgcccttacgatcctcggtggcgtaggcgagacctgcgtcaatcgcggactgcacgttgggcatcttgacttccttgcccttgacgaacaccttgccggagatgttggaaccgtaagagtggccgaagatggacatggccatctcggtacgacccgcacccatcagacccgccagaccgacgatctcgccggcatgcacgttgatgttcgcatggtctacgatcacgcgctccgcgtcgagcggatgatgcacggtccaatcctcgacacgcaggtattcctcgcccggggtattggaggggtggttcgggtacaggttgtgcagcggacgacccaccatcttgcggatgagttcttcctggtcgagcggcgtctccggcgtcacgtacatcacaccgacggtcgaaccgtctcgaatgatggtgacattgtcggcgatggcggcgacctcgttgagtttatgagtgatgatgatgctggtcacgccctgctcgtcacgtagctgacgaaccaggtcaagcaggtgggcggaatcctcatcgttcagtgcagcggtcggctcatcgaggatgagcagcttcacgtccttggacaatgccttggcgatttcgacgagctgctgcttgccgacgccgatgtccataaccttggtatccgggtcttcgggaagtcccacacgatcgagcagcttcttcgcctcggcacgggtcttgtcccagtcgattacgccacccttggcctgctcgttgccgatgaagatgttctccgcaatggacaggaacgggctcaacgccagttcctgatgaatgattacgatgccgtcggcctcggaatcattaatagtatggtatttgcattccttgccatcaaaggtgattttgccggaatagctaccgtatgggtacacacccgaaagcacgttcatcagggtcgatttacctgcaccgttctcgccgcagatggcgtggatctcgccgcgatcgacggaaagattcacatcggtgagggctttgaccggaccgaacgtcttcgtgatgttttccatcgtcaagatggtgtcatttgatgacatgtcaccactcctcgtcacagttctgtgttcatggacatgcggcgcatatcggctatgcgccgcatgtcattgtgtttgtttacggattgcctgatgaggactacttagtcagctcgtcgaagcgatcctgggtgatgtagttggccgtgaccagatcctggaggttgtccttggtgatgttctgggggtcaagcagcttggacgggacgtcgatgttgttgttgttgaacttgccgttcaggccggagacttccttgccctcggcgatctcgacgaccatgtcgtacacggcgtcagccagcttgttcacgtccttgaacacggtctcgccctgcttatccttggcgatgttggcaactgcgatctccatggcgtcctgaccggtgatgtacggccaggagtcggtgcccggcttcatgtcgggacgcttggattcgatggcgttgatcacaccctgggcgatgccgtcgtacggagtgaggaccgcgtcgagcttctcgccgtgggcgtaggtggagtcaaggatggattccatgtccttctgcgcctgctcggtcttccagctcatcacggagatcttctgccaatcctcaacggtgaagtccttggtcacgccaccctgaccgtgctgggacggggagacgagcacgcccttctcgaagtacggctgcagcagatcccaagcgcccttgaagaagtacttggcgttgttgtcatccggggaaccggtgaacagctcgatattgaacgggccggtggcgccatccttaagcttgagctggtcaatgagccacgtggcctcgagcacgccgacctgctccagctggaaggtggcgtagtagtcgacggcgtcggtgttcatgatcagtcgatcgtaggcgatgaccttggcgcctgcatcgcgggccttctcaacggcggggcccactgcggtgccgtccttggaagcgaccacgacgatcttggcgtcgttgttgaccatgttctcgatgtcagcgttctgctgggccggcttatcgtcggcgaaggacaggatgaccttgtatccggccttctccagcttggccttcaggttgttgccgtccttgttccaacgctcttcggacttggtcggcatcgaaatgccgatagtggcgcccttttcgatcttggcatcaccgccagttgcctggccgctacggctgccaccgcaggccgcgaggcccgcgcacatggcaacgcctgccaccacggcgacgatcttcttagtgaacttcatttgttctccttcatcttcgaggggatggcgaaccctccttggtcgcccgaacctgggaataacctcaggttcatctcatagaataccgtattgagttaagttgtcaaactcaagaaagcgaatttcctgtcgtttatgttcgaccaatgaacgcaatggcgatttttctcgcatcacaaggcgacacgccgaaaaatccacgctctgcgcctcgctgtgcctcatgccggtaacgactacactgaactcttatggcaacaaggcttttcggttcgcagacctcgcttcgcgaggcaaaccgcgccaacttgctggccagtatccacaagttcggcgccatgacacaggtcgaactggcagaggtgacaggactgtccactgcgaccgtgtccacgctcgtccatcagcttgtcgacgaagaccagctggagaccaaaaacaccgttcgcaacggtcgcagagccactctagtgacccttgcacggcatcagggcctcggcgtcgggctttggatcgcgcgacgtcatcttacgctttctatcgttgacttctcgaagtcaatcatcgctgagcacacgctccccttgccgttgggccacaaggcggacacaacgctggaacgcgccatgctgctcatcaatgagaccctgagcagcatcgacgccgaagccagcgagctggtcggcatcggcgtggccgtggccgcaccggtggccaccagcgaccacaccatagcgattcccggcattctgcccggatgggacggcgtcgatatcacggccccgttgcgcacggcgttcaacgttcccgtatacgtcgataatgacgcgaatttcgcggcatacggcgaatcccgtatgggcgtggcggcaggcaaacgcaatttcgtatatatctcagccaacgacggggttggcgcaggcatcgtcatcaacggcgaaatcatgcatggcgtgaccggcctggccggtgaaatcggccatatccaggtcgacccgctgggtgccatctgttcgtgcggtaaccgcggctgccttgacaccgtcgtggcggaaaacaggctggtgcagttgctcagcgtcacacacggcaatatgacgctggatgatctggtgtcctttgccaacgaaggcgaccccggttgccgtcgcatcatcgccgacacggccgtgcgtatcggtcaggtggcggctgatctgtgcatcagcgtggatccggaggtcattgtgctcggcggcaagctggccatgaccggcgacgtattcatccaaccgttcaatgaagcgttgcagcgcatgctgttccctgatgccgtggcacccatcgatgtactcgtgtcatcccacccgaacgacaactgcgcgctaggcggcgcattatgcgccatcgagttctcggttcgcaatgacgtcagccagtgaccggtaccaggagaagagtgagaagaaggaacacaccatgaggaattcgagcacacctcctctgctgcggctggaggacatctgtgtgaagttcggcttcgtcgaggcgttgaaatcggtgaatctgtccatccaacgccaggaggtcgtcgccatcgtgggcgataacggcgcaggaaagtccactctgatcaaggtcatcgcgggatttctgcagccgggattcggccatatctatctcaacggcgaacaggtgaccattccctcgatcagggaggcggaccgcatgggcatcgcatcggtgttccaggggcaggagttctgcgacaacctagacgtggcctcgaacctgttcctcggcaaggagatcaatcagattggcatacgcgatgacgattcgatgaactcgcgtgcccgttccgtgctgaagaccctgagctcggcgattcgggtcggctcccctatcgcatccttatccgtcggccagcgccagaccgtggccatagcacgcacgctgctcaatgacccgcagcttattctgctggacgaaccgaccgccgcactgtcggtgatgcagtcggcggaagtgctcgcatatatcaagagactgcgctccgaaggccggtccgtggtgatggtctgccacgatctgccggatgtgttcgcggtatccgaccgcattgtcgtgatacgtcaggggcacgtcaccggcgtgcatcgaaccgtcgaaacgtcctatgaggagattatcgccgaaatcgccggcgtgaccaccgaacacgagtacgaggaaatcgctgagaacccggaattcgattccatggtcaggcagcggaaactcatcgaccgcactatcagcgcggcagtgagccatggcaccggccatgactcaccattagactaacgtcccgttgccggagcgacatcgtcagcgcagagccaggttggccgcgccgatcagaccggcatcctggcccgcagtggccgcgacgatcttggcatggccgcggtaggcgctgccttccaggaaacgctggtagttgtagcgggccggctccagcaggatgtcgcccacggccaccacgccgccgccgatcacgaacaggtccgggtcaagcacggcggaaacggcggccatggtgcggcccagccattcgccgatcttgccgaacgcatacaggccaagtacgtcaccttcctgagccgcttgggacaccatcggcccctccagtttggtgatgtcgccgccgcacagttccagaagacgcttggcgtcctgaggacgacggcgcacggcggacttggcgaagttctccagcgaggttcccgaagtgtaacgttcggcgcagccgcgcaggccgcagccgcagtggtcgccgtccgggaccatcggcaggtggccgagctcggcggccatgccgaaggagccgcggtagagctggccgttgatcacgatggcaccgccgaggccggtgcccacggtcagcgcgaccatgttggagctaccctggccggcgccgtgcacgaattcgccccatccggcgcagttggcgtcgttttcgacgatgaccggcacggcatggtcgatcagcgcgccgacgtgctcggacagatcgtagttgatccatgccggaatgttggcggagaaggtgagcgtcttgcgatccgcgctcacattgccggcggcggagatgccgacggcctcgatatcggtgtgcccggcggccacagcctcgcggtacacctcggcgatgtgctggttgatggcgtcggcgtccatcggcgtggggacgcgccagcgctggatgatgctatcgttttcatcgcagacggcggcggcgatcttagttcctccgatatcaatggcgagcgtggtcatggcttactccttgaaggcttgtgtggcgtacgagacagcgaaaatagtaacgagttgccatgacctcccatagcgtatttttcatgatttgtcatatctcgcgcacgttctgccaatgtgaccctgcacacgtttttcaccatttataagcactgttaacgctaacgttgtcattcaatagcaaacgttgtcattcagactatcggcgtgtcgagcagagccccaaggccagcacgaaaccttcggtatttccatgcgatacggcatcggcatcgactgaaacagcttccatgccagagtcgaatggccatcaaacgactaaacaccagacacacattttggcctataaccccatatttcgccctacaccacgaaatacggcaaaagaacaaaaaagctcctgacatttgtcaggagcttggtggcgaccccggccggacttgaaccggtgacctccgccgtgacagggcggcgctctaaccaactgagctacggggccatctgtacctcaatgaagcacaagaggatatactacagcatcactggaccacggcgcgccgcccggcgcgtcgcgccacggcaatgtcaggcccatccattacccctccaagccatagcgacgcccgccattccagcccttccgataccatggtgggcggtggtttggcgtggattcgatcgttatgcggacagggcggcacaggcctgacgcggcgcaccgcgatccgtgattcgggggcgtgctccgcgctgcacacagcgtatccatcacaaactaaagactaaagaaacagcggaatttcaacccctttttaaggagtaactgcacaacatggcagaattcgtatttcagatgatcaaggcccgcaagtcttacggcgaccgcgtgattctcgatgacgtgaccctgagcttcctgcccggcgcaaagatcggcgtcgtgggcccgaacggcatgggtaagtccaccctgctcaagatcatggccggcctggagaccgtgagcaacggcgaggccagcctgaccccgggcttcacggtcggcatcctgcagcaggagccgccgctggacgacaccaagaccgtgggcgagaacatcaagatggcgttcggcccgattgccgagaaggtcgcccgattcaatgaaatcggtgaggagatggccaatccggacgccgacttcgacgccctgatggaagagatgggcaagctgcagaccgagatcgacgccgccgacggctgggacctcgactcccagctcgagcaggcaatggacgccctgcagtgcccggacccggacaccccggtcaacgtgtgctccggtggcgagcgccgccgtgtggccctgtgcaagctgctgcttgaggccccggacctgctgctgctcgacgagcccaccaaccacctggacgccgagtccatcctgtggctggaacagttcctgcaccagtacaagggcgcagtcatcgccgtcacccacgatcgttacttcatggacaatgtggccgaatggatttgcgaggtcgaccgcggccacctgtacccgtacaagggcaactactccacctacttggagaccaaggccaagcgtctggagatccagggagccaaggacgccaagctcgccaagcgactgaagaacgagctcgactgggtgcgctcctcccccaaggcccgtcaggccaagaacaaggcccgtctggagcgttacgaccagatggaaaacgaggcacgcaacaacaagaagctcgacttctccgagattcagattccggccggcccgcgcctgggttccaccgtgctggaagccaaccacatccacaaggccttcggcgagcgtgtgctcatcgacgacctgtccttcacgctgccgcgcaacggcatcgtcggcgtaatcggcccgaacggcgtgggtaagtccacgctgttcaagaccatcgtgggcctggagccgctgaccagcggcgagctgaagatcggcgacaccgtcaaaatcagctacgtggaccagaaccgtgagggcctggatccgaacaagaacctgtgggaagccgtgtccggcggcctcgacttcatcgaggtggccggtgtggaggtgccgacccgcgcctatgtggccagcttcggcttcaagggcgccgatcagcagaagctgaccggcgtgctctccggtggtgagcgcaaccgtctgaacctggccctgaccctgaagcagggcggcaacctgctgctgctcgacgagcccaccaacgatctggacgtcgagaccttggaatccctcgaaaacgcgctgctcgaattccctggctgcgctgtggtgatttcccacgaccgttggttcctcgaccgtgtcgccacgcatatcctcgcgtgggaaggcgacgacgacaacccggccaagtggtactggttcgaaggcaacttccaggcctaccaggagaacaaggtgacacgcctcggcgaggatgcggcccgcccgcaccgcctgcacaagaagcttgtgcgcggctgagatacgccggcattagtgccacaacgcgctttatacgtcgaaagccgtccctcaggggcggctttccccataattgccccatggctgcccgccccgcatcccataaaatcccacagtcgcctacggcaacacaccggcagcgcagcagcaacgtagcggcaatgcgccgcataacccaccgtttaccttccaaacagtctcgttacatttcgctcccggaactcttaacccccaccggatagactgccaaccataggttggaatacgataaccgaatactgaacacagcagaacaagaatcgaggaacgccatggctcaggcaaccaccgtaactccattggaccatctggtgaaggtgctgaagttgggcgagccttccgcttaccgcaatcacacatatatcaatggcgagagtatgtacttccccaccggccgcgtctacggtggccaggtcatcgcccagtcggtgatcgccgcgtccaaaacagtgggcccttcacgcctgccgcattcggtacatggctatttcattgccgccggcgatattcgtcaagacctgttgtttgacgtcgagaaccttcgcgacggccgctcgttctccgctcgtcgggtcaacgtcacccaagccgaggggtcgattctcacggccatcgcctctttccaggagaccggccaagagggtgtggaatttgccgatccgatgccggaaaacctgcccgatcccgaaacgttgacttccgccaaagaactcatgcagccgttcgccgagaagtcgccgttcgccaattactatgccgagaaatcgccgttcgatatccgccacgtgacgccgaccgtgatgctgcgcgcggacaaggattccgccgagcatgattccggcaagcagatggtgtggatgaaggccgatggccacgtcgatgtgccgcaggtcatgcatcgtgcgatgctggcgcttggctgcgatcaggtgatgatggagccggtgctgcgccgcgccggactgtcgatttccacaccgggcatttcctatgcgtccatcgaccattcgatgtggtggtatcaggatatcgatatcaacgaatggcatttgtatgtgcaggatacgcctatcgccgcgcacggacgcggactcggcattgccaaagtgtatgcgcagaatggcgacttggtggcggccatcgctcaggaagctatggttcgcgtgccgcaggaatagtggtaatcggcttggccgatggtgtggttttttcttcttctctcccccagtcggctacgcctacagccccctcgccagagggggcttatcacggattatcttttgtaggcctgggctatgtcgctacggcgcttggcttccttgattttcaggttttcggggccttcgttcggcggtaactggcacaaccattcgccgataatgccgatgatcatgtcggcgatgcacaccacggccgcgattgcacactcggtgacggcgtgtgcatagaaatccgcctcgatatggctcaggctcatcacaatctgaccgccataccagccggcgagcgttgcgcccgccaatcccagtgccttagacagcaccagcgtatacaccgcgatagtgggattgatgaagctatgcggacgcttcttggggtcggtattcgcgtatttatgcacttgcagggccaagatcagcacgataacgcccagcacggccagcaatccggtcacaatccgaggcgcaccaatcagcgacagtcccgagctttcgccgtaggaggccagaccgatacccgccaacaggcccagcacggcaccgatcacatactgccaccatggtgttcgccgtgttttcatgtccggcctccttatcgttgcgttgctgtttgctgtttgcgaacggccctcgctcctgggctgctcatcttgatttggttttcgtcactgccgtgcccggctgttcgaggccggagactggtccgtcaccgtctggtttctagcctaccgttcgtaactggttctgccatcagctcaactgttcgacagtatccagttgtccgatagcaatccgacctgtccggcatccggtgccatggccaaaaggaaggccaccgggtcgccgcccagagaagcattcgggtccatatccagccaaggtgccaataccgacgcatggttacgggccgacggccaaggaatgctgcagttgggctcgtcggaagtcacgccttccatgtcaacaaggtcaaggtcgactgccaggtcatgaacgctttcgatgctgcccaatacggcaatcaggtcggcgggcggcaacttggtttcgatttggatgaccgcgctcatcgcgtccgggccgtcgaaatggctgacatggtagagcggcgagatgccctgtacctgattgccaggaacactgtcgatggaaacgatggtttcgcggaacagccgttcggcatcctgcgaggtggaatccagcgaaataatcgccttgcgtgagacgggttccgactccgacgctgattcttgcttgactgcatgcccgccgagcatccagtcttcgctctcgagctgcacggcgttacggtccggcgcggcggccagcaaatcggctacaggcccctcatgggctccagcaagtttggcgttcggattcagcgccgcccagggagccagcacaaatgcgcgctgccaagcacgcggatggggcaatgccagatccggatccgcgctggtgatgccatcaaagtcgataatgtccaagtccaacggcctggaatcccaatgattctcacgaattcgcccatggttcgcttcgatgttttgcaacgcggcgagcaattcgtggctgcccattgtggttccaagctccaccacggcgttcaggaaatccggcgtaccgtcagccatgccccacgcggccgtgcggtaaagcggcgaaataccggtcacctgtgtgccaagcagcgcgtcaatctcccgaacggcggctcgcaaggtggattccacctcgcccacattgccccccaaggccaccaccgcattatggatggcatgcttttcagcagtgcgtccattatcggtggcacgcacgcgcgagatggagaccgatacatctgcaaaagccacgacgatgggcgcgtgaggcttgtgcacggtgacgtcgatggaggcgacggccggcgcatcggcaagaatcttatccgcgatacgttgggccagacgctcgatcaggtccacatgagggccttcgatgacagccacgatatccttggccacgcggccgtaatcgatggtgtcattgagatcgtcggattggccggcggcggccagatcaaggtgcagggtgacgtccacgacgaaggtttgtggccgttcgtgttcaaaggtgagcacaccgtgggtgccgttggcatgtacgccggtaagtgtgatggtgtccattggtaaggctttctgttcaaatgctccccctcagtcgccttcggcgccagctcccctcgcccgaggggagccaagacctagaagcaaccaaaaacagggagccaggggaatcatgcgtattcgcgccaggtgttgccggcgatgacggcggcgcggcttttggccacatcgtgtacgcgcacggcccatgcgccgtgctcggcggacagggcggacaaggctgcggtcacgtcatcgcgctgggccatggtcgggccatcagcaccggcagtacccgccccggtaagcatcgccgaaatgaagcgcttgcgggactggccaatcagcaccggatatccagtggcgcggaaggtctcgagcccggtcagcagcggtaggttatgctcgatgccgggcttggagaagcccagaccaggatcgatgataatgcgctcaggctttacgccggcggccagcacgccgtcgacttggcgcatgagttcgtcgtgcacgtcggtcaatacgccatgctcgtatacggaggtgtcttgatcggggttcgcgcccttggagccgacgagccagccgcgccaatgctgcacgacgtacaggcagtcgtggtcggcgaccacatgcggcagctcggcgtccagcgtgccgccggaaacatcgttgatgatctgtgcgccctcgctcagcgcggcggcggccacggatgcgcgcgtggtgtcgatggacagtacggcaccggccggaatcaacgtcttgacggcaccggtgatacgggccagttcgtcggcctcggacacgcgcttggcaccggggcgcgtggattcggcgccgatgtcgatgatatccgcgccggcggccatcatgtcgcgcccgtgctgggccgccttggccgggtccagccacaggccgccgtccgagaacgagtcctcggtgatgttgagcacacccatcaccatggtgtgcgtggcgtcatgcaacgcctgcaaatcagtcataggtcatctccccttcattgtttccccttcgctcccctcagtcacctacggcgacagctcccctcagagaggggagcctaggttgcgtcacttgtcaagaatcagactcatggcttcggctcgggtggcggggttgcgtagcagaccgcgcaccgcagaggtcaccgtgcgggcggaagacttcttgatgccgcgcatcgacatgcacaggtgctcgcattcggtcaccacaatcacaccacgtgcgcccgcatactcgaccagcgcgtcggcgatctgctgggtcaaacgctcctgcacctgcggccggcgagcatacacctcaaccagtcgggcgagcttgctcagccccatcaccccatccttggcgggaatgtagcccacatgggccacgccatggaaaggcagcaggtgatgctcgcacaccgaatacagttcgatgtccttgaccagcaccagctcgtcggtatccacgtcgaagtgcttctccagcacatcggccggcgaggcctgcagaccggcgaacagctcgcggcacgcgcgggcgatacggtcaggcgtttccaccagtccctcgcgctcgggatcctcgccaatcgacttcaggaacagacgtacggcttcgcgcacgccttcctcgtcgtatgtgcgtttctcccgctggcaagactctatattttcgttcatctcatctctcccttgtcattgtccacaacgacgtcggcccggcctgcgtacgtgagaaaccacatacaggtcgggccgaatcgtcatcgtgtctactcttccggcttcatgccgaccgagcgcttgaggctttcgggaatctccaccggcggcttgtccgagtcggggcggcggtcgttggacagccacaccggacgaaccggagccttcttgatcggcgcgaagatcgccgcaagttccttctcgttcagggtctccttgaccagcagctggcggaccagctcgtcaagaatctcgcggttgtcgttgatgatggtccatgcctcggtgtgcgcggtctccaccagcttcaacacttcgtcatcgattacttcagcagtacgatcggagtacttgcgcggctgcagaccatccatcacagtggtctgatcgtcatcggaaccccacttgatggcgccgagcttatcggagaagccgtattcgatcaccatcgtacgggcgatgctcgtagccttctcgatatcgttcgaagcaccggtagtcgggtcgtggaagacgatttcctcggcggtgcggccacccatcgcgtaggccatctggtcgagcagctggttgcgcgactgcgagtagcggtcggaggtcggcatgacggcggtgtagccgagggcgcggcctcgcggcagaatcgtcaccttggtcaccggatcggtgttgttcaaggcggcggccaccagcgcatggccaccctcgtggtatgcggtgttgcgcagctcttccagagccatgcccttagacttgcgcttcgggccggcctgaacgcggtcgatggcctcgtcgatggcgcggttgtcgatcaactgggcaccggcacgggcgcacagcaacgcagcttcgttgagcacgttggccaaatcggcaccggtgaagcccggcgtgcgcacggcaaccatatgcaggtcgacgtccggtacgaacggcttgcccttggcgtgcaccctcagaattgcctcacggccttccagatcaggcgcggccacacctacctgacggtcgaatcgacccggacgcagcagagcggggtcaagcacgtcagggcggttggtggcggctatgatgatgaggttggtgtcgttgtcgaaaccgtccatctcgacgagcagctggttcagcgtctgctcgcgctcgtcgtggccaccgcccataccggagccacgcttgcgacccacggcatcgatctcatcgatgaagatgatggcgggagcgttcttcttggcctcatcgaacaggtcacgcacacgggaggcaccgagaccgacgaacatctcgacgaagtcggagccggccatcgagtagaacggcacgccggcctcacctgcgatggctcgggccagcaacgtcttaccggtgccgggagggccgtacagcagcacgccgcgcgggatgcgcgcacccagcgccttgtacttggacggatccttgaggaagtccttgatttcctcgacttcggccacggcctcgtcttcaccggccacatcggcgaacttggtggtgggggtctggccctcgagcagcttgccgctgttcttcttgccgcccatgccgagcatgccgccggcaccgcccatgcggctcatcagccaccagaacaaggcaaagaagatgatgaacggcaaaatcgaggtgatgaggtagctcatcacactggtctgctcgatattcgaggtccagcccttttcgagatcgccgttctccacggccttggccacctgcgcgccctgggcgaaggtgtagtagaactgcacgttcttgccgtagttggtcaccttgccggtgtcggcgttcttcttggtgtagtcattcttcagctcaaggcggacgacctgcttgttgtccgtgatctcggcgtatgtggccttgccctgattgatcagcgcgaaaccatctttagtatcgatggttttggtgccaccgccggcgaacatctggaacatcagcacaaccatgaccacgagcacggcaccccacagccagggggactgccatatcgggcggttctctttgttgcctttgccattgttcccgttattgccacggttgaacgggttggtgaacgggttgccgttgttacggttgttgttcgggttcgggttattgccgttacccggcccttgcgggaagctcatgcttgcactccttggtagacggacggcttgaggaccgcgatcgaatcgaggttgcggtagcgttcgtcaaagtcgaggccgaagccgacgacaaactcgtccggaatctcatagccggcgtacttcacatcaacgtccacctctcggcgggaaggcttgctcagcaaagcgaagacttccacggaagcggcaccacgacgtttcagttctgcgaccagccacgcgagcgtgcgtcctgaatcaacaatatcctccacaatcaaaatgtgccgtccgcgaacatcggcggacaaatcctgcctgactgtgacctcaccgctcgacactgtgcccgagccatagctcgacaggctcatgaaatcgatctgtacaggaatgctcatggcctgggtgaacgcgaccagcgtattcacggcccctttcagcaccgcaacgagcagcggattcttatcgcggtaatcctcgctcgcgagagcagccatctcgtggatcttggcatcaatctgttctttgctgaccagctcgtggtcaatatcttcctcaacgtcagcgattcgcatgcgctccatcttggcacacgcgaatgacgtgtttcttgcgattggctgaataacctctgggaagtgagacgccgccttgcccatgccaatcgacgaccagccggtcgatggcggcaatctgggcagcactggcgttcacaccggcttggctcagcgcgtgagcgatgacccgcaaccgaatcgcctctggctcacgtgcaatacgtttgacgctgatcatcaggccgatgccatggctcgaatcgttggtatcgcctgccacacaggctcgtggcgcatcggtcgatacagctgccgacgatgccggccaatcaactgccgcaaccgcctcccccatcacctcgtcggatcgctgatccagatactccttatccattctggccaaccgtgcgctttcggcgaaatggcgggtgacattgaatccagcgaatcgttcgatggccggcagcaggtcgtgacgcacccgcgagcgcaacggatagtcgttcggcaactcgccgtctaccgcatcgccattggtggggtcatcccaatattccacacctaagtcttcacagatgccggtggtttcggctcgagtaagggtaagcagtggccgcgcaaaagtcgcgccactgcgtgtgaagacctgcggcatgccagccaacgcatccacgcctcgactgcgcagcaggccaatcaatacggtttccgcctgatcgtccatagtgtgggccaacagcacggcaatggcacccgattcatgcgccgcggcgcacagctcgtcataccgggcctgccgtgcggccgcttcgaggccctcgccgcgcgcctgtacggttgcgttgcgcatgatgaccgggcccagtcccaacgcgtggcaacgatccgcggcctcgctggcgacctgttcggagcctgcctgcaagccgtgatccacaatcacggcaccgcaacgcacgcccatggacgtgcatacgatatggctcaccgcagccagtgccatcgaatcgcgcccgcctgaacaggccacgagcacgagcggcgcatcggcggcaacggcatggtccccatgctgcgcgaattcgggagcctgcacatcgcatagttccacggcactcagcgttgcgcggaccgcgcctacggccttgcgcaatcgtgcggaatatgccatgtactcaccaccttttttctggttataggcactcgtgcgtttatggacgtttacggcctttatagcccttgatggcccttgatgcctcttttacagccccgcgagcttggtgataaacgagtcgatggcgctacgcgcggcggcataatcctcaggattgttaaccaccacggcaaacgacaacgctcccccattggtgcgggacacattgccggccatcgacgtaaccgtgccgaggctgccggttttgacgcgcagcagaccagccacggcatcatccgtataccgatcctgcgccgtgcccaccaatcccgcgatggatagaccttccgcaccagcagcaccgctctcggtggtcagattacgttgttggacggccgccagcgtgcgtacggtgagccgggagccgggagacaggccggagcaatcggccatggtcagaccggatgtttcgagaccgagatcgttcagagtggatttgaccgcttccgtgccgccttcaggactgtttgtcgctgatttcgccaaggcggtgagtctgccgaactcctcggccagcgtattgtccgaatgccgcaacgtgtatgccatgatttcggacagtgttgccgaactcaccgaagccaaaggcgtttcaccggatggagcggtgtttgccgtcacgtctccggtaacggccacgccgttcgattggagcagttcggcgaatttcgtggccacgtcgctggcggcgtgctgggacagttccgggtatccggccgaatcatcggggtcggccggcgcaggcgtatcggcggtgtattggcggcctccatcaatcgccattgatgagaccggcgtgaagtagacggtgtagtcgcttaagactgcgccgccttccgacagacctgccggaatgcgtgagtcgccgaatagggtgtcgtcgtactcgagattgacggaagtgatgcctcgctgggcgagcgcggccacggtggccttggccaaggtgttcagaccggcacgtccgttggtatggttggcgtcagaatcgcctgcagacagcagcatgtcgccattgcctttgagggtcaacgtattggtgccgtcatcggattgggtgaggaacacttgggtatccaaggtggatgccatattcagggtggatgaggcggcgagcgcggtcagcgttttcagtgtggatgcaggctcgcgtggagtgttcgactcatgttcggcagcgacggtgccttgggcgtcttcaatgatcaccgacgtatcgtttcccacgccttgcgcggacagcaattcgttgaccagcgcagaagcggccgtggaatcaatggccttgttcgcgttcaaggtgccggcgacggtgccgcctgatttggcggtggctggatcggcaaaaacaggtgcggcgacgggcttcaacgtcaataatccgggggccacgtcggtgatgtcggcggcgcagtaccccgcgaacagggcgatggtggtcagtgcggaaatgatgacggtcagtgttcggcgatgcgatcgttgggtccgccgttgcgcttcacgccgctgacggcgtgataccgctgtagataccatcgtgctccttatgccaaggcgatcatttctgcaatgaggcgaacgagtcgagtgctgccacaatcgaaagcattcgcgcatccatcagcttaccgcccagccatgtcccgagtgccaggatgccgatgccgttggccagtgcgaccggaataatcgccagccatatgccgccttcggctcccgtcagcagcatgaccagcgccacgatgccggtgggcagcatcagcagcaggctgccaagcacgtagacgaacgggaagaagccttgggccatggcgcggccttgaggcgcggagaacggcttgtccattgaggcgaccgggtacatcagcacacaggacgtgacttcggccacgcccaggccgctcaaggcgacgcccatgcccacggcgaggaagatcaggccggtgacgaggtcatcgggctgcgcccagcggccggtcagtgcgccgaccagcacgatgccggcgagatagagcagcaccatgtagacgaccatgatgccgacgtagacgcgcacgcggccgattctgtcggtccggccacgcacgccggcgatgacttccatggtgaagccgcggccgtcatatgcgagcccgttgctttccaccactgacatgaaccagccacaccagatcagcgactgccagacgaccgcgctgatgccgtgcgcctggaaggcgaagatgatcaggaacaggaccggcatggcgaaggtcatggcttggcgggggtctcgtttgagataggtgatcaggcgtgcggacaccgcgccggatgccgaatcgggcatccatgcgaatgcgccgatgcctttggcggtctcggacggactgtttgcgccgatggtgagccgttcatgcctcagacaccaagtgcatacggcgaagcagacgatccatgtgacggcaaggatggcgatgcgggcgatcagcaccgcccaagctccggtaagcgcgtcgaacggcagttggaaggccgcaccgaacggcgtccatgcggcgatggcggtcgccgcgccccaggtctcggtgttgaggctgaaggctatgccggagttgaccagaatgttcggcaactggcagatgatgacgaaagtcagcacgatgaagatgtagaacgcgcctttgccgcgtttgctggtcaccagcgtggtggatagggcgatgaccagtttggagatgctcatcatggtgatgacggccagcactgcggcgaggagggaactgatgattacggctggtcccatatgccgataggccagtgtccagagcatcagtgaggccacgccagtaagggaggggatgccggacaggccggaaagcagcaagccgaattgcaggttgcggtcggcgatgccgtagatcgcgaatttgcgtgggttcatggtggagccttcgccaagcatcatgagctggatgaagccgatgaagatggtcatggtcgcgccgaccagcacgacgactatgttgacgatgcctccgggaccaaggatgttcagcggaaagccatccgcgttcacggtgaagggcggcagtatgccgatgaaccatgcgagcacgccggtgccgatgatggtgccggccgcgagtacagcggaaaagacataggcgacggtctgccacgccgattttcgcagggtggcgagcgtgagcgtccagcgcaggcggaccagggtgatggcggtcttgatcattggcgggcctcatcggtgggtgtggcgggcgtaggcagaatcggctgaatcgtctgggccgaagttggtgcttgggcttgggcctgcccgccatcgagccacgcgagatgggcggcttcgtggcggccaccgactagttgcaggaagcggtcttcgagttcttcgccagcagcgacctcgtccaccgtgccggccgcgcataccagaccgtcgttgattacggccacatgcgtacacatcttttcgaccaatgccatcacgtgtgaggagatgatcaccgtgccgccagtcttcgcgtattcgatgagaatgtctttgaggttggcgctggacaccgggtccacggattcaaacggctcatccaagaccagaatgcgcgggctgtgaatcatcgcggaggccaggcagatcttcttggtcatgccggccgagtaatcggtgaccatcgtgttggcggccccggccaagtcgaaagcattgagcaggtcctgggcgcgacgcgtggtctcctcgcggctcatgccgcgcagcatgccggagtagacgagcaattgcaaaccggtcagtcggtcgaagatctggtcgggctggggcatgacgccgatcatgcgcttggccgtgttcacgtcgctccacacgtcatggcccagaatcatggcggtgccggcgtccggcaccaatagaccggtcaccatattgagcgtggtggttttgccggcgccgttagggcccaccagtccgtagaacgagccgattggaatgtcaagcgcgagcccgttgacggcgatcttccggtcgaagtgcttgaacaggccgcgaatggacaccgccgtattcgggttcggcggccatgcttgcggctgtggctgttgcgactgcgaagacgcgggagcggcggctggcatcatcggcggctgaaatccgacattcctttgagtattgtctaagctcatgcatctactctagcccaccagtcaaccctcagcgcagcacccccgggttgctgttggattgccccgctgagcagctccggactagcggactcggtcagcccttatgtgcgatgggcctccactgggctttggcgaagatggcctggaaggaaatcggcacgtagctgagcatgtaaatcgggaagctgagcacataggcgagcagctccttgttcgtggcaccgatctggtcgtgctcgacaatgatggtcaatgcagccaatgccatcagacccaacaccgatgtgatgatgccgctggaccaaccggccagcgattgcagctggctcgaccaactcacgaagccacacgcggcgaacagcaagcccatcaccgcgcgaatcacgcccaacacggtaaacggacacagcatcaaggtgaagtcgatgcaggagaaatcacgttcgcgaaccgcgcgtttcagcaatgccgagccataataacggaatacctgcaggaatcccttgctccaacgcaaacgctgacgccaactttgcgagaaggtaaccggctgctcgtcgtagaggatcgcagtaccgcaatagccgatgcggtcgccatgcagaatcgaatccatagtgaattcaagatcttcagtgagcaggtggaacttccatcccttgttccgcttcatcacctcgcgggagaacatgaatcccgtaccgcccacatggcaagaggaaccgagaatcatacgcgagttagacaggaatcgcgattcacggatgaaccacagcgcagaaccagaagacacccagttatccgccagattcaccgaattacggtagctggtcagaatcttgaatccggagcagaacgccttgttcatttcctcgaagtaatgcttgtccagcttgttatcggcatcgaacacgaagtaggcctcataatcatcggccacaccgatgtcgagcatatgccccaacagatacgtcagcgcatatcccttgccaaccagttcaagattgtggcgttccaccacatggcagcccaaagaccgcaccacgtcggcggtgttgtcggtgcagttgtcggccaccagccagatgtcgatgaggtcggacgggtaggtctgatcgcgaatcgacccaataaggttgccgatcacgttttcttcgttgcgcgcggagatcagtacggcataccggttggtcatcggggcgtcggggaagcgcacgggcttggcgaacagggacatcacgatgcacagtccctgatatatcatgccggcaccaccgacgattaccagaagaatatcgagtacggaaagcagggtcatcagcgccaccccgccctaggattgctggaggcagattgatcagactgcttggtttgcttgcgttgcttgggctgctcagactgctgcgtatccgcggcaccacgctgcggaatcgccacggtggcggaatcgtccaaatcggattctttcgtctcgtgtggcggaatcgcatagatctgttcctgcagcaaacgcagttcctcattcatcggcacacggctggtggaccccttggccgcacgcggcatgtgctcgccgatcggctgcagcacatgctcgccgaacgcttcggacgcctcgacgatcttggacttcttctccggagtcggatcgttcatcagtggtgagtcaatcagctcatagcgcttggtgtacgcacggaagatggcctgcagcgatgcggtgaccggcagcgccaggaacgcgccaaacgcgccgaacagcgagccgaacgccagcaccgcgaggaaggcgacggccgcgttgatatccatcgtgcgctgcgaaatcctcggcgagagaatcaggttctcgatctgctggtagacgatgatgaacaccagcaccgccacggcgtacgtccatccgcggttgccccaagcgaacagcaccggcagcgcgccgccgatataggtgccgaccgtggggatgaactgggataccacgccgcagaacagggccaacggcagccagtagggcacatgcagaatctctaagaagatggcagtgcaggtggcgttgatcaacgccagaatcgaacgggagaacaggaaggacgaaatctggccttgggccacggtccacaccagcaggaatcggcgctgcgtgttgggggccagccactggcagaaggagcggcgcagtttggggccggcggcggagatgtaatacgtggtcatgaccacggtcatgaggttcagcaggaaggagaacaggccgcccaccgtactcatggcggtaccggcaaaatcggtgacccacgaggtctggatattgttgaagatttccatgccgagattgctgatttccggcatcttgaacgtggcatactggtccacgaactcacgaatctgctcatacatggccggcaaaccgcggaccatggcaatcatctgctgtacgaacatgttgccaaatagcgtgagcagcacacccacgaccacggccacgcccaccaagctgacggcggaagccacgccacgcttccagccatgagccaccagcgccaccaccaacggttcgacggccagcgccaggaacagcgagatgatgatgtcgagcaccagataggagatgtcgccccacgagcgccagcagaacatgaatacgatgacggcgagggccacatacagcagcgcgcggccgaaccattccggtggcctacgggaatctcccttggcggggaacaaagtaccaaagtcgatacgattctcgtcgtccgggtctgccccggcctctgcggcaccggttctcaacgtgtcggtgctgtttacgtttcgcacgcgttcgctcatggctccccattgtagcgaggggtttgaagctcggatacgccggcggcgtacacccgcttttctattgttgatgttatgctcaacgtttcgatcatcatcccagcgtggaacgaagccgaacgcatccgcgactgcctgctgaacgccacccgtcagaccatcatgccgcatgaggtgctggtggtggacaatcgttctacggacaacacctgtgcggttgtcgaacagttcattgccgaacatcccgaggccccggtcaaactgttgcaccagaacgatgaacaggggctgattcccacccgcaactttggcctgaacgccgcgaccggcgatgtgctgggccgttttgacgccgactgtatgatccggcctgactgggtggaggtggtctccggcatcttcaccgaagacccggccgcgatgggtgccactggtccggtgatgtattacgacatgccctcacgccatttcgggttgaaaggcgacaattccttacgcaagcgaatctaccgtgccgatggcggccagccgctgctgttcggctcgaatatggccttgcgcgcttcggcctggcatcagattgtgaatgaggtctgccgggataaggccgatgtgatgcatgaggatatcgatatttccctgcatctgatgggcaaggatctgaaaaccgtgtactcgccgcgcatgatcgccgcgatgagtgcgcgacggatggatacgtcgttgagttcgttcctgagctacatgcgacgttttaagaatacgtttgatgcgcatccgcaacatacgcgcacgcataagccggaggtgttgttcaccgccatgtatccggcgatgcatatgttctacccggtgtggcagaaagtgctgaattccgcggatatcaatccggctgaagccgcgtggatcaacgagcagatggaactggcggaggcgcaaggcaagcagctgtacgacgagacccccaccgacgaagtctacgacgaaaagcacgaaaagtagctagatatacgagccccctctgcttatgcaagctccctctgataagggagctgtcgaatgaagtgagactgaggaagagactgcgacgcagtcgctaaaacattgaatcggacgcaggccgatacctattattcagcggctacgccgcaacttctctccctcagtcagctacgctgacagctccctcatcagagggagctaatgtttactgtcattgactgatcacatcagcgacttgtaaatcgcgaggatgtcctcttcggttgcctgacgcgggttgccgggggtgcacacgtcgttgaaggcatcgtgagccagcggcccaaggtcggcctcggtggcgcccacttcggaaatcgtggtcgggttcttcagatccacggtcagcttgtggacggcctgcacggcctcttcgcgcaccttctccaggtcgccggtgtaggcgtcctcaacaccgaacgcatcggcgatgtcgcggtacttctcaccggtgaagtccttgttgtattccatgaccggggccagcagaataccgttggccacaccgtgggccacgcccagacggccgcccagcgggtgagccatgccgtgcaccagaccgaggcccacgttggagtaggccataccggtgatgtaggacgcgtaggccatctgctcgccggccggaatgtcgccgtcggcggacttggccaggttcttggcaatcatgcggatggtctgcatggacaggcagtcggacaggctccaggcacccggggtaatgtaaccctcgatggcgtgggtcagggcgtcaagtccggtggcgaccttcaggccgcgcggcatcgagtcggtcagatccgggtccacgaaagcgacgatcgggatgtcgtgcgggtcgacagccacgaacttgcgcttgttggccgtgtcggtgaccacgtagttgatggtcgtctccgaggcggtgccggcggtggtcggcacgccgaagatcgggacggacgggttcttggtatccgcgacgccttccagagaaagcacgtcggcgaactccgggttggcggtgatgatgccgatgcccttgcaggtgtcttgcggggagccaccgcccaggccgatcaggaagtccgcaccggactcggcgaacttggcgacgccgtccttgatgcactcgaccggcgggttcggcttgacgttggagaacacctcgtacggcaggccggcctcatccagaaccttggtgaccttctcggcggtgccggtctccagcagcaccgggtcggtgacgataaatgccttggtgaagccgtgctgcttggcgacggccggaatctccttgatcgcgccacgtccgaagtatgcagtctggttgaaaatcatgcggtacaccataggggctctccttttgagctagtgtcttaactggtggtccactctgtctttgagtggtccaacggttccccagtctactccgcgcatgagcattcacctgaaaacacgctgaaagaacaacactgaaaataatggcaagaaatggcggaattccgcacttgtcgaattattgtccattgaccaaaccagttccatcgcccgaaatctcaacgataagaccattttccggagtcatctgacgctctccgagaaactcgtctctcatccgcttacttcgcgcgtagcgcaatcaatatgcgagatgcctaattccattcgtgcttcatcagccgaacgcgaactggttcaccagatggtgtattcaacggtttcagtctcctgaagaggactaagatacctcgacagttggggtgatcatcataagagaatgaggtagataatggcaaatggcaaggctatgacggtcggcgagatggcgtccctgtttctcgaccccgccactcccgttcgtatcgacgctttcgacggctcgcatttcggcccggcagacgcggatttgaaggtcaaaatcgccacgccgaactgcatgtaccagctactcgcgcacccgaatgaaatcggcatcgtgcgctcatacattctgggcgatttcgacgtggacggcattgactacgccgacccgtatccggcgatgcgcaagctggtgtcgctgtccaaatacgttcgcccactcactcccacatcaattgcccgcgtatctgccggcatcctgagccatggcttcaagaagccgccggtgcccgccaccgagggcccgagcaagttcgcccgtatcaagcgtggcctgatgccgcacaccgaaaaggccgattcggaaaccgtcagcttccactacgacatgtccaacgagttctacgccgacttccttggatcctccatgacctacacttgcgcggtattcgacaacgaacacatgagccttgaagacgcacaggccaacaaactgcgcctgattctcgacaaactggacttgcagcccggccagcgcttactggacatcggctgcggctggggttcgatggtcatcaccgccgcccgtcgcggcatcaaggcgctcggcgtcaccctttccaaggaacaggccgcgtacgccaacgaatggatcgcccgtgaagggctgcaggatctggccgaagtgcgtgtgcaggactaccgcgaggtgcctgagcacgacttcgacggtatctgctcgatcggcatgatggagcacgtaggcgtcaagaactaccagagctacttcgaagagatgttccgccttctgaagccgatgggccgactgctgaaccaccagatcaccatcagccatgacaagcctcacggcaagcccggtaccgacgaattcctcgaccgttacatcttcccggacggtgatctcggcgcgcccggcttcatcgaatcgtgcatccatgacgccggcttcaacgtggtgcatcaggagaacctgcgccagcactacgcgctcaccctgcatcactggaaccagaacctctccgagcattgggacgacgcggtcaagcaggtcggctttgaacgcgccaaggtatggggtatgtacatggccgcctgcgctctgaacttcgagctcgacggcatccagattcaccagttcttggccgtcaagccggatcgcgtggcccacccggacggcaagtggtaccccctgcgccaatggtggcaggcctgattcctttttgtgggacggcacgcggtttttaccattgttcatctgccgtcccacacgattctcttcgcacgcgcatttcgcgggtgctttttctgcaatactgactctatgagcgccacagccccgaactacaaccacactgtcaccgcctgcttcgtgggatacatcactcaggcggtaatcaataacttcatgccgttgctgttcgtcacgttcgcggcgacactcggcatcgacatggcgcggctttccgccctcatcaccgtcaacttcgtcacccaactggtcgtggacgtgctggccggcaagttcgtggaccgcatcggatacaagccgtgcattatcgccgcccacctggccgcccttgccggactgctggcgttgggcttgctccccacccgcgtgccggacccgtatctcgcgattctggcggcgattttcctctacgcgctcggcggcggactcatcgaggtcatggtctcccccatcgtcgaggcctgcccgagcgaacacaaggccaaggcgatgagcctgctgcactccttctactgctggggccagctcggcaccgtggccatctccacgctgtttctgtttgcgttcggcaccggctcatggccggttctcgcttgcttgtgggcgattgtgcctgccatcggcatcgcgatgttcgctggcgctcccatgccgcgcattgtgccggaaggcacggcgaccatgcggttcgccgacttgtcgaagaagccggtgttctacctgatgttccttatgatgctgtgcgcgggcgcggccgaacagggcatgagccagtgggccagcgcgttcgccgagtccggtctgggcgtgaccaaggtgattggcgacttggcgggacctgccgcattcgccctgatgatgggcctgtcccgcacgatttacggagtgctggggcatcgactggatctcacggcattcattgccagcagttccgtactgtgcgtggccatgtatctgaccgcagccctaaccacggcaccggtactgggtctgcttgcctgtgcgctcaccggtttttcagtgggtattatgtggcccggaacgttctcgatggctgcagacgccatgcccggtggcggtacgctgatgttcgcgctactagccgtggccggcgacctcggatgcgccggcggccctgccgtagtgggactggtggcctctgccaatggcgacagtcttaagaccgggttgctgttcggatcgatgttcgcattggtgctgttggcgtgcgtagttgcggcgaggaagacagttgttggcgaacgcgagcctttgcattgaccggccagcccgccattttggcctataacccccgccggagtaggtacgcgacggatatgcaaaagccccgcacaaggcggggcttcattatggtggctccgaacggcgtcgatccgttgacctagcgattttcagtcgctcgctctaccaactgagctacagagccatgaacagtcaaaaacccggataatccgggcttcataaccattccagcgaccccggccggacttgaaccggtgacctccgccgtgacagggcggcgctctaaccaactgagctacggggccattgttctcacttgcgtgaggcaacagatgtatatattactgaaattcgccagtcatgcaaacttcggcgtgttccgcataatttcaaggtttttgctatcaccagcacgcgaacacgtctgtcacaaacatccacaaaacgacgaagggcgcgaccggaaccccggccacgcccttatggacggaaacgcttcgcggcatccaccgcaaagtgaccgtcaatctcagtcagcctgcttccaggtgtcgacgtcgatgtggtgttcggggttggcctgccaggcatcccacgcggacttgacgatgtcttccacgtcgtacttggcatgccagcccatctcctcgttgatgcgcttcggggagccgatcaggtgcggcgggtcgccggcgcggcgggccatgacagcctcggtgaacggcagaccggtgaccttcttgacttcgtcgacgatctggcgcacggaggtgccttcgccggtgccgacgttgaaggcgtcgtacttgcgctcgtcacggtcgaggtacttgagggcggcgatgtgggcgtcggccaagtcggagacgtggatgtagtcgcgcacgcaggtgccgtccggagtcgggtagtcgtcgccgaagatggcgggagccttgccctgcttgaggcgattgaacagcatcgggatgaggttcaggatggccggatcctcaagctccaccggaccgcagccggccacgttgaagtagcgcagcgcgcagaagcggatgccgaacggctgctcgcaggcgcgtgccatccactcgccgaacagcttggtctggccgtaggggttgatcggcagcatcgggacgacatcctcaggcaccacatcgaccggcggcacaccataggtggcggcggaagaggagaagacgagcttcttggcgttcttggactgggtcatgccggtgagcacgttgagcatgccgttgatgttctgctggtagtaccacagcggcttctccacggattcgccgacctgcttgcgagcggcaaagtggatcacggagtcgacgccttcggcatcgaggatttcggccaaacgctcaccggcgcccggggcggcgatatccatgccgtacaggcgggagccttcgatgcgagtgggcttgccgtagctcagatcgtcgacgacaacgaccttttcgccggcctgatggagtgcgtgaacgacatgagcgccgatgtagccgcagccgccggtgacgagaactgtcatagttgacctttccttgtgcgggttgcaagtgtcggccgtggggagttcagcggctgttcacttttggtccgctttgttaccttttgaaacaatttgagtatatcacacgaacataatcgcacaaaacggtggtgtcgtccggcaatatctgcattcattaggtcgatttggcgttcattaggtaggtcggcccggagccggcccgcacggacaccgggtaaacggcttgatatggtggttggtatcgcacaccacctacctaatgaacgccaaatcgacctaatgaatgaacagcggtgcggcgcacaaggaaaatccgaggaatatatgaccaatcccgaatccacagcaatcgatcccgtcgccgcgatgggcacagaccacaccgaggcaccggcgcaccccctgcacaaggtgctctccttcgtacgccgctccggacgtttggacgatcgcctgcagcgcgcatgggacaactatgccggcacatatctgttggatattgcggccggcaacctgctggacgtgcgcgaaggcgtcacgctcgaccgcgcgttcgtggagtccgcatggggcaacgataatccgctcattgtggaaatcggcaccgggcagggagaaaacgtggtggcagcagccgcagcccacccggagacgaacttccttgctctagaggtctatgaccccggcgtggcccacacgctgctgctcgccggcaagcaggggctgaccaacattcgcgtggcccaggtcaatgcgcccgagctgttcaaggtgaccgcggccggcaccgtggccgaggtatggaccttcttccccgacccttggcccaagaagaagcaccacaagcgccgcatcgtgcagaaggccatggccggcgacattcatcgcgcgctggtcacagacggcgtctggcgtatcgccaccgacatcgaggactatgccctgcacgtgcacgaggtgatggacggcctcgatggctggaagaacctgggcagcgtaaccgtcagcctgccgctggagcacgtgggcaagggcaatgccgacatggccgccgatatgccgcacgccgacttcaccgaatccgagcgattcgagggccgcgtgctcaccaacttcgagaagaagggcctggccgccggccgcgtgattcatgacttcacctatcaggccgttaccctgaactgattgcgacacgccgaaatgccgtcgatttgcataaccgaacaacctcccgtaaagtaattcgagttgttcgcccccatcgtctaacggttaggacaccagactttcaatctgacaacgagagttcgactctctctgggggtacgcaagtaaaatcaagggctccgaggacttccccggggcccttgattttattgcgtgtgactactgtgtgactaaaagtacgtcttttttgtctgatgacaggcactcgcaagctactttgaattgtttttactcaggtgtgacgcttgtttatcgtgcctcggtttcgttgacgctgatgacgttgatgttatccttggtgccgtccacaaggcaagtgatggcggtgtggcgaccatccacggtcacgttgtaggcggcaaggtactgggcatcgtcaatcccaacctgtcccttctgcttgccaaggagcggactgctttcataggcggagccgggaaagagttgttcgcgggccgcgttgtcgcatgctaccacggcgtctccgtatccgattcctccgctggttgtttccccgtcgtcgggggtctcgtcgctgcctgttggttcctgttgtggttcagccggctgctgctgcgcatccgtggctgtattggcgttctgcgtttggccggctccggtgtccgtgccattgcccgctccagtcgcgccgccaatggcggcaatcaccagcacgacaatgacccagaaccaccagcgcttccagaacggcttcgctgtcgtctcgacattccgatttgtcttgggcatgttgcttcccttcccgtgtcgttgtctctttcggtctgcttggccttagtggttcttcttgacttggttgtttaccgcgaccatgaacttctgcgcgtccttgatggacttgcgatccacctcggcaccccacatgaactctggcccctcgacggtcaggaacttggtgccgccgctcttcttcttcgccgcgagcgcgaacgcgcccaagagcgccacacgggtcgctgtgacacgcgactgcaattcctcgccagcctccagccgggccgttactgccgccagaggctgttcatcgccgtccttgtcgatggtgtgctcgtacagcgtgaatttctgtttgtcggcctcgaacgacgcgacctttttgccgcgcgcttcggcggccgccttcttctcggcctttgcggcgtcggcgttggctttggcctccgccacggcttcgagcgcctgttgtccagcgtccttggcgagctgcgttgcctgcgctttgagattgtcgaatagtcccatcgtcggtcccttctgtgtgttcttggtaaggctttactgattatgccttaccggtaagtccatagtttagtgtgcggggttctagcttgacaaccatgccacacaccccgctgcccgatggatgggcgtcgtatgccaaggaactcgggctgaacgtccaacgccgcaggctggcgctgggcatgagtcaggaacatgtggcgtacaacgccaacctgtcacggttcgcctaccagcaattagagcgaggcgagtcgcgtcccggcacgccgtcgaaccccagtctgttgaacgtgatggccgtggctcaggtactcggcatcaccatggatgaccttctgcctgaaccatggcctgacctgcatacgcggtagcgctcgcggctacgatcggctggtgtcggaatgattgctgggattatcgtcaaacggtcgaatgatgatcgtcggtggcatcagtcccgcctcattgatgtcggcgcttacgcgaggcttgccctcagctctgtccagcaattccctgagcgcagacaactgtcgtggattattcgcatccttcgcctgtctgatcagttggagggttatctgctcggcctgagtaagcgtagctgaatcggataattctttatccagttccgcatcggtcatatccaaaaaacgctgcgcggctttcgacaccgaatggcgattgcccgggaaagtcgctcttcgctcgggattcgtatgaaagcccgtcttggggtggttgccttcggtgaacctgccaagttcgtcacgtccgtcattgttgctgttcatcattattcatgtcctttcctccgcttgactgcaagcggtttgtgtgagcctccagtaggtcgtgttgctcggccatgctgtcgcacgctgcggccactagatagtagaagtcatttttcaggctgcgtatggctcgcgcattgccgtgtagtcctcttgcgtccaattcgcgtgcctgtgcttccagtgcgtcccgttccggctgtatcagaccgcagtagttcagcgcgtcataggcttcgagcatgtacaaatcagccatcagcaattgctcttgatacatgcgtgcgtctacgccttcatctggtgacagtgatagtggattgcacatgtccttcctttcgcttgttcatacccggtctgcgagcgccggcaccttgaacatggttgtggcgctcgctgggttggtggttatttgctttgtgctgtcctagttgtcctagtgtcctaatcgttgatattccagtgttctcggcgtcctagctgtttgtcctagctgttggtggttgtcctagtggaacgtgctaggacgtgtggctaggacgccgtgaatggcggaataacgccaattaggacgctaggacactaggactggcggttggtcgcatcgcgaccatgtagctgatctggaatcgctgttgcccgcagagtctagcttgccttcgtcgcgtagttcctccaatatgcgatagacatagcctcctttgcggtcagtacttcgcgcggcgttgctgattctccaaccgactatgcctttcctgtccgggtcatgtttgtctagatagttcagcacggtgtttttcacgcgttccgcttttcgtttgtcggcttcggcccttgcgtcatcatctaaggcgattgcttcggctttcagtgtgcgcttgatctcctccgcctgttggatggcttcggcacggaattgggcggacttttcgcagacataatcggctaacgtccagtcccgctcccttaccttcaacgggtcattgggatgatcgagcattgccagcaaggcggcgaccttggttttcaagccaagccggtgcgcgtcaagcgggtcagacaccttgccgtgcaaggtatccgcccgaacacgccttgcttccgcgtaagcaatttggggatattccattaccgtcagcggatagcttgtttcgccgtgatccatcatgtcgtaccggctgccggcttgatagagcgtgtccaaggcgctcaccatcatatccgccggtagtgctgctacatcgaacgggaatatgctgccgaaaggcgcttgcgggggttcctcgggagcctccgagtcggttacgggcgcgaataggaaccgttggggcaagcctgtgcccgactcgtccagaatcatgcccaagttcgagggctgcacgccagtgatgagggaaagccgatacccgtaccggggcacggtataccggttggcctcgttcttggtgaaacagcccaagtcttcgcctgaccacgcgctagtgagcatcggtatcagtatggaaccttgacgcttgctgttacctcccagcactgctatctccgggatgtctagcaaggcgcggcagttggcacacaccactacttgaacctgcctgtcgccttcgtcctgttttttccgcgtcgtgaacatggccggtatgccttcgcctgaagcgggctgggcggtcatggccttgcggatatcgggcaccaagctacgggccacgccagtggtcaatcccttgcccatgccgctggggcccagtatgccgacgaatacgttcaacgaaccatactcgctgctgaccagcgagggtgtgaccacgtgtggcggcatcgcgaccgatatgcgcgccagcactacgaacagtgtggcccaaggcgcaacctgcttggccctcgcgtaatcgaacacataccgcaatgacggggtgctatcccagaattgacgttcgtccatcattaggccacctccccaagcattacttgtaggaaagcaagcgcacgcatgatgtcgttacggcacgcgcgggtcatgcccgagtaaccgtgctgcttggcgaagtcatccaacctctcgcgggtttgcagccgttggatttcctctctggcggcttctttggcggctggggaaccggggtagctgttcatcgttctgtcaacgcttgccccggagttgaccatgtaatcagggtggataccatcaggcctgtcggctataatgggaaccgttgttcgagccgctggaatgtttgtaacgttctggcggttcatttttgatcaccgacctcagcagtggcaagcgcggtgtaaatgtcttcgggaacgacgcctgcgagcgccgccacgtccttgattcgaaacctgattggccggttatccctgacacggttgggctttcgccgtcctaatttgactctggggagttcgccagaaacaatccaccgtttaacggtgctttcactgacatgggcgacgaaagcgacttcttgaagcgttaaaagagctgcgtgcttatgtaaaaaaggcatgccaaatccttcccgcaagcgcacgatacttgcttcaggattcggttcgaacgttcacgtcgttgacgtgagctcccacgcgctgtgaacagtctagcaggggtcatctactgtcatcaagtttcaccgatgattactctgatgggcaaattcccaaaggtcgcatacccgtactttgcctgtgtatggaatgatttcctgcgaatccgcgatggtgctatcgagcataaacaccgaaaaccgaacaccattcagcatgatttcgcgtgattttcccactggttcaatccctatgtcatcatggagcatttcttctcgctttacgcgcgagattgcattgacttgatcgagtagcttaaccgcccattcatcttccgcaaagggatacaactcgacgactatacgccactgtttctgtaattttcctcgatatttaatcggcttcgccggctgcttccactgcattgtttctttatcgaaaagatatcggaatgcttcattttcacggtggtgaagcacggtttcatcttcgtcacgttcaagtctatgacgtatatcctgcgcctgtcggcgagtgctcgctgcatctttttttcgcccgagctgttcgaaataattggccaagcgctctaggcggcagatgctcttttgctcttcgtctgttagtttgcgaatcatgccgttgcctttcttggaaatacgattaacgaggaactgtcatcaagccggggcagccggttcgccaactccgctgttagcccatgctcttgttccagatacgagagtgaggcagcaggcgtgccatgtcccaacgcggcctgaagctctttaatgccgacaccactcttagcaaggttcgtgccgaagaagtgacgcaaatcatgccaatgtatcggtgcgtctatacctgcgtcggccattgccttgtgcagcacgcgcccccacgttgccgtgcttacgtatttggcaccacgactagtgacgaacacgcgacagttcgggaactggctgacgttcctgcgtaaatgcgtctcgacatcgggggttatccattccggcaatgtgacgaaacgcacgccgtctacggacttcgggggtttcacgatccactcgccgtcaagccattgtgcctgtttcgtcacatgaatgacaacacgtccgttacgtacctcgatgtcctgccgttccaaggcggataattcaccggccctaaggcccccgaatgcagctatcagcaccgctacgcgccactgtccctccaaatggtcgaggatacgcttcaactcgccagtggtcggcgcacggtgttctttgcctgttttggagcgtgtgagttcccccggcacggggtttttctccagaacgtcatcgttcacggcggtctgcaaaatcgctttcaatacgcgtgcttcgttgcccgccgtggtcgccccggcatccttgcaacgcttagcgtgccatttacgaatcaacggagcatcaatgaccgtaagcgaatacgggtcgaagtaactcaaaccatgttccagcattcttagaatttccgccttcgtccgaggtgccagaggtttgcccttgcttgtgcggtgctgttcgatccaagtgtgggcatactctttgaaatttgtggccttgatagctgcgggcggcttcaaggtaccggccctacgctccgcttcgagttccgcgcggtagcgttccgcctccatcttgtcgtcaaaagcagatgtggcgtaccggtggccgttcaaataatacttcacacgccacttaccggatttcagcatttcgagtgtaccgaacgtttccgtccgcttcttacgctcacgggtaacaccattgatggtgtattcgaccgtcggggttttacgccgtgccatctatacctccagtttttagtcccacgattagtcccacatgtgactactgtgtgactacttgctggtattacctgaccttttatgaactattctaacatgacctaaagccaataaacagtaagcttgagaagctataaagcagcttaaaatcaagaatggcggaatatcaacgaaaaaggcttattgccagtctttcaatctgacaacgagagttcgactctctctgggggtacttcactaaagaccccggtcatagcgaccgaggtcttttcgtattcgcgggaccaggtctgaaagcattcggcccgcttgatatgtgctcatggtttcatctcagcacgtgttcgcgcccgccacaaggactatcccaccgtagacgatgtgacatcctccacactgtgacttcgcgcacagggtcccgacgccaccctcaccccgtttatcgacaccatgcgtgtataaccgcatatggcatcatcggcgaacatcggccggcagaccagttgtacaaggagaacatcatccacatggcagacaccgccaacaccaacaccaacgcctggctgccggcgctcaaagcggcgtttccgctgaccataccgatttgcctggggttcctgtttctcggcgcctcgtatggcattctcatgggcaccaaaggcttctccttcgtatggccgatgtgtatgagcgcgttcatcttcgccggttcaatggaattcgtcacggtgaatctgctgctctccgcgttcaacccgctcgccggctttctgctggccctgatggtcaacgcccgtcacctgttttatggactatccatgctcggcaaattcaaagggctcggctggaagcgcccatacctgattttcggtatgtgcgacgagacttttgccatcaactccaccgcgaaaatccccgccggcatcgaccgtggctggttctacttctgggttacgctgtgcaatcagctgtattgggtgaccggcgccacactgggcgggctgatcggcgcgcatctgccgttcaataccgacggtcttgatttcgtactgaccgcgctgtttctggtgatcttcctcgatcagtggctcgacggcaagcatcgcgagcgactgtccgccgtcatcggtgtgctgacatcactggcctgcctgctgatattcggggccaatgatttcatgattccctcaatgatcgccatgctgatactgttcgtcgcgctacgcccgcatctggacgtgttgcggccggccgccgacgccccggaagccacggcagaccatgccatgagccacgcagcggaccagcagaaggaaggacagacgcgatgacgatgaccatctggcaaggcgcaatcactatcgtgacggtggtgctgggcacgatgtgcacccgttttctgccgtttctggtgtttcccgagtccaagcagccgccgcgcatcatcgagtatttcggccaggtcctgccctatgcgatgaccggtctactggtggtatacgcactgcgcaacaccccgattctgaccggttcacacggccttccggaactcatcgcctgcaccgtcatcgtgctgctgcacgtatggaaacgcaatatgctgctttcaatcgccggcggcacaattgtatatatgttgctggtgcaactggtgttctgaggcacccgactcgttagtctctccctccgcttcgctatgctcagcacctcccttacagagggaggtaatcttctgtaccttcctctgacgagggaggcggcaccgcgaagcggtgacggaggtagagacccgcagtcgtaagactgcgaaacacacagcatcggccacaggccgattcctacagctgcttcgccacccaatcgacgatgtacggggcgacttcctcaatctggtcgatggcgacctcgaactcgtgcttgccgccgtaccacgggtccaccagatcgatctgatcttcgcggccgggcttcggcttgggcagattcgggtcgaagctgcggtacatgtgcacttcggcgcgcttgccggccggcagcatgcgcagcagggcgcgcatgtgggaggcggtcatcggcaggaacaggtcggtacggtcgatttcctcacgcgagatgcggtgtgcgaagtggtcacgcggaatctcatcaccatagccacgttcgcgtagcacgcgcacggcacgcgggtcgatcgggtggctccactcctcgtcggacacaccgctggattccacgttcacctggtcgccaagaccgcgctcattaaagaagtgacgcagaatgatctcacccataggcgaacggcagatattgccggtgcagacggtcattacggtgtagggttgggtattgctcatagctttgaatcaatcctcaatcgggcttcaccgggccgcacacggcccgactgtattgttggggtcgaatgaatatgaatccggctcatgccgctataaagggcataagccggattcgcatgcttacttggttttggccaagatacggaaacgataggaatcgatgccggactcctccttggcgggcgtatgccactcgcccacttcggcttcccgccacatcccggcctcgaccagcgacgccatatcgggcgcgtagctgtcggcatccacggtggcggccagatcagtcacataggctttgtccgcgaacggcaaagccttggcgaacaactgggcgccgccgatgatccaaatctccgaacggtccagaccgtcgtccggaatcgcctcctgacgggccatatcgagcgcgtcgtcaagactggtgaccacagtggcccccggcgcacggtacatcggatcgtgggaaacgacgatgttgtcgcggttgggcagcggccggtacttgccccccagcgattcccaggtcttacgacccataatcaccggatgggagacggtcagctccttgaaatgcttcatatcctcggcacagtgccaaggcatgccaccattgaggccgatggcaccggcgcgaccttccttgtcacgggcttcggcccagataagattcaccgagaaggtcttgggataatcgtcaccccagtcttcttcagtggcagacagcccggcagatccgggctcgggttcgtgatagccgctacggctactgtcatgctccatttcgcttactcctcctggattgcggaactgggccttagtgtagtggacagcgaagactcgggggccgtcaccttcacagtattcgctgtccacgaaacggtaatcagcatcagaccgcaacaggtgccttaatagtggggtgatgctggtagccgacgaccttgaagtcctcatactggtagtcgaacagggaatcggccttacggatctcgatggtcgggtacgggtagggcttgcggcccagctgctcaaggaactggtcgacgtggttgtcgtaaacatggcagtcgccgccggtccagacgaattcgcccggcttgagcccggcctgctgcgccatcatcatggtgagcagcgagtaggaggcgatattgaacggcacgccgaggaacatgtcgcaggaacgctggtacagctggcagcttagcttgtcgtcggccacgtagaactggaagagcgcgtggcagggcggcaacgccatcttctccacctcggccggattccacgcggagacgatcatgcggcgcgaatccggatgatgcttgatgaggtcgagcacattggagatctggtcgatggtgcgattcgggtcctcgggggtcggcgcgggccaggaacgccactgcacgccatagaccgggcccagatcgccgttctcgtccgcccactcatcccaaatatgcacgttgtgctccagcagccagttgatgttggaggaacccttcaaaaaccacagcagctcataggccaggcctttgaagaacacggtcttggtggtcagcaacgggaagtacttcgacaggtcaaagcgcatctgctggccgaacagggaaatcgtgccggtgccggtgcgatcggacttcagcgtgccttcggtcaggatcttgcgcaccaggtcctcatagggcatcggaatgtccgtttcgggacgtgcggggatacgggagcgaatatctgcgagttgttcttcggtcaaagccatgtgcaccagtgtagcttaggggcataatagagaagtccactgatgcgggagagcggccaggtgccgcgctcccccgctggcatggcgatgggccagatcgccggcggctgaaaataaaggagcagctatgggtaagcgactgtgggttgagcgtaacaaggacggttcgtgggatgcgttcagcgacgatggcgcacacattaagttcggcaaggatcgtggccagttcacgccgggcgatctgatgaaggtcgcgctggccggttgcgccgcgctgtccagccagttcgccatcgaacatacgctgggtgagggcaagggtgccaagattgtggtggatggcacgtacgacccggaaaatgacgcctacaccggtttcgaggagcaggtggtgattgatgcttccgacgccggtctgtccgaggaggatgccgacaagctcaaggagcgcgtcacccgccatatcgacaagggttgcacggtcaagcacacctacgtgcaggagaccccggtgcgcatgaacgtcaccgtcaagcactgagacgggatataaattgaagaggctccctggcgggagcctctttccgtatattcggactttactggcgatcgggatcgatggtcttttcgatctgctgggcgacttcaggctcggctgcggacaccggaatctcctcgacgccggcaatctcctccagcgacttggtaggcacttcggcgggcgagctcggcacggtgtcgagacgcgattccgcggcctcaacatacttgcgtggcaccacgtacaccgggccgaccgcatgctgcagcaggccctggctggtggagcccagcagcaagccagtgaagccgccgcgaccacgggagccgacaacaaccacatcgtgatcgtagctggccttggtcagggcgctcacggccgggccggaaacgatctgcttgttgatcttcagatcaggatgcgattcctgcaacggcttgatgcgcacctcaagatcgtccttgtaggactccatgacggcgtcctcgccgtccacacccttcaggttcggcacagcggaaatcacgtccagttccgcaccccagcacgtggcgaagtcggcggcaatgtccagcgccttcagaccccacttggattcgtcggagccgacggccaccttggtgatcgtgttgttcaggtgcatcaggttaccgtcatcatcggtgtacggcaccaccacaatcgggcagtaagcatatgccggcagcgatgaggacgtagtgcccagcaggcgctcggccagaccgcccttgccacggttgccaatgacgatcagattgtagttacgagacaattcgacgaacaccgatgccggatctccggtaacaatcagtgtggcggcttcgacgccctgctcgtctgcgatggccttggccttggacagaatctcctgagcatcggaatgcgcggcgttatcgtcccccatcgccgtgtaagtggcatcgaacgaaacggcggcatagctcggcagggaatatgcgcagacaatctgcagcgtcagccccgcgtgctttgcataattcgcggcccaccatgttgccttgtaactggcatgcgacccgtcaacgccgacgagaatagccttgtcgttaatcatgacgacctccttgaagttattgcggcacgaataccgcgtatctcaacaataccccgcgacactcggtttggccggtatcctccgctcaaaaagaaatccgcgtatacgaaaaaaggcacaccccaaaggacgtgccttaatacgaattcgcttaccgcataattcttgtcacatcacgcggcgaatggaatatccagctccaccgaatacggaaacgtcgcttactgccgttccctgcaccgggttcatagcattcatcacctgtccgttaccgatgtaaatggccgcatgagtaccattcgcaagaatgtcacccggcttggcatccgccaagcttgcgaccggagtacccacggtggcttgagcaccagaggtacgaggcagggagatgccaaactgggagaagacgtactgcacaaaaccggagcaatcccatcctgccggagtgttgccgccggcaacatacggatagccttggaacttcagtgagaagctagcaagctcagcgccagtgccagtgccagtcattttacccaagtcaacctgtggaatcgacgcacgctgttcagagcggctggctgccgcagcagcagcggactgggctgcagcagcttcatcagcggctttctgagccgccgccgctgcagcagcttccttctcgccctgagactcggtctgtggcacatcaagagtctcgatgccaccccatttagagttctcatcaaccgaggtggaggtggattcggcgaacaaattcttcttcaccgaactcgccttcgggaaagaacgtgaggacaccacagcactcgtctgcgcggaatcggcagaggcaaacggggctacgcacgcaaacatggcacccgtggcgataatcgccactgatgtggaaataatagtcttaacgctcatcatcaacgccatacactagcacacatgggtcgatttcataacaggaatagcatttcgaagatgatgtcgcgggtgcatcattcggcaggagaacgcaacaggcctcggataccgatcggcatccgaggcctgcaataaatcaatcaataagactgcatcacgggatacgcaccacgatggtgagcttttcggtcatggcactagcgagagccacgctatagccattccatccaccatggaccgcctgaccgttgccgacatacaacgccacatgatcgtagtgtgcaccaccgttccatccaccggtgttggcataaatcagaatatcgcccggctgcagggatccgtctgtgactacgtggccaccaggaacattgacgtactcttcaggccaaccgtggaagttaatgccacgggccgccaacgcttgactgaccaatgcggtgcagtccatgctctgtccgatcaaagaatacgcacggtcgatagaggcaccggcaccagcggaaaccgaaccactggcatcggaataagtaacagaagagcgagactcattacggctcgcggcgttggcctgctcctgggtcgcctgagcctcgacctccgcctgcttctcggcctcctcttcggcagccttcttggccgctgcggcatccttttccgcctgagattccgtctgcggcacatcgaggttctcaatgccgccccaatcagcattgtcctcaacgctcgtggcagtggcttcagtcgtcagatctttgcgcacctgggtgtacgaggggaaggacttggtggaagtcacagtaacaccctcagctgcagttgctgtaggaacaaacataaacaagcaggcacaggagacaatcgcggcaacaatggaagaagctacagttttggtcttcatagaaccatcaccctacacggtgcgcattaactcgtacaggatggaagaaataaaacaccccggagctattgggatatatcggcgtgtcggcacaggtcagttcggactaatacgcggccgcaacacttgaaatgtcatttcgcgcgaacgattgccgatagggcgacgtcacatccgaacagtaatcaccgaatgtaagccaatgaaatgaatcagtagtgaacgtactggaacttaccggcttcggcggcgctgaacgtacgggtcgaaatcacacccaatcccttggcattggattcggagatctcaatggagccgtcggcattgatcttttccagaacggcaacatggccgtacgcgccatcggcatcggcctggccaggagcgaacaccacagcatcaccgacatggcgaggagtgttgtccacccaatagcccagagcggaagctgacgccgcccacgcgccaccattgccgaagttgccgctggaaggcaggcccagttcggcacgacgctggtacgcgtaccacgtgcactgaccccacggatagttgttggagttggtgccaacggcatggttcgggttgaagccagccggcacagcatcgccatcggcatccacgagagccgacaccacaggattgttcgcattattgcgattcatcagcttggcgtccaaggtgctgtctgaattgctcagcccccagccgccttcattggtggactgtgcggtaacggaggatgaactcaaatcagtacgcgcttcggaacgagaagccgcagtcacatcgctgatgcgcttaatctgcgtggtcgtcgtggccggatcagccacgaacgagttcgtggcgtcttcattgttggaaaacgcgagagcacctgcggccgtgccgaccagagcggccagtgaggccgaggcaagaatatggctacggcgttcagcggcacgagcggcctcacgaatggaacggcgggtctggggagcgatttcgttgatcttctcggcaatggccggatcaagccccaaaacaacggcgtcgctaccagcggattgcaccgcacgcacagcacgaacggaatgagaacccttgccggaggcaaacaatgccttcgctaagctgaacttctggcgcgagaccgtggtcgctttatgcgaagcatgcttcatactacgttaactccttggatgggttcggcggggtcatttcgatgacctcgtatgaccgtcacaattgagtactgtacaacgaacagaggtcaatcctcaatgtgatcccccaccatccgggtgtgtcaaacgatttacgtaaccgtgcggccgggtgaaaaaactgccttgtttccgcccgttcacgaacctcactatccggttatcggaagaatcactaactcatgtcattccgacacaccgtaaccatgatgtgctgcgtacattctgcactgcattccgcattgccaccactgccgcccggcaccccggaattccgcagtaaccccgcagtaatcccgcacaccgagcattatccgcgatattccccaacactggtctacccttgaaaccatgactatcacactgagtattcccgagtcgctgaagcccgaagatggtcgcttcggctccggccccagcaaaatccgccccgaacagatcgccgcgctcgacgccggcgccaccaccctgcttggcacatcacatcgccaggcaccagtcaagcaactggtcgcttcgattcgtgaaggtctgcgcgagttcttccacctgcctgaagggtatgaggtggcgcttggcaacggtggcgccagcgcgttctgggagattgcctgcgcttcgctgatcacccgtcgcgccgcattcggcacgtatggctcgttcagtgccaagttcgccgcgtccgccgcgaacgcacccttccttgaagacccggtgctgttccccggcgagccgggcacttaccgtctgcctgagctcaccgagggcgtggacacatattgctgggctcacaacgagacctccactggtgtggccgccccgattcgccgcgtggccggaagtcgtgaagctggtgccttgaccgtcatcgacggcaccagcgcagccggcgctttgcctgtggacatcagccagaccgacgtctactacttctcaccgcagaaggccttcggtgccgatggcggtctgtgggtcgccatcctctcccccgaagctatcgatcgtgcggcaggcgtcgaatcaagcgctcatctggaaggcgcacatcgctgggtgccgccgttcctctcgctgaccacggcactgaacaactcccgcaaggatcagaccctgaatacgcccgccgtggccaccctgatcatgatggaaaaccagattcgctggctcaacaacaacggcggcctcgcctgggccaccacacgttgcgccaagtccgcatccatcctgtactcgtgggccgagcgctccgaatacgccgctccgttcgtcgtcgatgcggacgcacgctcgaacgccgtggtcaccattgatctggacgagcgagtccaggcctctcaggtactgtccatcctgcgcgagaacggcattgtggacgccgccggctaccgcaagctgggccgcaaccagctgcgcgttggcgtgttcccctcggtggaaccggctgatgtcatggacttcaccaagtgcgtcgactacgtggtcgagcacctgtgatggcatatatgccccgcattgccgaccatatatgccatgcacattgatcggtctcaactgatgccgattgaataaatcgtagggagggatgtttgacgcccctccctactcttactacagtgcatgagtatgaagttcgcgcctctcattgaccctgccgtccgcaaacccgcacccaagcccgtacgggtggatctgcgtaaggtgtttgccatcggtaccggtctatggattgtggcgttgattgtcgtgctgattctgctggccgtgggctacagcgtaatgccgttggtgattatgtgcgtggccggcgtcattattggcttgctactgctggtctgggaatacttcgaccgctgggactaccgccgcctcggacagtaacgcaacacaagctccctctgatgacgggagctgtcagcgtagctgattgagggagagaccgcggccgcaggtcgctcatcaaacagcattggtggcatgcaaggcatgccaccaattccttacctcactgcgccaacggcaacgtaaggctgaacgtactgccttgcccgggcgcgctccatacggtcacatcgccatgatgggtcagcgccacatgcttgacgatggccaagcctaggcccacgccatccgccgtgcgattgctctgttccacgccccggtagaaccgctcgaagatgcgcgcctggtccttcttagcgatgcccgtgccttggtcaatcacgcgaatcaccgcgcggtcgccatccttgtctttggatgcggacacgctgaccacgccattttccttggaatagccgatggcgttttcgatgagcttggtcacggcgctgtcgatctggtccgcctcaccattgatgactagatcatcgtcgcccttgatgttcagctgcacgccagcctcggctgcctgcggctccagtcgcgccgccgtggccctgagctgttccataacgttcagtcggttggcggaagacggcgtaatcggctcctgcgcgcgtatgagcagcagcaaatcagacaccatgtggttgagcttgctgcagctggaacgcacctggcgagcgtcggcagccacctgctgttcgtccagattgccggactccagcgaatcggcgagtttggccagagcctcagtggggcccaacaattgctcggacacattggtaataaacgagtcacgcacttgagcgaaacgaatcacatcactgacatcggtaatcaacacgatgacgaactgctcgttgatacgccctacagtcaccttcagccagttggggcggtggacggactgcgtggcgacgtgatcgcccttgttctggtctgcgacgtaccgctccggagtatcggtggtcaagtcgaactggcgcttgccaccggacttgcgcgcctcgtgaatggcatccagcacatgctgctgggcaatggcgtcatctgacaccacacccaggcggtaggcggcgggattgcagcggaccacctcgtcgtgctcgtcgaccaccacggacgcacctggcagcatggacagcagcgtggcggtgtcgtcggacagatcgtcattgtcgtcatcatcggccagcggcgattccatggacactcgatgtgtcgcaaatcccacgatgagcgtgatgattcctaccacaaataaaacagccgtgacaataagagcaatcgcggcgacgagcggcatctgtgtcatgcccccattctttcacaccacacgccgggattgcggtttgccggcacgccggtaacatgaatttcaggtgaacaacccaatgaacagtagaacaacttgaggttgccattacctacgttgaagtggggaacaagtactggaataatacactggtacaggttgcaataagcaagcatgaaaggctagagaaatgcgcgttattttcaacgaggagctgaagcaggttgctgacgacctcgaccgtatggcgcagaacgtacgcaaggcgatcaaaggagctggggaagccctgctgaatcaggacgttgaagccgcacagactgtgattgacggcgacatcgaaatcgatgccctggagtcctctgtgattgaccagtgcgtcaagttgctcgccaagcagaatccggtggccaccgatctgcgtgtggtcgtttccaccatgcgtctggcttccacgttcgagcgtatgggcgatcttgcccgccacgtggccgaggccgctcgccgcacctatccggccgccgcgattcctgaatccgctcaaccggtgttcgccgagatgatcgacttcctggacaacaccgctgaccagctggtggccatgctcttcgatcgcgatgccaagaccgccgaggccatcatcctggctgacgacaagctggacaatctgcaccaccagaccttcgatctagcgctgtccgatgacatcacccgtcagcagaccgtggatatcgtgctgctgggccgcttcctggagcgtctcggcgatcacgccgtgtccgccgcccgccgtgtggtgtacatcgtctccggcttcgaccccactaaggagccgacccgcgacgagggcaccgacatcgactgattgggacttgttctcacattgggcgaataactgaacacttgttctcctgtggtttgaggaggatgcccgaaagcggcgatccggctacggctggacgccgttttttgttgcttttgggcggtacaccggcgtatccatggggcggcaaaacacccatagggcggtaacttgcccatggggcggtttgaaggatatgtgaaaccgcggaattaagccattctggcataccgccccatgagggttttaccgccccatggggtaatcaccgccccatgggggatttggcaggcatagcaaaggggagccgcacgttatgtgcgactccccttacagcttgtaccgtgttagcggcttaggctcacttctggccctgagcggcgacagcggcggcaccggcagcagcagcctccgggtccaggtactcgccacgcggcttgatcggcttgaagttctcgtccagctcgtagagcagcgggatggcggtcgggatgttgaccttggcgatctcttcctcagacaggttgtccagcatcttgacgatggcgcggagggagttgccgtgggcagcaatcagcacggtcttgccggccttgagctccggctcgatagcggactcgaagtacggcttcacacgctcaacaacgttggccaggcactcggcttccggaaccggatcgccggcgtagcgcgggtcgttgttctgggcgtactggtcgttcgggtcgatctcgggcggcggggtggcgtaagaacggcgccacagcatgaacttctcgtcgccgtactcttcgcggatctcggtcttgttcttgccctgcagagcgccgtagtgacgctcgttgagacgccagtcacgctgaaccggaatccacagacgatctgcggcatccagagcgatgttggcggtgttgatggcgcgacgcagcagggaggtgaacacgatgtccggaaggacgttcttctccttgagcagctcgccgccacgcttggcttcggcttcaccctgctcggtcagcggtacgtcgacccagccggtgaactggttagttttattccatgcgctctgtccatgacggagcagtactagtttataagtcatacggttcagtctacagccgcgtgcgcccaaacacgagtattcgtcttattatttcgctctcagagcgtcacggaaaccgccagcaccaccgcaaacagcaaggtctggaagctggcggcgggcagagccgggcggaattgacgtttattcacgctggagaccatgcgcacaggtattccgacgcccgagatcaacagcactgcgccccacggccaccatagggtcgcgcacatgagcagggctatggcccacgcggccacgcagcacacaatcagcagcgtacgcgcgccggattcacccagccgtacggccagcgtgcacttaccatgctcacgatcctcgtcgatgtcacggatattgttcaccatcatgatcaggcaggagaacaggccagccgccacagcacccaatagtccgccgacgtccaccgtgccgcacagcgcgtattcggtgcccaataccgcagccaagccgaagaacaggaacacgccgacttctcccagcccgacgtatccatacggatgcttgccaccggtgtagaaccagccggccagcaaggaggccacacccacggcaaacagccaccaagcttgggaaatcacgatagcggcaatgccgcatatgcaggcgatggcggcgcaaatcatcgccgcgaacagtacatgcttggccggtaccagtccggatgcggtcagtcgctggggtttgcctgatttcgattcgtccgtgtcacgcccggcgtcagtgccgcggatgccatcggaatagtcgttcgcatagttgacggcgatttgcaggaacagcgcgactagcaggcacaggatggtcaccggccagaatcggtccatcagcagggtctgctgttcacgggccgtggcgcaggaggccggttcgggatatattgcgatgcaggtgcccgactgctcgatatgcgcgtatgccatcgtcgccccaaccatcaccgacgcgatggaagtggccaaggtcttgggacgcgcgccccgaacccacaagccgatggacataagcaatccctttcatatataactcggctcccctctctgaggggagccagagtatgcctaatcagccaacgagcggcttgaccagcgggaaggtgatggtctcgcgaatcgtggcaccggtcaaggcgataagcagtcgatcaatacccatacccataccgccggccggaggcatgcccacgccgagagcctcgaggaagtcctcatcgatgtcgcaagcctcttcgtcgccagcgagcgcgtccttggcctgagccacgaaacgttcacgctgcacgatcgggtcgttgagctcggagtagccggtagccagctcgaagccgcgcacgtagagatcccacttctccaccacgccgggcttggtgcggtggcccttgaccagcggggaggtttcgaccgggaagtcacgcacgaaggtgggctcgtaaagcttgtcctcgtagaagtgctcccacaggtgttcgacgagcttgccgtggttctccacgtcgtcgcgctctacgccgagcttgtcggcgatggcgcccaggtgctcaacggaggtgccgggggcgtccgggccgccattcggcacgatctcctcgcccaacgattcggacagggagtcgtacatgctgatggtcttccattcgccgccgaagtcgtattcggtgccgtcgagcagggtgaccttgtgcgagccgtagacgtccatggcggtcttctgcacgagctccttgaccagctggccgatggaatcataggtgccataggcctggtaggcctcgaccatggtgaattcgggggcgtgcgtggcgtcgacgccctcattgcggaagtcacggttgatttcgaacacgcgatcgatgccgccgaccaggcagcgcttgaggaacagttccggggcgatgcgaaggtacaggtcaaggtcgaaggcgttcatgtgcgtggtgaacgggcgggcggccgcgccaccgtgcagggtctgcagcatcggggtttcgacctcgaggaagtcgtggtcgtcaaaggtgcggcgcagggaggccacggccttggagcggttgcgcaccatgttgcggatgttctcgtccgcgatcatgccgatgtacggcttgcgggtgcgggtgtcttcgttcaggtccttgtgcagggccggcagcggctgcagggccttagaggcgatagcccactcagtggcgaatacggacagctcgccggtcttggaggcgatgacgcggcccttgaggtacaagtgatcgccaaggtcgacgagctgcttgaactgcttgagcgaatcggcgccaatctccttcttggagatcatgccctgaatcttggtgccgtcaccggcggacagctgcacgaagcacaggccgcccgcgttgcgcaggaacagcacgcggccagcaatgccgaccatgtcttcggtctcttcgccagcctcgagcttgccgtcatacttggcgcggaccgcctcgatggtgtcggtgacgtccaagtgcaccgggtagggggcgatgccggcctcaagcatcatcgcgcgcttggccacgcgcatctgcacctgctcggggtgggccagcgggccgaactccttgttggaggggtccacggcttcgtccagcgtggcaccggacttgatcttctcgcggatggtggcgtcctgcttgagcagcatttccgcacgttcgacggtgctcatctgcgggacggccggggtttcattctcagtgttttcggtattttcgacaacttcagccatgattcatcagtgtacgcaaggccggcgattatgagcccggcagaccgcacggccatccgaacacccgctcacatgacgcaaaaccggccctgcacaaggcttgagagacctgtacacatggcgaatccaccatcacgcaacactcgcgacatgccgatttgcattgtccaccaccacaatgtaatatctacatctgttgccaaacgggctgtagcgcagcttggtagcgcgcttcgttcgggacgaagaggccgcgggttcaaatcccgccagcccgacaactggaccggattgttgagaaatcagcaatccggtttttcgtttcctgtcccaacaatcaaaccaagcgatcgaacagcggtaaacaacccgccgcacacagcgacaaaccacatcacggcaagcccccgtatttgttggcggaccaccgtaatatatcgctcgaatcaatcgattgccgcactgtttttgtaagtaatactgaagtaattagaggaaccatgaagaagagtctgcttgcactggcttcgggcgcgttcattctcggtgccgccgagttcgtgatgatgggcattctgccgcaggccgcggccgccaccggcgtggacatccccaccgcaggccattacatttccgcgtatgcgatcggcgtgtgcttcggcacactgattctggtattcggccgcaaggtgccgccgaaggacctcatcatattgtttatggtgattgccttggtgggcaatctggcttccgcattctccgtcaatgccgccatgctggtcgccgcacgattcgtcgccggcctgccgcacggcgcattcttcggcacagccacactcatcgccaagactctggcggaggaaggcaaggaggcgcaggccgtatccgtgatggtcaccggacagaccgtggccaatatgctcggcgtaccggcgggcaccttgatggccgagttcctttcctggcgtcttgccttcggcattttggccgcttgggcggcaatgacgattgtgctggcgtcggcgtggattccgtacgttgcaccgatcaaggacgcaggcatcgccggtcagttcaagttcctcacccgccgtggcccgtgggtgattttggccgccgtgttcaccggcaatgccggtgtgttctgctggtggagctacgtctccccttggctgcagaaaaccggcggatggtcgtcttccctggtgccgatgctgatgatgcttgccggctttggtatggtcatcggcggtctgcttggaggtcgtctgaccgaccattggaggcatgccggcgcggccgcaataggtcagtccatctcctgcctcggcttgttgctggtgcttatcactccgggtaatcagccgatgaccgctgtactgacgttctggatcgccatcggattgttctttacttccgctccacagcaattgctgatgaccgaagccggccagggcggcggcgagctgatcgccggcgcggctgtacaggtggcgtttaacttcggcaatgccatcggctcgattgtcggcggcgcgatgctcaccaccttctcgatgaactatcgctataccggcctgggcggtatgccgctggctctgcttgccgtagggctgctggccttctactcgtggcgctgcgaaaccgataccgacgccattcaccgcttgcgcgaaaccaaggtggactgagaccaagctcacagcaaactccctgacgtgtttgttcacagtattaatagactgaaatcagacacgattcagggaggtctggcggtatggatgaggaagcactgctcaaacaattcgccgcgcaattcgcgcatggtccagacgatgccgacgacaccgatgcggcggccgcagcacaaggtgccgattccacggcgaaccaggttgcggacgatgccgatcaatcgcccgcaacctttgatacccaacaattcctgaacggactggacgcgattttcgatcgccacacggccgccaccgaagccggcccgtacttggaacaggcgatggtggacgcggaaaacgccggcgacgaggccggactgctcaccgtgctcaacgaaacgatgggcttctatcgctcgcaaggtcggcacaaggagaatcagtggattgtgcagcgagcgctggaactggccgctcgtatgggcttgaccaccggcacatccgaggcgtgggccaccacgctaatcaattgcgccacctcgatgcgcgcggccaaacaatacgatcaggccgaggatttgtatcatcaggcgcagagtgtctgccggcattcgctggcgcccaccgaccgtaggctcgcagcactgcacaacaatctgtcgatgctctacagcgagacgaatcggcccgacaaggcggaactggagttgcgtgaagcgctgcgcattatcgaagcctcgagcgtgaacccggacgcggatatcgacgtgtccagctcgcacacgaatctggcgttgaccctgctgaccgaacacaagttggaggacgcgcattggcatgcagccaaggcgctggaaatctatcgcaccggccatctggaacattccgcgcattatgcctccgcactggcgggcttcgcgcaggtgtgctttgccgagagacggtatgcggatgcggttactggataccggcatgcgctggccgtgatcgaggaatgttacggcaaggacaccgattactggcgtatcaccgccgacaatctgcggcaggccgaggaagcggcgacgcaggccggggtgacggttgacaatgcaggtgttgccggcgatgcaggcgcgctgccccagtccggctcgcggctgccgaacagcccggcacagggcaagaccggtgcgaacgcggcatcttccccatccaccgtttcggtgtcgaccggttctgcgggcgcggccgaggccgtttccgcatgcccggtgtccggactgaagctggcccgcgcgttctggacgcagatgggcaagccgatgattgcggcgaagtatccgcagtatgccgggcgtatcgccgccggtctggtgggtcatggctcggaatgctacggattcgatgatgcgtattcgcaggaccacgatttcggcccgcgcttctgcctgtggcttacggatgaggattacgcggcgatcggcgagcaacttgaggtcgattacgaggcactgccgcgcaagttcagcgtggatgcgcaaggccgcgtgacgttcgaggcgcatgccaggtccgatgcttccggagcattcccctccgcaggtgcaggctccaccgtcatacccgatgcggcaaacgcacccacccccggcaccgctacgcacgataccgccactgccgagtcaggcgcggcgtcctctgatgtggcggaagcgatgacgactccgattgatgcaccgctctcccccgtcacgccgcgcgcacagggcgcgaatcgccgtgacggcgtgttccgcatcggtgacttctttgagtcgatcaccgggtatcacactgcgccggcgcagaccgcgccgcatgagtggctaatgcttcaggaatcgaccttggccgccgccaccaatggcgaggtgttcgccgatcccaccggtctgttttccaagacgcgccaagggttcaagaacatgcccgacgatgtgcggctcgcgctgatctccaagcgactcggcatgatcgcccaggccggtcaatataatctgccgcgttcgttgaagcgcggcgacggcgcggccgcatggctgtccatccacgagttcgtgcaggccaccgcctcgttggtgttcctggttaacgtgccgatggtggtgggctatatgccgtattacaagtggcagttcgcagcattgcgcaagctgtctggctcgatgttcgcgctgttgccgaacgtgggcgaacagttggaaaccgtgatgcgattgagttcggcagcctgctatggcggggccggatttggcgaaggcggcaagggcgcggctccagcaatcgagaaaatcaacgatattgtggagcagattgcggtggatatcgtcaaggaactcaaacgcgaacacctgaccacgtccggcgagaccttcctcgaatggcagcgcccgtatgtcgaggaccacatcgcctctgatgatccggtgcttaaaagtttgtagattcaagctccctctgccacggcttcgccgtgccacctccctcatcagagggaggtatcagtgaaaggaacgtcgatgaccaacgaactgactgatgatgaactgcgcgaggctattgtgcgtcatgaatgggatcagttccagcgcaccaacaatgagggtggacgcgcggcatgccaaggcaactggccggtgttccaccagatgcggttggcccagttcctcacatgggagcggccattactcaccagctatgccgctgatcttgacgcggccgaccacgtgggccgcaacctcgtaaccgaaaaatacggccgcatgatggcctccaccgcaccggaaaatttcacgaagaacatagagccgtatattccgcgtctctctgaagagcgcgcggcccgtcaggaacaggtcatcgcccagcaggtcgcctgggccaaggatttccgcgagcgctaccccaagctcggcgaggcgatgcgcgcactcaccaccaccgaagacacaccatctgccacctcattcgaaacctatctgcgcggcgagcttggtacgtattccgaccagaccttcgaacgttacgaagcgatgattggcgagcgcgccgcagccagcccgcaacgcaatatcactgaggaaaccttgttgcacacagtccagctcggcggtttcgacaccttagaggaggccgaagcctcccaagcgtaatactcagccattcactgtgtatcggacaccccgactgatgtacgtcggccggccatacccaggccaacgcaatctgccgatcgccccacacccagaccaccaacgcagcctgcccgccaggccccatttaccagcgcacatcggcagaattacagcgagaataggccccaaaatgccagtgtcatcagtgtggcgagagtgccgagcgctaccatcacgcatatgacgcgccgcacaccgacgatatcggcgcggcaataccagacacgttccatttcccaagcaaacagcaccaccaacagcatggtcgctattcgcagcaccacccatccgacggcaaacagccgcggttgaggcataaccaatacagccgatacgcctacggcgctcatatagccgtacaacagcccagtaatcaccatcaccgctgtgccgataccggcagataagccggcaatgccgtgcaacatgcgccgctgggcggcccccagctcactcggcgtcgcatgcacggcccgcacagtcgccacactacgtcgcccggccagcaacgtctgtagccaagaaaacacagtcaagccaatacctaatatcgccgccatcacgatcagcacgggccctgccaccatcagaccggccagcacgccaagcgagccgacgataccggatctggtacgttgcgacgcggcgaagcgctggtgaggtgttgcaccggcgacttgaggcgttgcccatccatcggctttggttccggcagtcacaccgttcacccaattttccagcgcttgcgtatagccttcggccaatggcaggttcggggtgaataagccctcaccagcccgcatctgatggttgccggcaaaatagcgtacggtgacgttctcgttgccggacttgttggccgtagcgatgatccgctgcgccccctgttcgatgggcatggccgtatcgtaggtgccgtagttcaccagcaccggcatggtgagggatttcagataccggtcggcatcaaagtcggcataggctagatcaaatggcgcgtagtccagcgacatcaatttggccatgtctttgaccacgggcttgggcgcgccggcctcatgcgtataggcgctgacagccatggccatttgctcacgtccattgaacaccggtgcggatgtaagtacggcaaaggcaatgtcttgccgtttcgaggttagaatcgtggcgatccaggtgccttcggattcggcgtagatgccggttttggcggggtccacgccgattctgccacgcaacacgtcgagcgaacgcccgtattcgcgagcaaaacgcgggtagtcgcgatgcagcacggtgtagttgtcgttgcgcttggccggcaccaaggtcacgataccggcagaggccatggcgttggcgatatcgccgaaatcctcggcaccactggtaccggacccgtgaatgaacagacaagccgggcgtggcccgggagcgccgaccggttcacgtagtacggcgggtagcgtgacgccgtcgccggtcttgatggatagtcgggtttcacgcgtacgatatcgcccctcgtggggaatgttcgcatgggcaggggtgatggtggtgtcggcagaagcgataacgatgtgcttggtgtagggccgtgtgttccattgcggcatcatcgcccagccaagtgtggcgaataccagcgtcatcgccatcgcggtgacgatgacgctcgctacccgccgcaccgaaatccgcttcatagttactatgcctccccccccatcagcatagaacggtcggctcttatcggtcggctcccgtcataatgtgcttctactgggaccgtaatgcaatggtttgtaacgctattttctcttcttgacggcaccgactatggcccatacaacggccactattaccagaatcagtcccactacggcgcaaataatagccgtcagcaattgcggattcggcgagaacaacgaaatcatccgatccggagatatgtacccgaaaaccagcgcgatcacgccgataatcacgcctaatagtccgaataccacagtaggcgcgctggtgctctgtttctggatgttcttggcactcttgacatccttagcattctggacgttcttggcgctctggacgttcttggcgctccccccaggctggcatggtttgccggcggtctgagactgcccatagggaggtcgtgctgaagatgctgcgtacatcggcacatcatcggcagatggaatcggcccaccatctccctccacggcatcggcaactgtttccagggcaatccgatctgtggttggttcgatgggcgatggagaggcagctgttgcctgcgtatccacatccgagaccgacgcatccgcatgattgtcggggacgggcagcacagccgtttcgtcatcatccgctgcggatggcagcaccgtggtatcggttcggtcatcgacggtcaccatggttgtggtcgcggtggtcgcgtcggtttcggaaggtatggccgtggtcggtgtcgcatcctcgatggaggcgaattccttggtttcatcagtcatgattccatctcctagttgcaacggcttgatcattccgattgttcggttgtgttcttgcttgtactgttgccgtcgtatatatcggcaagcggctggaacgtagagccttcccaatcggaggcgtacaccacgttgacacgtgcttccaccacatagggaatattgatttttaattctgggccgttgtccggcatggcggattccttatacaaccattcgtgatcaggcccattggtggcactttcagcttcgaagaaaacaaagcttggacccatgtagttgttgtataccatctcgtatttgccgccaacgtcactcgaagtggagtagtaggagtcggcggtgccgaaggcgtaagtgcaggaatccggcagaacgatatgcacttgcgcctgtgttgcggctatggtgatggtaccgaccgggcaattactgatggaagttttgccatccagcatcttcaccgtgtgcggtccatgtgtcttgtcccaatcggaccaatcaatgattgcctgatcggtgttgtagttttcaccgctgaacgccacaccttgctgcaatgtttcaaacgtggcatcgctggcatcggcaacgaagatgccatccttttgcacatcgttcatgccgtcgctgtttctcgcactgacagattggctcagtgaaacaacagtattgatgccgctggcaccaagatcacggtagtacacgccatacgtgcctgaaatgatggtcatgcagagcgcgcatccaccggcaaccagtccgagaggaatcagaccaccggtacgccgtcctctgaatccgagaatgatgaccaccagccccatcactatgcatactgcggcaatccagatggtgcccagacgcataatgccgataatgcccatgtcgtttacccaaatcagtcccatcagaccggcaaaggagaggaaggtaaggcccagtatgctcaagaccacgattgggcccgccggcttgcggcgcttggactcggtgggggcataggccgtcgcattcatacggtcgggggcaaacggcccgttgggtactgtgccgggcatcgcgccgggcacagtacccggcatcacgctgggcatcgactgatagacaggctgtgaaacaggctgtgaaacactaggcgcggtttgtgaaacaggttgtgaaacaggttgtggaaaaggttgcggagctgaatacaaaggagattgaggtactggttgcgcggctggatatgagacaggctgtggagctggatatgacacaggctgtgaaaccggtcgcggcgcagatgccccgaatccgtacccttcctgctggcgaatgccgcttttggccaacagccatagcgctaaggcggcgagcgcaatacaaccccaccccgcacctggaatcacgattgccacggcgaggaacaggaagcatcccagacaattccagtcccattggccggcaatgaggtcctcggccaagatgtgcccatcgcgtacatccggcatcagaaaccagccgagtgcgtacagagctgcgccaaaaccgaagaacaatgtacatacaatcaccaacgcacgtactaatgtggggctccagccaagccgtaaagcgatgccgctgcatacgccgccgatccaccggtcgtcgccgcgaaccagtccactggatcgcacccaagtgaagaagcgtcgcgatgtcttgtttttttgcggaccaggctgcggctgtggctgatatggattcgcgtttggattgctcatgattccattacaccgcccgaccactgccacaacgctcggggaacaccctgattgttccctgaacaccgggtaaaaccccggccgcaacgccctgagcgcggcacaataggagtatgacgtcatctcccgaaccattgctgcccgcgcgcatgccgttgatgcgcccccggcagggccgttggctcaccggcgtgtgcaagggcatcgccctgcacttgggcatcggcgtggcatgggttcggattgcgttcatcgcactgaccgtcctctacggcgcaggcatcatcgcttatgtattcctgtgggtgttcatgcctgccggagacccggtggcggctgcggctcgcacagtgcccgttaatcaggcgccgcttgcgcgaggcaatcagccacttgccgctcatgacgacgaatcggctgccgcaccggaatcattgtccgaggccatccaacgtgctccgaaaccggccgtcgtggcattggccggtttcgcgttgatggccactggactgttgctcaccagcaccggtgcggatgtccagattgtgtttccgctgctggtagggttgggcggcatcgcactggcatggatgaatcttagtccgcgaggcacgcagctgttgtctatgttgggcggcatcgcactgattttcatgggatgggcattgtatgtgcataatgtcagcattcctgggtggggcacctctcctcgacgcattgttgccagcggattcgtgatgatcgtcggtatcgtggtggcggtgatgccgtgggcgaacgcgatgctgcaacgactcacccacgagcaggcattgaaggagcgcgaagaggagcgcgcggacatgaccgcccatctgcatgatggcgtgctgcaaacgttggcgctgattcagctgaactccgaggaaccgaccaccgtattcgccctggcgcgtagccaagagcgcgagctgcgcgaatggctgtatcaggaacgttccacatcggatcgttcggtgggagccggattgaagcagatcgccgccgaggtggaggacgagcacggcaagccgattgaggtggtcaccgtgggcgacgcgcggccgagcgcccagaccgatgcgctgctggacgccacccgtcaggcgttggtcaatgcggtcacgcatggcggcgagccggtgtctttgtattgcgaggccagcgacacgatggttgaagtgttcgtgcgcgaccatggcgaaggcttcgatatggacgccattccgcccgaccggctgggcatccgcgaatcgattatcggccgcatcaaacggcgcggcggtacagtggagatagtgtccagggccggctggggcaccgaggtcagaatgcatatgccgatcgcgctgaaagcggcgcagggagaacatcgatgagcgagaacgagacagccaagattcgtgtggccatggtcgatgaccatgagatgttccgtgcgggcgtaatcgccacgttgcgcgattccttcgatatcgtcggccaagcggcggacgtgcccggttcggtggcgatgatcgcacagaccaagccgcaggtggtgttgctggatgtgcatgtgcccggcggcgagggtggcggcggtgccgagatcctcgccaaatcgcggccctactcccccactaccgtgtttctggcattgtcggtttcggatgcgccgcaggatgtggggtcggtgattcgcgccggcgcccagggctatgtaaccaagacgattaccggcgctgatttgatttcatccatcaagcaggtgcatgagggctatgccgtgttctcgccaaaactggccggttttgtactttcgaccttccagggtgtgccggcggcggggtctgatggcggcgctgatggtgcggcacgggctcatgatgaggagctggaccggctgtccgcccgcgagcaggaggtcatgcggctgatcgcgcgtggttacacgtataaagaggtggcggccgaactgttcatttcgatcaagacggtcgaaacgcacgtgagctcggtgttgcgaaagcttcagctttcgaatcgcaccgagctcacccgctgggccgccgataggcgcattgtgtgataaacgacagatgagctccctcatcagagggagctcatctgctcatatcactccgcgtcgcggaaaccgttggggttcttggtctgccagttgagggaggaggcggccatgtcgtcgatggtcagctcggccttccagccaagctccttctccgccttggaagcgtcggcgtagcaggcggcgatgtcaccggggcgacgcggcttgatcgcgtacggaatcggatgaccggcggccttctcgtaagccttgataacctcaagcacggagtagccgtggccagtacccaggttgtagacgaacacgccttccttgtcgatgtggtcaatgacggccacgtggcccttggccaggtcgaccacgtggatgtagtcacgcacaccagtgccgtcgggcgtgtcgtagtcgtcgccgtagacctggacttccttgagctcgccgaccgcgaccttggccacgtacggggtgaggttcgccggaatacccttcgggtcttcgcccagcaggccggactcgtgcgcgccgaccgggttgaagtagcgcagcagcacgatggtccaggacggatcggccacatgcacgtcgcgcagaatctgctcctggaacagcttggaggtgccgtacgggttggtggtgccgccggtcggcgtctcctcggtgatcggcagttccttcggcgtgccgtacacggtggcggaggatgagaagatgatcttcttgacgttgtgcttcttcatcaccttgagcagcacaagcgtggagtacaggttgttgtcgtagtattcgatcggcttggccacggactcgcccacggccttgagaccggcgaagtggatgacccagtcgatgttgttttcagcgaagacgcgttccatgagcgcctcatcgcgcacgtcgccgtcataacgcttgaccggcttgccggtgatttgctcgacgcgctcaagcgccacgggcgacgagttgccgtagttatctacggaaataacgtcgtagcccttgttgagcagttcgatgtcggtgtgggtggcgatgaatccagcaccgcccgtaaccagaacagtagtcatattccctcctttggaaggacttgccttcggtttttccttcagtattgagcttacttcacttgacctgtttcacctagcggcaaaaccaaggctttcgaggaatgtttgcgtggtggctttctgcttgaagacggccgtgttgccgaggatgcggtagcagacgctgccgagctcgtcgtgtacggcttggcggatggcctcgcggtcgtggtttccggccaacgtttcagcgagttcgccccattcgagactgaattcgctgacttcatcgggcaaatcgcggccttcggcgagcgcctcttcgacaatgccgagctggtcgacgagccgtccgggcagaatgaacaagccttgggcctcgatcagtccgatcggctcctgcttgaccggccagtattcggggtgtgcatggaaaataccttccgggtactcgtcgctgatcgcattgttgcggaagatgagactcatctcatagccgcgttcggtgatgatcgcgctgggcgagagggcggattggcggttgccatccgcgtcatggctggcgatgccgttcgccgcgtcgtcataaccgacccatgcctcgcggatgatgtcggatacgtcgatgatgctctggcgactcttcgacaccacgcgcacggcggtgccgggccagtcaaggatttcaaccacggcgtccggatagtcggcaagtgtgaaggcggcccaagtggcggccttgtgcatcggcagcagttcgccgccgccctggtaatggtcatgggcgagcaccgagccgccgatgcgaggcagcgcggcgttgcatccgaggaagtatccggggaaacggtccacgaagtcgagcagatggccgaaggtgtcgcggtccacatgcatcggcgtgtggtcggtgttcacgcagatgccgtgctggtcgaagtagccgtagggcgagaactgccagaaccatgactcgccgccgagcgtgaccggcaaggtgcgcagcgtgcgcttgtcacgtccggcgaagccctcgttctcatggcagatcgtgcacttcgggtagccgccggccacggcgttgccggccgccgccttcttcatgttcttgaattcgggtttggcgaggttgatggtcaccgtcagcccgtgcgagtcgaagcgcgggttccggtcgagctgggcacgcttgacataattgttggccacacagtagtcgtagaaccattgcatggcggccatgccgccatcccggtgctcgacgagcaggaatcggtcgtcgagatcagcggggttggcggagaggatgcccatgatggtgtcggcgtaggccgggccttcctccggcttgaaaaggccggcggttgtggcggcggcgcggaaggcggcgagcagggggtcgggggtcttttcgccatagggggcctggcttcggctgccaacaatgtcttggactacgtctgacactgacgccgccgacgttgtggttttgggtccggggtaggaatctaggcggaagagggcgaagatttggttgcgggtccagtctgcgttgcgtgggtcaaggtcaagatgggccaaggcataatcgatcagggcgtcgatgctggcgtatacctcggtcagctgatcgttcattgctctgcctccatcatgctggttcgggtatggttcggctgacggctcacctggcagcctccatgatgtcggctacgatggcgcgggtttcgctggccttctgctccatctcctgcacgagtttgatctgggtgcgggtgcgcaccagattatgctcggggtacttggtggcaaagtagatatcgccttccaagtagtcggcgagaaagcgcatgccgcattccatggtgagcaggttgccgctgaacggcagcagttcggcctcgcgcgcggtgatgctgccgcgtagttcgcccacgaagccttccgtgtaggcgcggaacagctcggtgctgaaatgcaccttgctgaggtccttttcgtcttccagagcagtggacgcaccaaagcgtatggaatcgccgaagtcgaacagcatggagccgggcatgatggtgtcgagatcgatgatcgcacgcgccttgccggtggtggcgtccatgaggatgttgttgagcttggtgtcattgtgggtcacgcgcagcggaatcgaaccgtccctgagcccatccatcacgacggcatactggtcggcgtgactcagatagaagtcgatttccggctggcatgcggcggcgcggccgagcttgtccgcggcgagggcggccttgaagtcctcgaaacgatgcggggtgtcgtggaagtgggcgatggtttcggtcagctggctggcgtcgaattcggacaggaagttctggaagtcgccgaatgcgctgccggcttcgcggaacacgtccgggttcggcacgaggttgtaggacacggtgtgttcgatgaacttgtagacgcgccatgcgccgccatcgatctcggcccaggtggcgcctgaggtggtgggcacaatgtccagcgtctctttgccctgagccttgagagtggaggtgaccagttcgacattgcgcatcagattcaccgtatcggggaagatgctggtgttcatctgctggaggatgtagcgggggccgtccgtggtcaccagataggtggtgttgatgtggccgtctccgtaaggttcgataccggtcacggcaccttccagcgcaaaatgcgaggcgatgccgaataaaacttcattgctttcagtcatgatgggtccgttctccaaaacgtgggatcaggcttcacgccaggcgataccgctgtcaggcaggtcgaagtcctcggtggtgccgtcggccaaagtcaccgtggtcttctgcggctgatcggtgttgttgattacgcaatacagcccttgctcggggaagtgtgccacttcgcattccggattggacgagctccaggccgcatacttgtcttcgttgtgggaagcgtagaacagcacgcgttccagcagtcgggcgttggccgccgaatagggcaggccggagatgtacacgccgcggcccttgccataatcgttggtcgcgagctgtacctggccgccgtccgcgcgcagcagggtcacgttttcattgaccggatacgtgttgagcacgggttcgccgaaatcgatgccgcccaacggcttgatggactggccgccgccgcagccgctcagcgggatgcggtagccggcctgctcccaagcctcgcgggccgccgggtcgaccggcacatcggcggtgatgaagtggtccggcaccaccggcgggaaatacttgtccaccgaaagggtctgatagcgctcctcgtccacgccaatcacgtcggccagctggaagaaccggcccgtttggaagcgcggtgccgagctcggctcgcccacgcccacgaacgcgccgccgccacgcacccaggcgcgcacggtttccacgagcttcgggttggtccacacatcgccgccggtgaatgcggtgtcgaccgggccgccgttgatgattacgtcgatatcgctatcgatgccatgcgcgagtacgtcgtcgaagctgatgaaccgcacgttcacgcgcatgccggacagggattccagaatgccgtagtaggagtaggtctgcttgttgggcagggcgtgtgccacggtgaacgccatccaggagcgcatcttgccccaggaattcagaatcgccacgttgagctcaccttcggcggccaccccaccggtgcggtcgtggatgtcgcggaattcgttggcgatatgggtcaccgtgtccacgaacttcgggaacttggcggccagggagaggtagccgccgtagcccatgcggctgatcggcgagcgcaggatcgcgcggcgggccttgcgccagttgtcgaggccttcgatgctcggatcgttgccctcgtagaacgtgtcggggaagaagtacggcaggaagcggccttcggtgtacttgacgcccggaatatcggcgatcatgcgggtggtggtgccgtcgccgatggaaccgaccacggcgtccaggccgagttcgtcgaatccgtccttgtacggttcggtgccgatccactggtcgccgaggaacatcatcgcctctttgccggcggcgtgggacatgtcggcgagctgcttgacgttttcgcgcacgaagccggagaggaagtcgatccagtcgcgctgggcttttctgggcacgcgccatgcggagttgtaggcaccgccgtccacgaagtcctccgggcgcaggcggtagccatacttggcttcgaaatcatccagcgcacgcgggcttacggtgcaggcgcaaccaaaccagtcgacgaccttttcgcggcgcttttcatcgaacaggagcgtgaactggtagaagaacgtggtgaatcgcaccacatcggtctgcgggctgtccttaagccactgctcgaacgtgtcgaacacgaacttgcgggtggccggatggtagatgtcgaacgggatctcgtgttccttgtcgccccagtcgttggtcagatggttgtacatctcgaccgggtcccagatgatgtaggccaggaaactcaccgtgtactcatgccatgcggcaacgccgctcacatgcacggtgtcctcgtccgcgtcaagcgtccagttcgccgaatcaacgacctcgccggtggtgcggtctacaacctcccaatacttgtgagggtcggcatcacgattcggcttcagctgctcagcgaagaagctttccatcagcggaatatcaaccgtatccgattcggcgagaatgcgatcggtcagcagatacacctgtggcgtctcatccatatgcagcgtaatccactcgttatgcgcgcgagtcgggaaatacgcattgtaaatcttcttgcccaaggcaagcacagcctcatccagatgcgtgccatcggagttacgaatggcgtctgctccccacagttcggcaagctccttggtcttctccgcaaaattctcctcgctaggcaaggtgaagcggccggtgctagtcatagtctctcctttgaggacattgattatttttttggataattaaattgtaaacaatatatgcatataaaacaagaatccgacacaaccgtcgggcgtccaggatcctgactgtataaatccttgagagtagccccacggcaacgccggaagagcgaattgaacatcaccggagcttcccggtcagtttcaccgacaatctcatgacaagaatcaggaaggctctggatcggtatggttgcgtgctacttattgttgagaagccgtccggcgccggaaggagtagcacgaggcaccggacggcgggaattattggtcttaggctgtccgcttaacgcgtcgccttcggcccctgcaattaaggactcgcctacggcgagactcaatgctgccttcgctcggctaccgcctcgctcgggccgacgctacagacagcccaccgggctgtccgcttaacgcgtcagcccttgaccgcaccagcggcgaggccggcctgccagtagcgctggagaccgaggaagagcacgatcacaggcagcacaccgagcagagcacccatcatcagagcgccacgatcagtgaaggtagccagagagaccatgccgtacagacccaaggtcaccggcttcaaggtgtcggaagagaccatcatcaacggcagcaggaagttgttccaagtggccacgaacaggaacaggaagatcgtgaccattgccggagccagaatcctcaacacaatggtgaagaagatgcgagcttcgcttgcaccatcgatacgcgccgcctcaagcagctcgttcggcactgaggtctgcgcgtatacgcggcccaggaagaagccgaacggagagacgcagcacgggatgatgatggagagcatcgtgttggtcaggtgcatggcatggaagatggagtactgcggaatggtcagcagagcggccggcatcagcatgcagcccataatcacgccaatggcaaggttcttacccttgaagttgaactttgcggtagcgtatcccgccatcacagccacgagcgtacccaccagagcggaaacacccgagtagatcagggagttcagcacccagcgccagaactggccacgggtccaaccaatcagcgtgccatagttcttggcgatggcggcaggcaaatcgctcagacccacggcgaaccacagaccgttgctgccggtcatctggctcggcgtcttggtcgaggcgatgatggcccagtaaatcgggaacagaaagtagatcagcgcgaagaccagaacaacgatggtgatggtcttgaccagcgcggaaggctgcatggaacgaggcaggtcgttggcatgcttgtcgcgaatcctgtcagccttcttacgagcgcgtgcgaccgcgcgggattccttatcagtagcttctacggtgctcattctgcgttcaccttcctttcaacgagcgtgtagaccacggcgagtacgccagcgatcagtgccataacgatggccacagcggatgcaggtccgtcaccacccggggtcagcgtgccctgcgaggtattgagggccatcatcattggcgtgtacgacttggaaatgctcggatcggaaatcgacatcacctgcggctcgttgaacagctggatggtgccgacgatggagagcagcatggcaagcagggcggctgcacgcacgttcggcagcttgatcttcatggcgatctggaagccactggcgccatcgatgcgtgcggcctcgtacagatcgtgcggaatggcctgcagtgcggcgaggaagatcagcatgttgtagccggtgaaggtccaggtcgtgatgttggccatagagccgaggaccacattgtcgccgaagaagttcaccttgatgccgatggcggcaagtcccttaacgataggggaaatctggccgttgtagaggtacacccagatgatggatgcgaccacgcccggaatggcgtacggcaggaagtagctcagacggaatgcggtgatgtgcttgacgatataggaatcgatgagcattgccagagcaagtgccgcgatgatcatgaccggcacctgaatcacggtgtagagcactaccctgcccacgccagcccagaagttgccggaagtaataacgtattggaagttctgaagtccgacgaacttatcgaccagttccccgccgccgtatgcgccaccgcccgtggtgacctggcggaagaagctggaataaatagcccaaatgatgggaagaataaataccagagcgaacaggatgccaaacggtgccatgaaggcccagccggtacgattctcacgcttcacagcatcagaagcctttggcttatcggcacgcctggcgacccccgtcttcgccgtttttgttgttgcagtcatagggaaacctgtctttcaaaagaacagtgagaaatagaaagtacgtaatgcagttcgaatcgatgcagtcagatcaaacacaattaatgacgaaccgaactcgagtaaaaggaaaggccggagtgttgagctccggcctttcgatgtgtggttgaggatatcagcggctggaaggaaccctaaccgttaatgtcactcggaaacagacaagccgaagttcttcagcgtatccacagaggtggtctgtgcgtcggagaagatgtctgcaaccttgccggagccatcggtggccttggcggcggtttcgttcatcttggcggcgactgcggagaagccaggcatgtaggtgaagtcacccatgttgttgttagcggtcttgaattccttcatgatgtcctgaccaccgaagaaggtggaccactcggaaggagtctcagcgtcttcagtggtagcagccggcacgaggccctgggaaaccagatcaggaacctgggtgttgaaccaatccaggaactccattgcttccttcgggtgcttggagttcttcagcacggccacggcggaaccaccgtcagggccggtcttgccagcgttgccgaaccagtcaccgagctgagcgacctgccattcgccggagccggtgccaccggaggaggtcatgaacagcggggcttcccaagcggcggccacagtaccgatcaacgagccatccttgatggatgcatcgaaggacggatcccaacgcgggttggtggtggctgccttggcgtcgagcagctgctggtagaagtcagcggttgccttggagccatcggtctcggtgttgacgacccaggagttgcccttcaccttgtaccaaccaccggaggcgccagccagaccggagatcatgttgccggcctcatcaggctggtaggacatgatgtacttgccagcggcggcagcggtcttggcagcggcgataaactcatcggcggtctgcggaatctcggtgatgccgagcttctcgaactcagccttgttgtagaagtaaaccagcgggccggtgtcctgcggcaggccgtaagccttgccgccaacctgaaccaggctgtacgggccggatgcgaagtcgttcttgtactgctcggcatactgggtcacatcctgcagcagacccttggtgaagacctcaggcagctcggcgtaaccgacctgagccagatccggagcctcgccggacttgacgtcggtctcaagcttcttgatcatgtcagaggccttaccatcgaacttggtggccttgacctgaatatccggatgctgcttattccacttggcaacgatgtcgttgaccagagtcatgccctcggaatccggcagacggtgcatgtaggtgatgttgaccacgccaccatcatcggtggtcttcgtgtcgccggcagtgtcgctgccgcaaccggccaagcccattcccattgctgctaccgcggcaaaagcagccacgatgcgcttattgcgagataccatatctctactccttcgtagtgaaatcatcatctcagtgtgatgactgattactaatgtatgccctcattcttttattgtcaacttagctaacaattaccgcgcgtcccgttgaggcgagtagcattaaaccggttcgatgctcgattgtgcgagtttgttcatttcattaactccccttacaaagcaacgtacttttggtccaccggtaggcctaatgagatattggatagcggcaacaatccaagacgttagcttgcaatcgtccaccgcaaattgcaagcacttgccaacattatcggttttcaggtcgccggcgcgatacccgaccagggggcaccgcaccttaatgagacgctacacgagcagtctcagcaactggtagagctgccacaggctacgcacgttgaagtgcgtgccgtcaaccgtggcgttcgcctcgccatcgcccatatggacgatcacggtgcgcccgttcacggtcagactaccgtgcatcgtgatatgattcatcttgcaaccttgttgattaaaggcgcaagccggtaatcaacgcaaaggcccgatgctgcaaacgtcgggccttttcttatcggctcacgccgatcggcccgtcatatcaacggggacaccgcatgttacggcatcacaaaccaatatatcagcaccccggcggcaatcaagaagacaggttccagaaaaagaaaaaaagggcctgggcatgttgcccaggcctcggttcgcggacagggcgagattcgaactcgcggagggttgcccctcaacggttttcaagaccgtctctttaggccgctcagacacctgtcctgatgcgcgttcacacgcgcaagtattcattatacagaagggagggatgttgatattcggcagtgcggtcggtcttggattcgcctgctggctatcagcgatctctccctcagtaatctctccctcagtcagctacgctgacagctccctcatcagagggagctaaagcacgatgagactcaggcctcccacttcgtgggctcgataacttccttgccgcccatgtaggcgcgcatggccttcgggatctcgatggagccgtccttctgctggtggttctccatgatggcgaccagccaacgggtggtggccaacgtgccgttcagggtggagaccgggcgggtgccgccgtcttccatacgctcgcggatgttcaggcggcgagcctggtactcggtgcagttcgaggtggaggtgagctcgcggtaacggccctgggtcggcacccaagcctcgcagtcgaacttacgggcggcggaggaaccgaggtcgccggcggcggtatcgatgatgcggtagggcacctcgaccttggcgagcatctcctgttccatggccagcaggtgctcgtgctccttgtaggagtcctcctgcttggcgtaaacgaacatctccaccttgtcgaactggtggacgcggatgatgccggaagtatccttgcctgcggcaccggcctcgcggcggtagcaggaggaccaaccgcagtagcgcagcgggccgttgccgaggtcgaggatctcgttctcgtgcatgccggcgagcgccacttcggaagtgccgaccaggtactggtcatcgggctcgcgcagacggtagatctcgtcggcgtgggagttcaggaagccggtgccgcgcatgacctcggggcgcaccagcgtcggggtgatggccagcgtgaagccgtgctcctcggcctggtccacggccatggtgagcatggcgatctgcatacgggccacctggccacgcaggaagtagaagcgggagccgccgaccttgacgccgcggcgcatgtcgatgccggccacgccggtgccgagggtcaggtggtccttgggctcgaagccttcggccgcgaagtcgcgaatctggccaaccttcttgacgaccacgtagtcgtcctcgccgccttcgggagcttcgggctccacgatgttggagagcttccacatggcggtggtgtattcctcggcggcggaatcggccttggacttgtattcggagaccttctgggacagttccttggtctcggcgatgagcttggccttctcgtccgccggggcggaggcgaccttcttgccgatttccttctgctgggcgcgagcctcttcgaaggccttcagcgcctcacgacgtgcggtgtcggaggagagcacttcgtcgacgagttccacggactcgccgcgcttgcgctgggattccttgacgatatcggtgtgttcacggatgaattgaatatcaagcatgggcaccagactagccgcgtaagcagacaccgacaatggccgaatgcacgggagtcacgcggaaatcacagggaagcccgggaaagtccgcggacgggtccacccggccaatttcgtcagatgagacgcgattgaaccataatcgcgccccacggggctgttgcgtgcaggaaatgttcacgtacggcgcaccatggccgcaaacgacctccccaccgataacaataggagccatgcctcagcctgccctcaccgtgtttctgatcatcgccgcaatcgccattgtggtggtgctcatcgccgtcatcgtcatcgccctgcgcgcgcagcgccgccgcaagctggctcagacgctggagaagcgccgggacgacgaggtgcagtacgccttcatcgtgaatccgtccaaaccgcaggccgaagcccgccggctgcatatccagaggttctgcgaggccaaggggctcaatcgcatccgcttctacgacacccagcttgacaaggacggcagggtctgcgcgcttgaggcgctggaggacggcgccgacgtggtgatcgcggtcggcggcgacggcacggtgcgcacggtggcgagcgccgtctccggcaccggccatgcgctgggcatcatccccatcggcaccggcaacctgtttgcccgcaatatgggcgttcccgtggacgatatcgacgccgcgctgaccgtggccacctcccacggctcccgcctggtggacatgggccgtctcaccctgctcgaccacccggaggacgaccacggccacgccttcctcatcatcgccggcatcggcttcgatgcggccatgatcgacgacaccaaccccgagctcaaggcgaacatcagctggctcgcctacttcgtgggcggcgtgaagaacctgttcgcgccgaagttccgcggcacgctgacagtcaccagcgccgacggctcgacccacaccatcaagaatctcgatttccgcacggtgatggccggcaactgcggccagattcccatgttctcgctgatgccggcggcatcctatgacgatggtctgctggacttcgaaatcatcgacaccaccggcggcatcctcggctgggccaacctgttcggcgacgtggtgcaccagacgatcatcggcaagcccgaacagaacccgctgtccacgaactcgaccatcgaacaggttcagggcgtcagtgccgaaatcacattggaaaagccggccaaagcgcaggtggacggcgacatgctaccggagaccaaacatattcgtttctcagtggatcatcgcgcgctgatcgtgcgcgtacccgacgcctccgcgctggaaaagaccgcacaggccgctgcctcaaacgccacctcggatttcgccgaaatgaccggcacgctcgagccgattcgctgatccgctacgatgcgtggccggtgactcgggcgacgtgcattgccagataggcggtttcgtcgtcgctgatatccgtgtcgaggcgcagttcgagcagggaggcgatggttcgcgcgcatcgtagcgcggcgggataggactcacgaatcaccttcatcaccggtgccggctcatccgtcagttgctggtgctggtggatgcgtacgaacaggtaacgcagatgggtgatgaacctgcccacattcacggaactgcggtccaacgtgatgccgtagctgtggtcgataatgtcaagcagttgctggatcacgcccgtcatcgtatacgtataggacaggtcgccggtggcgaagccggcgttgaccagatgcatggcaagcgcggtggcctcgccgtccggcagcgtgacgtcgagccgcgcattgagcgatgcgagcatcgcacgcccctgcgcgtattcctgcgggtacaggttgctcacctcgccgagcagcgggtaggtaatgtcgatgccgcgccgcacccgctccaccgcattcgccacgtgatccgacaaggccatgaccagcgtggtgctgccggtctcacgctcccccagtccggcttcctgcatggattcgacgaccacgcggatgatttcgggcggaatgtccgccagcatctgcgccagatggtccgggtcccgcccgtccgacggcacgaaggtgcgcacgactttcgactcgtcgaccgtctgccccggcttggcttggaaccccagtccacggccggtgagaatcacctcaccgccgtcgccgcctttggcgagcacgacgttgttgttgaacactcgcagtatttccatggcatcctttcgcaacgtcattgttccacatcgatgatcgggctgccggctgatacggttttgcagtcaccgccgttgttgtcgccgctaccgtcgccgatcaacggcgtgaccacggtcagttcagcggcgttgaccaccgtcaccaccaccacaacgctgtgcccggccgccgcgactttgccgaaatccacggtggccagtggctctcccgccgcgatccgctcgcctttagccacgaccacagcgaatccctcgccatccatatcgacggtgtcaatgccgatatgaaccagcacctcgatgccgccatcggttttaatgccgaaggcatggccggttcgggccacggttttcagcatgccactgaccggtgcgagcacggctgtctcaccggtcgtctccggcacgacgcctacgccctcccccagcgcgcgggaggcgaacaccggatcgccagtcgcttccagattcaccagccggccggcgaccggcgacaagatggcgttggagtcaagagcccgatcggaggcgggccgcgatggagaatcttccgcagactccgcatccgacgatgtcgtgccaatccctctcaccgcatcctgcgagcgtgcgttctcgcccgccgagaccatctgtgcctccgtggcgcgcgacggcgtgcggtacccgaacaacaccgtcaacaccatcgccattacaaacgcaacggcgatggacagcgcgtacacccacatccgatcgaacaccggaatcgtcagcaacgaggagaaggcgaatgccgtagtcgtaacgccccggaccatctggccggatggcagcacggacgggaacagccagccgaacaccgcgctggtcactccgccggccgcgcagccggcgagcagccagcggtagacgcggcggtgatgcagatggatgccgtacaggctcagttccgaaacgccacccagcaatcccgcgagcaacgcccccaccgcggtctgccgcatggccgaatccttgccgcgtacggccagcacgagtacgccggcggtggcaccgaagcaggcgaagttccatacacccatcggaccttggacgaagtcgtagccgagcgtctgaatgttcatcagtatcagggcgttcaacggccagtgcagaccgagcggcacgagaaacgggtagagcatcgggatgatgagcgcgaacaggaatggcacgtgcgcgttaagccatgctgtggccgctcccagcccgctgccgagccatattcccagaggcccgataaccagtatggtgagcgcaaaaacgacgaccagtgagaggaatggcacgaacaccagctgtacgctgtcgggaatgacgcgcttcagcccgcggtagaccacggcgagcacggcggccatgagcaatggtacgaagatgttgccactgtagtcgttgagttgaatcggtatgccgaacgccgacacggtgcaggtttcggtgccgaatgtggcggtggccgagcattgaatctccccggagagagcgctggatacggacgtcccggacattccggacatcacgccagtaagctgcggggtcataagcgcggccataatcgcaccgccgagccaagggtcgacgtccagtttcttggccgcattgtaagcgatcataatcggcagaacggtgaacacaccctcccaaatcgccttgagtagtatccaaccggtggacgtctcgccatcaggcacaatgccgagtgcaacgatcacgttgacgatggcgatgaccagcgaggcaccgagtagcacgcccagaatcgggcggaacgagtcggacaggtagtcgaaaaacgcggcagcccgggcacgggcggcactgccccactcgcggacggtacgaggcgtgaagtgacgggatgtattggatgggccgcaactttgttcggcgtcggtggcagtatcgcgcgatggtgcggcatcgtcggaaaggtacggcgcggactgcgcgggttgcgtgggctgtgtggattgcgctgactgcgcgggctgcgctggctgagtgggctgcattgactgagtgggttgcgttgactgcgacgctgactgcatcactgccgatggcaattgcgctgccggcatcaatcgcgccgtccgcagccgaacgatctgctcgtacaccgaggcgaccgctccgccgatgatgacctgataacgattgccggctcgcgggaatgcaccgaggactccggggatggattcaagaccgtgctggttgacatggccggcatcggccagttcgaagtgcagtcgcgtggcgcaatgggtcaggctggtaatgttcgcggggccgccgacggcatcgacgatgcgcgccgcaatcactgcaggcgttgcgttcgatgcgttcgccacggttcctccttgctgccgtatgccactgtgttccattatcggcgctgggtgccccaaaagcacggcaatgccggcaaagcatcgcgaaacggcaactatgcgctacggtgctccgcgatggtgtcccgccataatgttccgcgatgatgcttcgccacacccgttctccgtatttgccgcagcgcccattccgacatcattccaccatgcagaatcctgcaatcgttgtcaaaaatcatcgttttttgctgcctattcggagtgtcgcgactgcggaagtcgtattctatctttcacacacgttgcgtagcagggttgttactcaaaacgaggcaagacctggagcgacgtggaatttgcgtatcgtaatatgcgaattccacgttgttccaggtctttttttgttttcgggcgacttcagacaatcgaagcctgaccttgcacgcggcagaggggccacgcaacaggcgcggtccgtcaacggcgaaaggacaaggcaatgacgacgacaacggcatcacccgtatcgaaacagacggcatccgcggcgcaggaaaccagcgcaaccggggcggcggccaccgcaatcgaaaccatcgaaaccggcgtggccggagtggcgggcgcggccacaaacgcggcagcaaacgcaatcgaggacctcgaagccgccgaatcacgcgacttctccacgcgcttcccgctcaacagcgcattcatcttcaccttcggcgcgctcggcggcatgctgttcggtttcgacaccggcattatctccggtgcctccccgcttatcgaatcagacttcggcctgagcgtctcccagaccggcttcatcacctcctcggtgctgatcggctcgtgcgcaggtgcgttgtcgatcggcgcgctgtctgaccggttcggccgcaagaagctgctcatcgtctccgcgctgctgttcctgctcggctcaggcctgtgcgcctcctccaccggattcgcgatgatggtgtgcgcccgcatcatcctgggcctcgcggtcggcgcggcttctgccctgaccccggcgtacttggccgaactggcgccgaaggagcgtcgcggctcgctgtccacgctcttccagctcatggtcaccttcggcattctgctggcctacgcctccaacctcggattcctgaaccacaacctcttcggcatccgcgactggcgctggatgctcggttcggcgctggtgccggccgccttgttgctgctcggcggcctgctgctgcccgaatccccgcgttatctggtgaacaagggcgacacctgcaacgccttcaaagtgcttacgctgattcgcaaggacgtggatcagacccaggtgcagattgagctggacgaaatcaaggccgtggccgcacaggacaccaagggtggcgtgcgcgaactgttccgtatcgctcgtccggcgctggtggccgccattggcatcatgctgttccagcagctcgtgggcatcaactcggtgatctacttcctgccgcaggtgttcatcaagggcttcggcttccctgaaggcgacgcgatctgggtgtcggtgggcatcggcgtggtgaacttcgtgagcaccatcgtggccacgcttatcatggatcgtttcccgcgcaagggcgtgctgatcttcggttccatcgtgatgaccgtttcgctcgcagtgctcgccgtgatgaacttcgtgggcgacgtggccgtgctggccgtgccgacgatgattctcatcgctttctatatcctcggctttgcggtctcgtggggcccgatcgcctgggtgcttatcggcgagatcttcccgctgagcgtgcgcggcatcggctcctccttcggctcggcggcgaactggctgggcaacttcatcgtctcccagttcttcctcgtgctgctcgatgcgttcggcaacaatgtgggcggcccgttcgcgattttcggcgtgttttcggccctgtccatcccgttcgtgatgcgcttggtgcccgagaccaacggcaagtcgctggaggaaatcgaggaggaaatgaccaagcgctagacaaccggcacacgattcgcacaaaagttgacaactcttaacataatcgtacccaacgtggcgaaaaaacgtggcagaatagggagcatggtagcaaacaatgcgggtcagcccgccaccccagcagatctgatcaatgtcgatgaggttatcggcaaatactatgacctcgtccccgatcccgaagtccccgagcagcgtgtcatcttcggcacctccggccaccgcggatcgtccctgaagacctcgttcaacgaggcccacatcatcgccatctcccaggccatcgccgaataccgcaagaaggccggcgtcaccggcccgctgtacctcggctccgacacccacgcgctgtccggcccggccaagaagaccgccatcgaggtgctcgtcgccaacggcgtgcacgtacgcgtcgattcccgtgacgacttcgtgcccaccccggtggtctcccaggccatcctgacccacaaccgtgcggccgacggcacccagcgcttcgagggcgagggcctcgccgacggcatcgtcgtcacgccgtcccacaacccgcccaccgacggtggcttcaagtacgaccccgtcaccggcggcccggctccggccgagaccaccaatgccatcgccgctcgcgccaacgagctgctcggcgacttcaagtccatcaagcgtgtgccctacgaggaggccatcaagtccgagtacgtcgagggcttcgacttccgcgagcactacgtggacgacctggagaacgtcatcgacttcgacgtgatccgcaactccggcgtgcgtctgggcatcgatccgctcggcggcgcttccgtgaactactggccgctcatcaacgagaagtacggcctgaacatcggcgtggtgcgtcctgaggtcgacccgacctggcgcttcatgaccatcgaccacgacggcaagatccgcatggacccgtcttccccgtacgccatgaagggcctggtcgacgagctcaacgccggcgcttgggacaagtacgatctggtcggcggcaccgacccggacgccgaccgtcacggcatcgtctgcccgaactggggcgtgatgaacccgaaccactacatcgccgtgtgcgtggagtacctgttcggcggcaaccgtccgggctggcctgagggcgcagccgtgggcaagacgctggtctcctcttccctgatcgaccgcgtggccgcatcgatcaacgcgaaggtcatcgaagtgccggtgggcttcaagtggttcgtggacccgctgttcagcggcgaagtcgccttcggcggcgaggagagctccggcatgagcttcctgcgcaaggacggccgcgtgtggaccaccgataaggatggtctgatccccgacctgctggccgccgagatcaccgccaagaccggcaagaacccggcccagcttcaccaggagcaggtcgagcgcttcggcgagtcttggtacaagcgcgtcgacaccccgaccacgctggagcagaaggccaagttcgccaagctgaccggtgatgatgtggccgccacgcagctggctggcgaagacatcaccgccaagctgaccgaggcaccgggcaaccacgccaagatcggcggtctgaaggtcaccaccaaggacaactggttcgccgcccgcccctccggcaccgagaacatctacaaggtgtacgccgagtccttcgtctcccccgaggctctggacaaggtgctcgacgaggccaccgtcgtggtagacaaggccctgagcgagtgaaatcgctgcgttagccgcgttcacagcaaccaataaggctctgcattggattcatgcaatccactgcagagctttttttagcgcatatgcagttcgcgaccactgaaacacgcaggtcaacggttctcctcatgcaccgtgaccgcattttctcaacatcactgcagggcaggacggccatatggccgcgaaacgttcgcctgcctacattatgaccgagtttcccatcatcattgtggggtcacagcggccagatgaccaccgaagcgttcggtcggcttgcatcatggtcgagttttaacatcgttgtgggacgccacgacgaatttgcccattccagagttgccatcccacaaaagcgtgggacaacagctaagtcaatcgttttacattttccccatcccacacactcaaactggaaaccccggaaagacgccattcctgccacacccgtcacagccattacccgaggggccgtgggacgccacgcaaaaatcggcaaaacacgcgtagcgtcccacacccattggcgcaaatccacgctcaatgcaccgacaacacccccaatcgaccactatgacacatttccctccacaatcgaacactagtcattcacgaaatccatcactacgaggcatcgcaatcgaacggcatgcaatatcaagcacacaccacaacaacaggtcgtacaaatattgcctttacatcagtccgtttcgaacatcatggtcacagcaggctctgcgccaactcttcaagagacatggcaactacatgaaactcgaatacggcaccgcgcgaagcaagcgccctcgccacgttgaaagcgaattcagcacgagtatcctcgttagcgatacttgccgccgtggcgatgaagaccagccatctccgcccgaccagcatgccccttttctcttggtcacggcgccattgagtcttactcgtacgatgatgatcgccatcatattcaacagcgaccttgaactctggccacgctaagtccaacgttatgggagctccagatgcaaaagccgcgtccggcaccacatagttcgcaaccggctgtggaatcccatgcgccaccagagagagtcgttcttctgattctttgggcgaatcagcaccaggtgatatcagaggcaatgctcgaacgcaggacgggcgccctctgaatcgggtaaattgctccacgaacttcaccagatcctgatagattgcagcagcatcacgatccttagccaatactggctgtttgctcgtagcagtaatgacggcatccccgagcacaatcagagactcaaaagaaacatacggggcaagttgagcccatacgtgaaacaggtccagcgcaaacacgtgttggttcatttccacattggcggctttagccgcatgtttccaaatatgcgtttgcagtggtgcatggcgtgtacgaaaccgcttgctcttaacgctggatacagtgtgcagcttggccgagtcgaggtcgcaatcggcgggaatcggtacggattgcagagcgagggaagtggtcatgccgaaaagcagcttcttgcccgcccgtttcgcttcctcagtgcagcgtgcgaccatgtcgcgtttgcgctgggcgaggctttcgctcatggtcggtgtcgctgcagaatcatgtgcaccactgttcggcgatgacgagtcgcgagaagtcgggtatttcgagtcagtagaaaatgaccccgcaaattcgggcggaacaaaaactgcctccgattcttccggaggctgatcgtatatagagcctggcagagctccatagttggtgatgccgtcggtcatcctgttcatgacaccaccatatgggtagtgggtgcggaaacggaagccgatccgaggtatgtggtcctagcttcacttacgcacattcattgtggataaccatgtggacacctcacttatacacatagtcacccacctcttcaaccccgatttgacacactaactgtatctgatatgattacagtatcataactgtacacatcatagttacagtatcgactcggtaaggaggtcgtttcatgaacggcgaccattcactggcagtgcacgcattggtctaccttgaccatcgcgccacacacctgcccagtcagatcctggccgagaacatatgtaccaatgcggcgcgcgtgcgcaaagtaatgcgaccgctcgcctcagccggactcatcgccactaaagagggtgctgaaggcgggtacgctctggcccggcccgccgccgaaatcactttgcgcgcggtagcggaagccaccggcaccacttttgtgaaagtgaactggacaccgggcgacgtacacgaggactgtctggtgtcatcttcaatgggcgcagtgatgaacgacatctatgccgggctcaaccgcacttgcctcgaacaactcgaacacaccaccatccacgacatcaccgaacagatattcagcgagcgcaaaggctaataatcccgcgcgtttcccctagccagcatcagtcgataacgcttcggcagtcaaagaagaaaacagacgccgcacggcacacaacacatcagcacaacgcactcttatcactcgaatacgtaaggaagtaaccatgtccatcagcacacccaatgccatcagcacacccaacacctcccccactatcaccaccgacgccctgatcattggattcggcaagggcggcaaaaccttggctgccaagctcagtgcagccggccgcaaggtcgtcgtcgccgaggcaagcgccgacatgtacggcggcacctgcatcaatatcggatgcttgccgtccaagtcactgattttgtccgccgaacaggcgcggcgggatggcgcgaacagtactcccgaaacccgcgaagcagcgttcgaggctgctatcaaggagaagcgccgcgtcacttcgatgctgcgcgacaagaactatcacaagctcgccgaccaagacaacatcaccgtaatcaccggccgcgctcacttcaccggccctcatagcgtggaaatcgccaccgctgagggcccggtcgccgtgaccgccagcaagatcttcatcaataccggtgccacgccgcgcattccggatattcccggtatccacactacgcccggcgtctacaccagcactggactgatggatctcgacgatatgccgcagcgactggtgattatcggttcaggattcattggacttgagtttgcctcgatgtttgccgatttcggcacggcggttaccgtgctgcagcacaatgccgagttcctgccgcgcgaggatgcggatgtggcggccgcgattcgcgcacagttggaagcgcagggcgtcaagttcctgttcaacgcggataccaaggccatcgcgcctgctgctgacggcggcgtcaggttgtccgttgcggtgaagggtatgactcgcggcgcatcgcaagcttgcgattccacccccgccggcaccgggaacgctcataccgatatcaccggcgccaccgacactacaacaaccaccagccccactagcaacccgaccgatcacgccacgatgtcacacgttcaaacgaaaccatcagacgatggcgagccgcggttcgccgagccggctgaagcccgattctgcctgaccaccgacgcggtactggtggccaccggacgtacgccgaacgtcgagggactgcatcttgaggcagctggcgtggagctcaccgaacgcggtgccgtgaaagtcgacgagcttctgcgcaccacagcagccgacatttgggctctgggcgatgtgaacggcggcccgcagcacacgtacatttcgctggatgactatcgcgtggtgtggtcgcagctcaatggttccgaccgtccgcacacggtgaaggaccgcaagcatgtgccgtcgagcacattcctcgccacgccttactcgcgcgtgggattgaatgagcgcgaggcgaaggcggctggattggattatgtggtcaagcgattgccggtggccgctgtgccgaaggcccaggtaatgcggcgaccggatggtctgatgaaggcgattgtggaacgcaatactggccgcattctgggtgcgatgctgctttccgtcgagtcgcacgaggtgatcaatatcgtcaagttggcgatggatcttgacgcgccggccagcacgttgcgcgatatggtgttcacgcatccgacgattgccgaggcactgaacgacttgttcgcgtagtttgttcgcatagcacgcccgcgcagcatgacccgcgtagcgcagcccgcaacagactcccctaatgcgcgcgaaggtcctcatcgacgtaaaccgatgaggaccttcgcgctgtcgtcatgatccgtacgtgacagcaatcacgtccgaaccagccgttacttcaagccgagcttacggtccagaatgtcggaggcatccaatcctaagcggcgtcggatgaaccagccaagaccgagcggcaggccgggagccaaggccatgccgcctggaccgagtgccacggttttggagttgcctgcgataagcatggtgcccttggatgcggccgtggaggtcgaaccatcgctgtccgcctctggtttgaggatttcgatgttgccgtcactggttttgtacagtcccttattctcattccagataccggatgcgccattgttgccggcctcacccgcagagaggaaatgtcttgtttttcttgtgagcgctcacctattcacgcgcgatggcatgtttttcaagcaaagtcaataggtgtgatgttattcacactcttcactacgttgttttgcctcgcactgggcaaccccacttcagcaagagattgcacagcttgcgttagggtggagaacatgactatcacagtatccacagatgggtccgcattagggaatccaaacgggccaatgggctgggcctgggccgatcatgagcagaacgccggcggcaagcccggccataagcacgacgaccatggttatgatgcgggcggcgcgaccaacggcaccaatcagattggtgagctgtgcgcagtgctggaagctttgcgagcgcacccgggccctgagccattgctcatcgaatcggattcgcagtacgccatcaattgctcgaccaagtgggtcaaaggctggaagaagaacggctggaaaaattcgcagaaaaagcctgtgaagaacaaagagcttattcaggcgatcgaccgtgagatctcacaacgccctggcccggtggatttccgatgggtcaaaggtcacgccggcaacgaaggcaatgagctggtcgatgaactggcacgcacctatgcgggcgattgccgttcgggtgcgcgcgacggctatctaccgattgaaggctggcagtcgctgctgggctccgaatacgcacatggcaccgatgtgcctccagacgtgcaattggtattggacggcaaagcggatgcggcaagtttgcgcaagccggctgcggcgacggatcagacggatgccgcaaggccggagaccaagtcttcgtcacccttagcggcacaatcaacgcaacctgtacaatcaacgcaacctgtaccccccgcaaagcccagcgggctgacggtatccggtacgctgaccttctcccccgcgccgaaaacgagcccgtatttcaacgggcagccgatgccgatcaaaggcagcatcgaaatcgaaggctatgtggacggcgacggcaacctgaccatcaccaacgcaccattcgtacgacactgacacccaaacacacgaatatgtaccgtaatcggacacgatgacacaaaatcgctcattcgcgttaggataggagataaggcttcacgccgttgatccatgcggcggaggcaaggatggcaaaggagaaaccatggataaggcacagcaggatgcgctgaagaaggcggccggcatcgaagccgccaagctcgttgaaaacggcatgatcgcaggcctcggcactggttcgaccgtgaagttcctggtggacgagctcggccgccgtcatcaggaggaaggtcttgagttcactggcgtaaccacgtctcgccgcacgcaggtccaggctgaaagctacggcatcaagatcgtggacatcgacgacgtggaccacatcgacgtgaccattgacggcgccgacgaagtcgacaagaacttcaacggtatcaagggcggtggcgctgctctgctgtgggagaagatcgtggccaccaactccaaccagatcgtgtggattgtggacgagtccaaggttgtggacaccatcggcaagttcccgctgccggtcgaggtcattccgttcggtgccggccaagtcatcaagaagttcgaggcccgcggctacaagccggtgcttcgtcttgacgccgacggcaaggaagtgcgcaccgacgagaacaacttcgtggtggacctgcacctggagcgcatcgatcacccgcaggagctggccgaagacctcatcaacacggtcggcgtggtggagcacggcctgttcctcaacatggtcgacaaggtcatcgtcggcgacccgaacggcccgcgcgtgatgaccaacgccaacaagtgatcgtctcacaccactaagcttttccaagcccgcatctgcacatcgcaggtgcgggctttactgttgcccgaacaaggcaaagagccaagcaaaagagaaaccccgcgaccataacgatcacggggtttctaatgccttgattgcaggtaagactacttacgctggtggcgggtcttacgcagcagtttgcggtgcttcttcttgctcatccgcttgcggcgcttcttgatgacagaacccatctgaagcctccatttcgattaatcgtaaaagttgcaactcgcaccataatacacgtgttgccagacagagggaaccagtatgttgccgatagtccgcatatgccctgaacgcagttggggcatccacatcagcaatgtggatgccccaacgttcataagtttgtgcagcagctgacagccgatactagatgctacatcgggaacttctggtagaagcgatcgaccgcttccttggtgccggtagcttggaagaccacggtatcgttctgccagatggcaacggcgttcttgctgttggaggcatcggccttcaccacgtacgcgcccgtgacgttgccggaaaccttgacgttgccggatgccgactcatcgccggtctgcgcagcgaccaacgcatcgtactgggtcttggcattgtccgccgacgaccactgcgcggcgaccagcgtgacatccttggcggcatcaccagtggagtaggtcagagtgtactcctcgagcggcgacgcggaattccacgtcgtggaggcatccgccttggtacgcgcgtaattcagcacgctgcccggcatggccttcaacagctcactggcatcatccggcaaagctgtggcgtcgatggtcggcttggtcggctcggatgattcggttttctgctggctgttttgggtggtagtggaggtgccatcattcttctggatggcccaacccggccacacaaaggccgaaagcactgccaggataatcacaacagctgcggcaaccaccactgcaatcaacttgccatgggattgcgtggtcgaggagttctcactattagtcatgccccgattctctcacagccgcgtgacgctaggcggccgtaattttagtcgttgtgcgcaagccgcgtgaaactcttgtgaacggtaaaaatttaccgtccgctggtgtttgggttagggtgagaccatggcgaaatcaagtgtgcagtatgtatgttccgaatgcggttggaacgggccgaagtggtacggccgttgccccgagtgtggtcagtggggcacggtcgaggaatttcacgaggctcggccggcggcaggctctcgcacggccgctcccggccgaacatcacgcacgcagtcggttacggttgccaacaacgccagatctgcagcccgtccgattaccgaagtgggcacggaaagcgtcgagcggctcggtaccgggttttccgaattcgaccgtgtgctcggcggtggcgtggtgccgggttcagtaacgctgatagcgggcgaaccgggtatcggcaagtcgacattgctgttgcagacggccggcaatatcgcgcgcgttgtggcgggagacagtacgttccgaggggcaggtcagcggtctgcccaacagtcgggccgggcgcagggcaacgcatcgaacacggtgccgatgcggggcaacgcatcatcaacacacgccaacaccgtgctgtacatttccggcgaggaatcacaggcgcaggttcgtttgcgcgcttcccgcatcaatgcggtggagccgaacttgttactggcctccaccaccgacctgtccacagtattggggctgatcgaacagaacaagccggccttggccattgtggattcggcgcagaccatcgtctcgcaggaggtcgatggcatttccggcggttcgactcaggtgcgcgaagtggcaagcgcgctgatagataccgctaagacacttgacattccagtatttctggttggtcatgtgaccaaggatggttcgattgcaggcccgcgcacattggagcatctggtcgatgtggtctgccaattcgaaggcgacagcgagactgcgctgagaatgctgcgagcggtgaagaatcgttttggcccgaccgatgaagtcggctgtttcgacatgagcggtgaaggcatcgaagaggtcaccgatcccgccggattgttcctgtctggagacggccctgatgcggccaacgcggcacccgtggaaggcacctgcgtgacgttcacattggatgggcatcgcagtctgcctatcgaagtacaggctctggtcaccacgtcggtgctgcccacaccccgtcgtgcggtcaatggcgtggaccccagccgtatcgccatgctggtcgcggtgctctaccgtcacagcaagctcaacctgctgtccaacgacctgtatatctccactattgccgggggccaggccaaggagcccggttccgacttggcgatagtggcggcactggcgagcgccgccacgtcaaaacccattgcgcgagccacgtgcgccattggtgagatttccctgaccggtcaggtgcgcccggtaccgcgtatggaatatcgccttcgcgaggccgcacgcctcggcttcaccacggcggtcattccgccactgcgcaagccggtgcatgtcgagggacttcagctggtggagtccaacacattgtccgacgcattagacgccttgggagtgcgtaaatagccctgagatatgcctcaggcggtaagacgcttggtctcctcgacgttgcgcttgagttcgtcgacgagttggtcggggccatcaaacttgacctgcgggcgcaggaagccgacgaattcgacgcgaaccttgtggtcgtacaggtcgatccattcttcagtgatgcagtaggcctccaccacacgttcgttgagccctgttttctcgctgaaggtgggtttggtgccaatggagatggcggcgggccaacggttttcaccatctaccagccaaccggcatagacgccgtcgaccggaatgtagcctgcaatgtcggagccaagattggcggtggggaatccgatggtgcggccacgctcctcaccgtgcaccacttcgccctcgatggagtgcggagcacccagaatggcgttggcgtcctggattcggccatgagccagcaggtagcgcacattggtggagctccatgcgcgcattgccttggcctggttcttcttgctccatgcgcggcgctcggccttggtggcattggccagcgggtcgacgggctctccccattcgctcggggcttccggcttgaaatcgcgcggaatacgcacttcacccgggccacggtcatcgaccacatcaagttcgaatacaccggtggcggcggcaagattggcgatatgcttcacatcaccttctcgacccttgcccatggcggcatcctgcccaaggaccaacgtgcgcatacccagcttgccggtgagtcggccaaggaagaaaatgtatgacatagctgcgaaggccagcgtgtagtgcaccaccagcacgtggtccacgccgaactgttccatgcggtgcagtcgatcatccacactggtcaaggcttcggcatccacgttctgcaccgcgggttcttcgccatggtgcgagatgacccagccgtgcacgaatgcggggcgcggatcaaacagaatcaccacggaaaaagcatcatgctggtgcgcgagttccaccacacgcttgatcaccgcctgatgacccaagtgcatgccatcaaatgcgcccaatgtcaccacggccttcttatcgttactgaacgagggccattcaatcgaaccttcggcgtcaggggtcaggtgcgtgatatccatcagtgtgctgttccttttatccgtgcgatgttatttatgcaatatagacgttgttgtgcgcggcctgtatcaagctgcacttttcaccgcgtctactttacgcgagggggaatacggtgaccggcttggcctgatgagcgtttgcacgctcgataatcgccgccacatcatgcgtttgcggcacaatggcggcagtgggctcgctgattgtacgctcaatacggcggccgaagcgtaattcgctggcctcctcaggagtgatgtcaagcgccggcatcgcacctcgagcggcctgttccatggtaagggcatggtcaagcagccagttgcggcgctcgtcaccggcaagaccttcaggagtgtccaatacgcacttgttgcgcgtgacggtttgcccttcccgattagtgaacgtcttctgatcggtatgtgcggtgacggtatgggttcgcgtgtcaagcatcgcctcaggagcgataagtccgctggcatcgtccggcaacgcgaatcggccgactcgcgtacggcgcaaacgggtcaggtatccgccgacgccaagttctttgccgaggtcgcgggcgagcgcacggatataggtgcccgatgaacagctgatccgcacgtcaacatcaagtgcgggaatcgctcccgtgttcgcgtcttcccgcaatggttcagcggtctgctcccctgctacgaatccgctgcggatatccagcacggtgaattcgctgatggtgaccgggcggggtttgagttccacatccttgccttcgcgagccaagtcgtaggcacgctggccgttgattttgatggcggagaacgtattggggacttgttcgatatcgccggtgaaattggtggcgatggtgcgtgtgagcaggtcttgccatgaggcagttggtaacgccgttggttcgccgctctggccaccctcagtcagctgcgctgatagcgtttgccagcgggagcgggcttcgtcatcgacaagcacctcgccttcggcatcgtcggtagtggtgcgcaggccgaggcgtatggtagcctcgtaggttttgtcatgcgccacgatggcgttgagcagtcgtgtggcgtggccgaaggcgatgaccagcgtgccagtggccatggggtcaagggtgccggcgtgaccgaccttcttgatgtgcaacgcgccgcgcacggcggcgacggcgtcgaaactggtcacgccttgcggcttgtcgatgatgagcagaccgctgggggttgtatgaagcacactactcctcgtcagagtcgtcttcgaagtcgtcgctgggctcgtcgtcatgcttgtacggatcggcgtcgccggcgtactgggcggtggcgcgagcacgggcgagttcttcgtcacgcttcttggccacggcgagaatgtcttcgatctcgtgagcctcgccgggcacttcatcgaacacgaattggagctgcggagtcagacgcaggccagccttgtggcccaccagagaacgcaggtggcccttggcctgatcgagggcctgctgggcgcgcttgcgttcgccttcctcatggccttcgtggccgagctgggtccagtagaccttggcgatttgcaaatcgttggtcacacggacttcggtgacggtgatgctggcgagtcgcttgtcatgcagttcgcgctcaatggaggaggcgacgacacgctgaatcaaggccgcaatacgtgcggcgcgcgggttggttcctgccataggaatttccttttctagacttgagccccctctgacgaggggctgccgaacgcagtgaggccaggggagagaaaatcatggaactaccatgtctctcccccagtcagcctgcggctgacagccccctcgccagagggggcttaacaatgactacttgcgctcgacttcccgcatctcgaaggtctcgatgatgtcgccgagttcaatgtcgttgaaggtgccgaggttgataccagcctcgtagccttccttgacggactgaacgtcgtccttgaagcgacgcagcgaggagatctcgaggtcgttgaccgtggccacgccgttgcgcaggatacggcacttcgtaccacgcttgacctcgccgtcctgcaccataacgccggcgatgttgccgaacttggaggagcggaagatctcgcggatctcggagtgagaggtgacgacctcttcgtattccggcttgagcatgcccttgagggatgcctcgatgtcttcgatcgcacggtagatgaccgagtagtacttgatctccacgccctcgcgctcggcgaggtccgcgacctgacggttcggacgcacgttgaaaccgatgataacggccttgtcgaccgtggccaggttgacatcattctgggtgattgcaccgacgccgcggtggatgacctggatgccgacctcgtcggatacctcgatcttcatcaaggaatcctcgagcgcctcgacagaaccggacgaatcgcccttgatgacaatattgagcatgtcgatctcggactcggcgaacttcttcttgaagtcctcgagggagacgaccttgcgacgcttggccagctgggcggcacgctcggtggcctgacgcttctcggcaatctggcgagcggcacgatcatcggaggcgaccaggaagaggtcaccggcggtgggcacggaggtcaagcccagcacctgaacaggtgtggacggaccggccgcttccatcggctgaccgttctcgtcgagcatggcacgcacgcggccgtacgaagtgccggccacgatggcatcgcccacgtggagcgtaccctgctgaaccagcacagtggccacggcaccacgacccttgtcgagtcgggcttcgacggtggcaccacgggcgtccatgtcggggttggcgcggaggtccagctcagcgtcagccgtgagcagcacggcttcgagcagcttgtcgacgtgcaggttctgcttggcggagatgtcgacgaacatggtgtcgccaccatactcttcagggaccaagccgaactcggtgagctggccgcggaccttctccgggttggcaccgggcacatcgatcttgttgacggccacgacgatcggcaccttggcggcctgagcgtggttgatggcctcaacggtctggggcatcacaccatcgtcggcggcgaccacgaggatcgcgacgtcagtgagctcggcaccacgggcacgcatggcggtgaacgcctcgtggccaggggtatcgaggaaggtgatcttgcgcggttcgccttcaaggttcacggtgacctggtaggcaccgatgcgctgggtaatgccgccggcctcacgtgcgatgacgttggtcttgcggatggtatccagcagtcgtgtcttaccgtggtcgacgtggcccatgacggtaacgaccggcgggcgaggcttgagatcctcgtcatcctgcagttcttcctcgtcaaggttgatgtcgaactgctggagcagttccttgtcttcctcttctgcggagacgagctggatgttccagccgatctcttcgcccagaatctggaaggtctcctcatccaaggactgggtggcggtagccatctgacccaggtggaagagcacggtgaccagcgcggcctggttgacgttgatcttctccgcaagatcggccagggacgcgccctgacgcagacggatggtctggccgttgccgttggggatgcgaacgccgccgatggtcggtgctttcagctcctcatactcatggcgctttgccagacggttcttacgggcctttgaagacttgccgccctgacgtccgaatgcgcctgcggcaccgccgcgaccgccgcgaccgccgccacgtgcgggaccgttgctcggtgcaccgccgccctggaagttattgccgccgccttggcccccacggaagccgccgcgtgcgccgccctgaccggcaccctgggagccgccgccctgacccggacggttgtggccccactggccgggacgcggaccgccctgaccaccttggcccggacgaccgccacggaagccgcggccctgcccctggccttggccgggacggcccggacgaccgccacgaccgttatcagcagtcggacgagccatcggatgcggacgcggaatatcacccggcgtcggggtgtgcataccctgcttgcgggagaacgggttgttgcccgggcgcgggccctgagcgtgcgggcgcggaatcgcatttgaagcggcattgccgccattggcaccggcgccgccctgagcgtgcgggcgcggagccgaagcattgccgcggttgttctgatgctgaaccggctggccattgttcggacggccctggttgttacgacgatcgttgttacggcgatcgttcgggcgactctgacgaccgttctcacggccttcgcgattatcgcgaccattctcacggttgtcgttctgaccgtggcggccgggggtcggcatgccggggcgtgcgccgccctgcggacgcggtgtcggtgcacccggagtcggagcctgctgatgtgccgaggcaggcgatgcctgacgtgcgggagcggccggagtcggtgcggaagatgaagcggaagccggggccgaaggtgcggccgggcggcgctgctgcacgggcttggaatcgcccttggcgttgtccttggcgaactctgccttcagacgccgggctaccggcggttcaatcgtagaagaagcggacttgacgaattctcccatgtccttaagcttctcaagcacggttttgctatcgacattcaaaaccttagccagttcgtatacgcgtggtttcgccactaattactcctattctgtgaccacgcgcgtgcatgggcgtggtcagttggtgatgacggcaagcctaccctgtctcatcgtgcgaccatgatcgtgttacctcgtctctggtgtgggcgatttcgcgcacactgcgccagcccacatacgccaatcaagcatactcatagcgctggatagcgtagacgcagcgagccgcgccattgctgacgcggctcgtatcaggaaataatgcgccctgaagatcattcgccttcgagcccggcggcctattcggcttccggagcagcagcctcggccgcagcctgggcggccttttcggcggcgactttcttggcatgggcctcggcggattcgatgccgatcttccagccggtcagcttggctgccagtcgtgcgttctggccttccttgccgatggccaaggacagctggtcgtcgtggatgaaggcgatggcggtcttgttcttctcgctgatcacctgcacgccggtggccacagccggggacagcgcggctgccacgaacttggccggatcgtcggagtagtcgacgatgtcgatcttctccgggccaaggttctccataacggcacgcacgcgagcgccgccggggccgatcagcgcgcccttcgggttcacgccatcggtgttggccttgaccgcgatcttggtgcgggcgccggcctcacgagcgatggccatgatggacacggcaccggagaccagttccggcacttcgcgctcgaacagcttgcggaccagctccgggtgggagcgggacaccacgatttccgggcctttgatgccacgggccacgttcaccacgtacacgcggatgcgttcgccgtggcggtaacgttcgccgggcacctgctcacggcgaggcagaatggcttcgacatcgcccatcgcgacatgcacgttggaggggtcggaagcatcctgctggatgatgccggtgatgagcttgcccttctggccggagaacgcaccgaataccttctcatcttcggcgcggcggaacagctgggtgatgacctggcgtgcggtggctgcggcgagacggccgaagtcacgcggggtgtcatcgtattcctcgcccagcttgggaacggggtaagggttgtcttcggtgggttcgaccggaatttcgtcggcggcccacacggtgaagttgccggaacgttcgtcaagctccacgcgcgcgtgcttggcggcgtgcggggtcttgaggtaggcgaggcgcagggcctctgccagcgcatcatccagggtttcggggtcgattccttgctcggcggcgagcttgtgtattcctgtcaggtccagttccatcgatccgtacctcctatgaagttatgtggcgcatggcctatgagtagtcacagttagctattagtgtatgtttccatgcagacacgcttctcttcaggacggtttacccggcgcttggcatccgtactatgcgcgagcgcgatgctgtgttcgctttcggcgtgttcgatgccgcgactggccggacgggccgaggcagaagctcaaatgaccccttgcgagaaagcgatgacgttggcgggctacgccacccatccggctgaaggcacgccgttattagagcagtatgccaccggtctggccgctcccctggcttggattgacgttgccgggtattgttcgggtcgttttgccgagggaacgttacgtgacgcgcagaccaagcaatggctggcttttctggccgataaattcgggcagtccgcgcctgaggtgacgccggcgcgtcttgatggcgtcacgtccgccaacgttgatcgatcggtattggatgcgatggccgtggccgaggatcgcgccggattcgctatcgaggtcttggccgcacgaggacagaccgctggggctacgttggcgttgagcgatatgcataagaccgccgggcagcagttggttgcgctggcgaacggcaattttgatgattccggcgcacaatccagttcttccggccaaaacgacccccgccaaaaggtctatgccatcgaccaactactggccaaccccaccaccatcgccgacaaggcaagcggccaaaccgtaccgaccgccgccgccatcgaaatggactgcgcccgcgcgcagatcaaggccgtgaccgaatcgaaatcttccaccgagagcgatacgctgctcatcctcgccgcactggccgccaagcacgcctacaccgcgttccaacttggctacccagcgactgacgccgcattgttcgagtagacacacactcctcacgaagccgatgcgaacttgttggatgctagtgggcaagtcgagttgaggcacgttccaccaatgtgaaatcggtggtgtacgtacgggccgggcctgagtatccttcgatgcggtcgataagcatgtcaacggcatgcttggcataatcatcgatatgaggatcgatggtggtcagcgccggcaccgagtactcggcttccggcacgttatcgaagccgaccacttgtacatcgtcaggtacatgcaaaccacatcgttgcaattcatgaattgcgcctaaagcaatggcatcattgagacacactacaacatccgggcatgggagcttgtctagcatagcttttgtcacgcgcataccttcacgctgattcatgctttctgccggaatcacataccgccaattcaccgataatccgcgctcttcaaatgccttcacatatccttgggcgcgtaacgcctgggtcccttccgtctgacgacgcagcactgcctcatccaccagttcaggaagaacacccatcagagcaaccgtttgggcaccttcatccaaaaatcttcctacaaccgtggaaatggattcaatgttgggcatggtgatccaatcgcttttcccgtaggccagatggtctccggtcgttacaatcggatatggctgctccagaacggccccttcatccgcgagcggcgacattacgaacagaatccatccttccgcccctaaacgataggactcgtcaacgctggcaaccaacccttcaccgtcggaaccatatgtgttgatgactacaccgtaatggcgttcttttgcgtattcaatgaccttgtcagtgaaaaaaggaacgaacggctgcgagaaatcgaagatgttgagtccaataagctttgtgccgccagatcgcattgcacgcgccgaaatattgacggtatatccaagcttacgcatcacctcttccacacggcgacgtgtatccggtctcatactgccagtgtcattcagcacattggaaaccgtcttgatggagacgttcgcctcacgcgccacgtccttgatagttacgcggtttcccattgttcgaatccatttctgcttattacatgacacaccttcaacagcgtcattatgttcttattatggtaagtcacagtcgggtcgagcatctcctcctcatatcggaatcatctacccctcaacctcagaattcagccaaggagctttcctccgttggaccccatgcaccattaggcaaatatccttctgacaatactgcaggacgatcgaacgtagaggttaaactttctggttgaagaaacgcacgcacgccatccgaacaagggactttctgaccgccggctttcaacctagctttttacatacccgtcttttctccttattcctttgttgggtatcgaattgttccagtcgatgtgaatgacggcattgtcttcctttgactggtatgccacattacattagtggcgaatccgaacctctctttctgcaatccgggcatgttgatgattgtttgggtattgcttggtggttgtacagggcacagcaaccataagagactgcgccctgtcatgcgccaccgtcactcgaatcacttcacgtgcacggcggtccaggagaccggcggcaaggtcacacgcacagtgccggtatcggcgtcggacgtgatggtggtgttggggtgcagaacgactcggttctggtcttccagcgtgttttttgccagcagatcatcctcgtgcagggtttgcgcctcgaccgcggaaagtgcgaatccttccggcagcttgatggcaaagtcattggccgcttccatggagcgattgaccacaaacacgctgatcgtaccgtcctcaccacgcacggctacggaattgatcgtcggcacttcaccgtatttgtcggtttcatacgttccggaagccagtttcggttcaagcaccgtgccgcccttggcgagctttgcggtcagcgagaacggatagaacgtggtctgacgccacgtcgggccgcccggttcggtcataatcggcgcaattacgttgaccaactgggccaggctggcggcgtgcacgcggtcggcgttcttgagcagggtaatcatcaaatcaccgaacaccacggcgtcggcggcgctgtacacatcctcgagcaggcgcggggcaaccggccaattgccgatgccttccggattcttgctcggctcttcgttgagataccagacattccattcatcgaacgagatgaacacgtcgtgcttgctcttcagccgggccttggttgcatcgatggcggcggcgacatcgttgatgaaaccgtccatatcgacgcccgaggcaaggaagctcttcatgtcacgggtgccatcaggctgaagttccggatggtagtacgcatggcaggagacgaagttgacgttgtcaaacgtcttctcaagtacggtttcttcccacttgccgaaggtgtccatcacgtggctggatgaaccacagaccaccagttcaacgttcggatcgatggcgcgcatacctgccgccaccgaggccgccaaggtgccgtaatcctcggcggacttgtgaccggtctgccacgggccatccatctcattgcccaagcaccacatcttgatgccgaacggctgatcggcaccattggcgcgacgctcctcggagagcttggtgccgccgggaatattcgcgtattccaacaggtcgagggcctcttcaagaccacgggtacccagatttacggcttccatcagctcgttgccgccggtttttccagccatttcgccatttcgtgcagaccaaactgattggtctcggtggaatgccatgccaagtccaggcgacgcggccgctcatcacgaggaccaacgccatcctcccagcgatagccggaaacgaaattgccgccaggatagcgaatcgtggtagcgccgagttccttgaccagttcgatgacgtccttgcggaaaccgtcttcatcggcttcggggtggcccggctcatagatgccgtcgtatacgcagcgacccagatgctccacgaacgacccgaacagtctgtcgttgaccggagctacttcaaagtcattatcgacgacgagtcgagattcctccagctcccccggtttattgtcgtgcgaatgctcggacatgtgctctcctttaatcgttgtcttcaataccgcaagacaacgttgtgctaaataccaaaagcaatcggcccatcttcttggttcacctgttttgcggcatcgccaatcagcggtgaatgtgcgttctggatatttaatacaaccttgtacttctgttgatatcgataatacgatggttgtacttagtacgcaagtcccgctgagtacaacgttatccttttcgctattttccacccgacacgccgtatacgatacagcacaggagcgaatacggacgttcgtatcaaaaacaaaaagggttccgggacaaacccggaaccctaaaggcggataaggcgagattcgaactcgcggaggctttcacctcacacgctttcgaggcgtgctccttagaccgctcggacacttatccatgctgccaaaatggcaacttgttcattatgccacattctgccgacctggcaaatcggagtttcgctgagctcgattcggcgtgggataatgcgattttgtgtgagattgcgatgggtcagacgatgagccgattaacagtccgaattggtcaactgcgaaaatccgaattcttcaactaccaaaatccgaatattggtggtggtagaagcggtgacggggccactctgcattgagtggtctctccctcggtcagccttacggctgacagctcgaacgcaattaaggacagctttccagctgccattttatttgctcactgtcgttcgccttcgcctaaaaacgcctccggcgttttcttcacggctcagctcatcagagggggcttggaattttatttatgccacctgttcgtggacggaggcgttgacccattgggactgctggacgttgtatccagagaagatgccgatgtcgagcatgcagtcgcggtaatcgcggccgtgggcgatggtgatgtagctgtcgtccaccaatcggttatgcgtgggatccagtccgacccatcggccatcctgatacacctcgacccaagcatgggtcgcgccctctcccccaagcaaaccggcaatgtagcgcgcggtcaatcccacatgccggcacacggacagcatcacgtgcgcataatcctggcatacgcccttgcgctgagccaaggcctgttcggcggtggtgcgaatcgtggtggaaccgggcgtatacacaaacgccttgtagacctcatccatcacttcggcggcctgctgcaccggagtggcgtcggaaggcagcgccgccaagcgttcgcggcatacggcaatcatcgcctccacgttcgggccgggaatggtgagcgctgaattgaatcggtacagcggtttataggcttccttatggatatgcgcattgtccacgaaggcgatgccggtcaccgagtagctgaatatgtcgtgcggctcagggatgaatccggtcatcaccacggagtcaaaggagtcgatggtggtttcgagttcggtttcgggctgaatcttcacttccacgtcaatcacctgttggcgagggccagtggagggaatacagcgaagctggaacctgtgatcggtgaccggtgcgctgaaggacagcctcatctcatagtcgaacacgagttttttcacaacgtctcctgcacttgcacacgagccggcaaccggcatattctcgggataacgacactacagccatggctgaggtatggtccgtgcgctcacagcccacgcatatattccggcaatctgctgatatgcacaggccggcactcgggcgcacggttttttcgccataccaccatagcatttgaacccgtcagggtgtcaggtcgggatcagggacgcttggcatccatgttcatggagctcagtgagcccatgtctttgatggccagcgcgctgacacggccggagtagtcgtcaaggtacttcttcagcaggtcggcgacttcctgatatccgcgagacggcagctgaccgaccagccagctcagtccgtcggcgaagcagctgggcagcggcatgccgtccaaggtcatcgaataggcggcgagcttcttgagcggcgcttccagctcctccatcgtcaggccgaagcgcgtgtacaggtcgatgcgttccagatatttgccgatgaagatgaacgccttcagcgtggggtcgaccggcgaattctcgatgccgccccagaaggcgagcatgtcatcggtaatatcgcgctgcttgtagatgtcctcggcatcggccgcgtatttggcggcatcggtgatattggtcatcgccaactccacgtactgcagcagacgcgagctcaattccgggcgcagaatcacggcgttgttgaatgcggaggttacggccgaccgcaccgaatcaggattggacccgtcatacaggaagctgttcacgaacccgtcgaagtcctcgaaatcttcgggcaggtcgagtgcgtgagcgaacggacggaaggcgtccacatcagtgtccatcacacgatcgtagaacgggaagaactggttcagcgtggtgaaggcgcgctcggtgtaccggcccagccaatacaggttgtctgccttggaagcggtgaccagagacaacgagtggcggcgggactggttcagcaggttcaccacctgcgtttcggcaccgtattcatgctccacgccggattcgggtgccaacacccacgtatccttgaatccgccaccctgcgacgagttgacaatcatctggccaggcaccgacgagtatcgagtcaagcccgaataccacacgtgcgtattcttgccggtgaccacgaaggcacgcaaatcgcacttgcgcggcgacatctcgccggtcttcgggtccaccacatcgatatcacggaactgaatcacctcttgggcaatgaatcgacgcggctcctccttgatccggttggcgagctcctcacgtgcggcggcatccagcgacgaaccaaacaccacgccgtaaccgccggcttcggccacatccttgatgaccagctcgcccatccgattcaggacttccttgcggtcggcctcgaacatcggcatgtacgtgggcgcgttgttgagaatcggttcctcgccgagatagtacttgatcatctgcggcacgaagtagtagatggccttgtcatcggccgcgccgttgcccggcgcgttgacgatggccacgttgcccgcgcggtaggcggacaggataccgggcacaccgatcaccgaatcaggattgaaggcgaacgggtcgaggaattcgtcggacaggcggcggtagaccacgcccacacggtggcgtttgccggcgtagtcgaggaagtagaccttgttgtccaccacttcgaggtcctcggggaaggccaacgccgcaccggttttctccgccagataggcgtgctcgaagaacgcggaattgtagcggccgggagtcagtaccacggcgatgccctcggtggagacaaagtccatggctttgcgcaacaggcgcgggtattcgcgattatcgcgaatacgaacgtcgcggaacaggcgcggggagatgcggcgctcgatgtcgcgcacgaacagcgggtagctggcacccgagggaatacgcaggttgtcttccagcacccaccatcgtccgtcctcgccttggaccaggtcctcgccggcgatgtgagcaaaaatgccgccgggaggggtcacgccgttgacctgcgggaagtagccggccgaggtgtatacgtattcctccggcaccacgccgtcatggatgatggccttgtcggagtagatgtccttcagataggcgttcagggcgttgacgcgctgcttcaagcccttctccaattcgtcgtattcgtcggattcgataatgcgcggcacagggtcgtacgggaacagccggtcatggtattcgccgttcttgtagatgccgaaacgcacaccgttgcgggacagctctcgattgatcgcttcgcggcggtttaccagttcatgggccagtctgcgtgctgcggattcgatcatcgtgcctgctccttgctgtggcggcttctgtggcttcaagcggttaggcgtgttgagcgcacgctgacgccgcaagccgtaaccgggtttgatggtttcaacctaaggcgggcccgtttcaacaaacgcgcgagaatgttacaggcaggtcacttcgccggccgcgtgcatcttgacgaccgcactcgtctcgccgaccgcacgcatcttgccgaccgcacgcatcttgccgaccgcactcatctcgccgaccacactcgttacaatgaatggctatgacacgactgcgcattgacttggcctacgacggcggcggattctatggctgggccaaacagcccaatcttcgtacggtgcaaggcaccattgaagatgcgctgcacaaggtgctgcgggtgccggccgatgacgcggccgaaccgttacgcttgacggtggctggacgcaccgacaccggtgtgcacgcctcccaccaagtggcgcatctggatgtatccgatgaggtactgaatcgctgcgtaggtcacatgaccattccggtcaccgaggcgctgactcgcagactcaaggctgtgctgcctccggacatcgtcattcatggcattgccgtagctccggtcggcttcgatgccaggttctccgcattggagcgcacttatgtgtatcgggtcgccgatcgttcgtctgaggtcgacccgcgcctgcgtggatgcgtacttaccgtggatgaagcgctggatctggagcttatgaaccgcgcagcctcattgaccatcggcctgcacgattttggttccttcgccactccgaatccgggaggcactacgatccgtgaagtcaagaccgcctattggcggcgggtgccgatcactcccctagtaccggatgagatggcatcgcatgaagcatatcggactccgtcgctggagtccggcctggtagtgttcacgattgtggcggacgcctttgcccgcaatatggtgcgctccctggtcggctcatgcatcaaagttggttcgggacgcaaatcactggagtggtttgccggcaaaatggccgagccagtacgtgaaggctcaagcgggccgattgcgccgcagggcctgactttggagcatatcgcatatcccgccgatgatcagctggccgcaagagccgaggccattcgggccgtacgtacgttgtagattctatgaaaacaacgcaaaagggctggaacccaaacggattccagccctttcagctagcttagcgaaacgctattcagctcactcggccttctcggcgtcagcggcttcctcagcgggagcctcagcctcagcggcggcggtctcctcgaccggagcctcaacagcctcagcagcctcagtggcctcagcctcaacggccggagcttcttcttcggcaaccttggcggcggcttcagcttccttcacaacagccttcttggcaaccggctcggtgacgagctcgatcacagcggccggagcggcatcgccaacgcgcggagcgatcttgacgatacgggtgtagccaccttcacgctgctccatctgctcggcaatctgggtgaacaggatgtgcaccacggacttgttgcggatgacgcgcatcacgcgacggcgggagtgcagatcaccacgcttggcgaaggtgatcaggcgctctgccagcggacgaaggcgcttggccttcggcagcgtggtggtgatgcggccgttctggaacaggctggtcgccatgtttgccagcatgaggcgctcgtgtgcggggctggaagccagacgcgggcccttcttaggtgtaggcattgggtttactccttatatgtccgttcttcaggcaagcaggtgggcatatgcccgaacatctgcttgcctagtgaacgaacgattggtcaaagaggcagatcactcgtcttccggcgagaagaacgtgccaccttcgagattattggtatcgaaggccatcggcgaggacttgaggctcaggcccaaggtctgcagcttctccttgacctcatcgattgacttcataccgaaattgcggatgtcgagcaggtcctgctcggtgtgggagacaagctcaccgatggtgtggatgccctcgcgcttgaggcagttgtaagaacgctgcgtcaggttgaggtcctcaatcggaacggccatctcggggttggtctcctcggccaccggggccggaccgacctcgacgccttcagcctgggcgttgagctcacggcacaggccgaagagctccaccaaggtggaaccggcggaagccaccgcgtcacgcggggagatggcgggcttggtctccacgtccaggatgagcttgtcgaagtccgtgcgctgttccacacgggtggcctcgaccttgtagctcaccttgagtaccggggagtagatggaatcaaccggaatacggccgatctcatcgttgtcctgcttgttcatctgggcaggaacatagccacggccacgctcgacagtgaactcgatctcgagttcgccatcgtcggcgagggtagcgatgtgctgctccgggttggcaatggtgacgccggccggcggggtgatgtccccagccacggcttcgcccttgccgctcttgcgcagatacatgaccacaggctcgtcgtattcgctggtgagcacgatgcccttgatgttcagcaggatctcggtgacgtcttcctggacacccggcagagtggtgaactcatgcagggcaccggaaatacgcacggaggtcacggcagcacccgggatggagctcagcagcgtgcgacgcagcgagttgccgagcgtgtagccgaagccaggctcgagcggctcgatggtgaagcgggagcgctgcggattcagagattcctcggtaagagtcggacgctgtgcaataagcactgtggttatcctttcagcttgaactcggtggtgcactcaccggtcaggcggttttggatggatttggtattgctgagtgctcagacgcgacgacgcttcggaggacgaacgccgttgtgggcttgcggggtgacgtcggtgatggaaccaacctcgaggcccgcagactgcagggaacggatggcggtttcacgaccggaacccgggcccttgacgaacacgtcgaccttcttgacgccgtgttccatcgccttgcgggcggcggactcggcagccataccagcggcgtacggcgtggacttacgggagcccttgaagccgacatcgccaccggacgcccaggacaccacggcgccggacggatcggtgatcgaaatgatcgtgttgttgaaagtggacttgatgtgagcctggccgaccgggaccgacttgcggtcgcgacgacggggcttacgagcggcttgcttaggcgctgccattgaccctcgtttcctagtaacgaactttgttgttgacgttcgggcgatgggatgaaaatcatcccgtggcccgaatcatgccaccgactacttggtggccttcttctttccggcgaccgtgcgcttcgggcccttgcgggtacgagcattggtcttggtgcgctggccgcgcacaggaagtcccttacggtgacgctggccttggtagcagttgatctgaatcttgcgacgaatatctgcatcgacttcacgacgcaggtcaccctcgatcttgtagttggcttcgaggtagtcacgcagcgtaatcagctgctcgtcggtgagatccttgacgcggatgtccggactaataccggtcgcggcaagcgtttccttggcacgagtgcgacccacaccgaaaatgtaggtgagggcgatctcgatgcgcttctcattggggatgtcgactccggcaagacgtgccattgcgattccttcttgttgccgtaggtcttgcacccgctcgcccggttacccggcacgggcctacgtacccgtggttcagtgtcgttcccttgcgggaagcactgtgagagagtgccttatttacttagtgccgctggagaatctgctctcagccctgacgctgcttgtggcgcgggttgacgcagatcaccatgacgcggccgtgacggcggatcacgcggcagttttcgcagatcctcttcacgctagggctgaccttcatggttatccttttcttgtgtacctttacttgtaacggtacgtaatgcgtccgcggttcaggtcgtaagggctcatttcgagcacgacacgatcctgcggcagaatacgaatgtagttcttacgcattttgccggaaatcgtggcgagcacgatgtgcttgttttcgagttcaacgcggaacatcgcgttaggcagtgcttccacgacctgtccttcgacttcaatcacaccgtcttttgccatgtgcctctagtcctattccgttggatgattactatggcatatccgaagacacaccaactgtcaactatatacgcacatacccctgtacgaacactcggcgtgtcgcacaggggtatggaaacgttgatgtggtatttcggcatcactccggcttgttgcccgggctgccgaacctactactcgaggtggctgatgatacggccgctgatctcgtcgatgtcgccgacgccgttgaccacgacgagcaggccacgggcctcgtagatgtcgagcagcggagcggtttccttctcataggtctccaggcgcttggcgatggcctccggagtgtcgtcagcgcggccctgctcggcggcgcgcttcttcatacgctccagcagcacgtcgcgggcggcttcgagggccaccacgtggtcgagcggagtgtcgaggtcggcgagcatctcgtcgagagcggtgacctgggcggcgttacgcgggtagccgtcgaggatccagccgttcttgcagtcttccttggccagacgatccttgacgatcttgttggtcagggagtccggaaccagctcgcccttgtcggtgtagctcatcgcctcaaggccgagttcggtcttgttcttgatgttgtagcggaagatgtcgccggtggagatggtggggatgttgaagtgttcggcgagcagagcagcctgggtgcccttgcccacgccctgggggcccatgatgagcagacgcatggtggtctccttttatgtcggttattaatacggttttggctcccttggttaagggagccattgagttatatgcggaagaaagattgctccgtcgtggaacagtccactggactgtttcactcctcgcgcggccgcctgcccattgcgggcggccgctgtcaagcgggcgtcagccctctttgtggtccacgttttcgaacaggaagccggtgtactggaactgttcggtctgggccttggcctggcgcagggtgtcgaggcccacgcccgcgataatcaggatcgtggtgccaccgaacggcagcttggcgttgaggccgagggccatgatcagcacggtcgggatcagggccacgaacagcaggtagacggcgccgacggtgttgagtcggttcatcacgtaggtcaggtagcggctggtggcgttgccggcgcggatgccggggatgaagccgccgtactgcttcatgttgtccgcggtctcgtccgggttgaacgtgatcgaggtgtagaagaagcagaagaacacgatcatcagcgcgtacagggcgatgtaccacacggatgtggtgttcgccaggttggcgttgatccacttgacccacgactggtcggacttgccgaactgggcgatcagggtcgggatggcgaggatcgaggaggcgaagatcggcgggatgacgccggacatgttgatcttcagcggcaagtaggtggaggagccgccgtacatcttacggccgatcatgcggcgcgtgtactggaccggcacgcggcgctggcacagttcgacgaagtcgacgaagatgaggatgaccacgagcacgcccacgacgatgccgaacttcagccagtcgccatcggtgccgtcggtgccgtagccgatctcccacagctgcggcaggaagccggagcagatggacatgaagatcaagatggacatgccctggccgatgcccttgtcggtcacgagctcggccatccacatgatcaggccggtgccgccggtcatgatgaggaccatgaccacgaggttgaacacggaaccgtccgggatgacctggtcgcactggtagttgaacagggcgccggagcgggcggtgaccaggatggtggtggactggagcacggccaggccgatggtcaggtaacgggtgtactgggtgagcttggcctcgccggactggccctccttatgcagggcctcgaagcgggggatgaccacgcgcagcagctgcaccacgatggacgcggtgatgtacggcatgacgcccagcgcgaagatagacagctggagcatggcgccacccgagaagaggttcaccagtccgatgaagttctcctgggaggcgctgccgatagtggccatgcacttgttcaccacgttgtagtccacgccaggggtcggaatgaacgaaccgatgcggtagacgatgatgatgaacaggacgaagagaatcttcttcctcaactctttggttttcagggcctggattagtgtcctcacctagatttcctcccaatagcgcgccaatcgcgcgaaatacacaaactaacgaacgagcatagtctaaagtgcctacttcggccacttcatgtctcgcgaatgttacctgaattatgctccgtcgtactgaacggggggaagcatactcaaaacgatcattgtgttgagactgcttctctgcactcagaacaacaattttttagaaaagggaacccccgtccacctattggcgggcggggggttgtacagcctattgcgctccccgtaggactaatcagtcctcggaaacggaaccgccggcggcctcgatcttggacttggcggaagccgaaaccttaacacccttgagggtgaaagccacggtggtctcgccgtcgcccagaaccttcaccggagcgttgtcacgaacagcgcccttggcgatcaggtcggccacagcaacctcgccgccctcggggaagagctccacgagacgagcgatgttgatgacctggaactcgaccttgaacgggttcttgaagccacgaagcttcggcaggcgcatgtacagcggcagctggccgccttcaaagcccggacgcacgtggttgcgcttcgtctggcccttggcgccacgaccggcggtcttacccttggagccttcaccgcggcccacacgggtgcggtccttcttggcacccggggcgggcttcaggtcgtgcatctgcaggatttcgttatctgccataatcagtcaacctcctcaacggtgaccaggtgacgcacggcgttcaccagaccacggttggccggggtgtcctcgcggacaacggtcttaccgatcttgttgaggccgagggtcttgacggtggcgcgctgagccggggtacggttcacgatgccgtggtgcagggtaatcttcaggttcttagccatgagtatcactcaccatccttctcttcggcggccttagcggcagcagcctcttcgcgagccttgcgagcctcggcaatgccggcggcgcgggcgcgcagcagagcatcgggagcgacctcgtcgagcgccaggccacgacgggcggcgatctcctcgggctcttcgagctgcttgagggcgtcgacggtagcgcgcaccacgttaacggcggtggcggagcccatcgacttggtcaggacgtcggtgatgcctgcgcattccatgacggcgcgcacggagccaccggcgattacaccggtacccggggcggccggacgcagcaggacggtgccagcagcgtcgtgaccctgaaccgggtgggtgatggtgccgcggacgcgaggcacagagaacatgtgcttcttggcgtccagctggcccttggcgatggcggccgggacttcacgggacttgccgtagccgacccccacggtgccgttgccgtcgccgaccacaaccagtgcggcgaagctgaaggtacggccacccttgtgggtcttggacacacggttgatggtcaccacgcgatcgagcagctcgtcgccgtggttttcttcacgacggttacgacgctcgccacgacggccttcaccgcgctggccacgacgacccttgcggtcctcgttgttggattcggtcgccacagtgttctgagtttcttcagccacttgggtttccttcgtttcgttgtcgctcacagtgcaagacctccctcgcgggcgccatcagcaacggctgcgacgcgaccggtgtacttgttgccaccgcggtcgaacacgactgcggtgatgccggcagccttggccttctcggcgatcagctcgccgaccttcttggcggcctcagtcttggtgccttcgaagccggcgaagtcggcctgaagagtggaggcagacaccagggtaatgcccttggtatcgtcgaccacctgagcaaccatgtgacggttggagcgggtgaccaccaggcgcggacgctcgggggtaccggagatgcgcttgcggatacgcgcgtgacggcgcttgagagctaccttcttgccttttccgagaatagcaacgctcatatcacttaccagcctttccagccttgcgcaggatgcgttcatcggagtacttgatgcccttgcccttgtagggttccggagcgcgcagcttgcggatgttggcggcaacctggcccacgacctgcttgtcggtgccttcgacaaccacgtggttggcgtcggtcaccttcagggtgatgccttcgggcgggttgacggtgatggtgtgggagtagccgaggaagaactcgatgccctggcccttggcgacggcgcggtaaccggtgccgacgatctcaagagtcttggagtagccatcgtgaacacccttgaccatgccggccatgatggaacgagccagaccgtgcttggcacgggtcggacgcaggtcatcagcggcggtcaggacaatctcgttgccttcaacggcagcggtgatgccttccggaaccacgtaggagtcagaacccttagcgcccttggcggagaagttctggccttcaatcttgacttcaacgccagcagggatggcgatggggagcttaccaatatgcgatgccatgtttcagctctcctttctcaccacacgaaggcgacaatttcgccgccaatgcctcggtcgaggcattccttctgagtcagcagtcccgaagaagtcgagatgatggcgatacccaggccaccgagcggcatcggcagggagtcggacttcgcgtaacgacgaaggcccggcttggagatgcgcttgataccctgaatggaacgctcaccgttcggaccgtacttgagggtgacctcaagagtctggccgaccttggcttccttagcggtgaagtccttgatgtagccttcacgcttcaggatctcggcgatgttcgccttgaacttggagtacggcatatccacggtttcgtgcttggccgcgctcgcattacgcagacgcgtaagcatgtctgcgatcggatctgtcattgtcatttgggcttgttgccctttctcgctatggtttccgccgccctcacgcttcttctagaagcgttcgggccgcggaccttcagcgtcgatgtttaccaactggacttcgtaacgccgggcagttcaccgcggtgagccttctcacgaaggcagatgcggcacaggccgaacttgcggtagacggagtggggacgaccgcagacctggcagcgcgtgtaagcgcggaccttgaacttcggcttgccggccgccttgttcttaagagcggtttttgccatatcagttctccttgaaggggaagccgaggtgcttcagcaacgcgtaagcttccttgtcgtccttggtggaggtcaccacagtgatgtccataccgcgcacgtgatcgatcgaatcaggatcgatctcgtggaacatggactgctcggtgagaccaaagttgtagttgccctggccatcgaactggtggccgttgatgccgcggaagtcgcggatacggggcagcgcgagggtcagcagacggtccaggaactcccacatgcggtcgccacgcagggtgacgtacgcaccgatggcctggccttcacgcaggtggaactgcgcaacggacttcttggccttggtgatcttcggcttctggccggtgatcagggtgaggtccttgacggcaccttcgatgagcttggagtcgcgggcagcggcaccaacacccatggagacgacgaccttctggacacgggcaacctgcatcgggttggagtacttgaactccttctcgagctcaggaatgatctgctcgttgtacttgaccttcaagcgcggggtggccggcgcttcgacagtagtatcggtcatgccagctcctttccggacttcttggcgacgcgcacgcgcacggtcttcaccttgccgtcacgcgcctcttccttaacggtgatgccaacgcgggtcggctgcttggtctccgggtcgatgaccatcacgttggagcgatggatcggagcctcagtggagacgatgccagcctgctggccctgctgcgttgcacgcacgtgcttcttgacgatctgcacgccttcgacgattagtcgatcgttggagagcacctgcttgacggtgccttccttgccgcggtccttgccgcggatgaccttgaccaggtcgccgctcttgatcttggctgccatgtcagatcacctccggggcgagggacacgatcttcatgaacttgtgctcgcgcagttcacgaccgaccggtccgaagatacgagtgcccttcggttcacggccggagccgagaatgacggcggcgttctcgtcgaacttgatgtaggaaccatccgcacggcgggattccttgacggtacggacgacaacggccttaaccacgtcgcccttcttgaccgacccgccaggaatggcgtccttgacggaggcgacgatcacgtcgccgatgccggcatagcgtcgcttcgatccgccgagcacgcggatggcgaggagttccttcgcacccgtgttgtcggcgacatgaagccgcgtttcctgctgaatcattgattctccttagccgagctggttctccccatttaccggggcatcgtggttgcccataatgccccggtaaatggcgagccttgccgaactttacttacttggcgcgctcgataatggattcgagacgccagcgcttggtcttgctcagaggccgagtttccataatactcacgaggtcgccaatgtgggcgtcgttgtgttcatcatgggccttgaccttgctggtggaacgaacgaccttgccgtacagcgggtgggtcgaacgctgctcgagctcgacggtaatcgtcttgtccatcttgtcggacacgacgtagccgcggcgaaccttacggaagttacgctcttcagccataatcacttctccttggattcggtagcggccggctcctggctgatgccaagctcacgctcgcgaagcacggtgtacatgcgggcgatgtcgctcttgacagccttgagacgggcggtgttctcgagctgaccggtggcgtgctggaagcgcaggttgaacagctcttccttggacttcttcaagaagccttcgatttccgcgttggtcttctcgttgagattcttgatggagtaatcagcggtaccgactgccatcagatatcaccaccttcacgtgcgataatgcggcacttcatcgggagcttgtcgatagcgcggcggagggcttccttagcgacgtcctcggacacaccaccgatttcgaacatcacgcgaccagggcgcacgttcgcaatccagaactccggggcacccttaccggaacccattcgggcaccgagcgggtgcttggtcagcggacgatccgggaagatcgtgatccacacgcggccaccacgcttgatgtagcgggtcatggcgatacgcgcggcttcgatctgacggttggtcacgtaggccggggcgagggactggatggcgaaatcaccgaagttgatctcgttgccgcccttggacatgccagaacgcacagggcggtgctgcttgcggtacttagtcctcttggggataagcattcttgctcactccttcgtttctgcagccggagcggcctcggcgggagcctcagccttgggggcttcggcggcctgcggggcggcggaacggttgccacggcgcgggcggcgatcgccaccacgacggcccggacggttgttctgctgagcctgctgctcttcgaactcggattcggtcatgtcgcccttgtagatccagaccttgacgccgatacggccgtacgtggtcttggcctcgaagaagccgtaatcgatgagggcgcggagggtctgcagcggaacgcggccctcacggtagaactcggaacggctcatttccgcaccgccgaggcggccggagagcttgatgcggatacccttggcaccggcgcgcatggcgtcctgctgggccttacgcatggcacgacggaaggtgacgcggttggtcagctgctcagcgatgccctgagcgacgagctgggcgtccagcgcggcgttcttgacttcgaagatgttgagctggacctgcttgccggtcagcttctcgagcttggcgcggacgcgctcagcctcggcgccacgacgaccgatcacgatgcccggacgggcggtgtgaatgtcgacgcgaacgcggtcgcgggtgcgctcgatgacgatgcgggacacgccagcgcgctcgaggtccttgctcatctccttgcggatctgatcatcctcaagcacgaagtcgcggtagcgttcgccggccttgttggagtcggagaaccacttggagcggtggttctcagtgatgcccagacggtagccaaacggattgatcttctgacccatctttagcgggctccttccttgttagccacgacgaccgtgatgtgggaggtgcgcttgttgatgcgagcagcgcggccctgggcacgagcgcggaagcgcttgagggtcacaccttcgtcaacgtaggtctccttgatgtacaggtcgttctcgcggaacggctcgccggccttgtcggccttcacacgagcgttggcgatggcgctctccagggtcttgcggaccggcagggccgcagcctgaggggcgaacttcaaaatggtgacggcttcggtcgccttcttgccgcggatgaggtcgaccatgcggcgagccttgcgcggcgtcacgcggacgtgacgagcgattgctttagcttccatgttctattccttatccttagcgacgggccttcttgtcgtccttcacgtgacccttgaaggtcttcgtgggggcgaactcacccagcttgtgaccaaccatggcctcggtgacgaacaccgggacatgcttgcgaccatcatgaacggcgaaggtgtgtccgatgaaatcaggggtgatcatcgaacgacgagaccacgtcttgatgacgttcttggtgcccttctcgttctgctcgtcgactttcttctgcaagtgggcgtcgacgaaggggcccttcttgatgctacgagtcatcttctcgatactcccttacttgcggttcttgccggacggacggcgacgaacaatcatcttgttcgaagccttcttcggacgacgagtacgaacctcgcccttgccccacggggagaccggcggcttaccaccgcgggtacgaccgccgtgcgggtggtcgaccgggttcatggactcaccacgggtgatcggacggcggccgatccagcgggcgcggccagccttgccgagctgaatgttggcgtggtcctcgttaccgacctcgccgacggtagcgcggcagcgcgcgtcgacgttgcggatttcgccggacggcatacgcagctgagcgtaggcgccatccttggcgacgagctgaacggcagcaccagcggaacgagcgatcttagcgccgcccagcgggcggagctcgatggcatgaaccacggtaccggtcgggatgttcttcagcggcaggttgttgcccggcttgatatcagcctgagcaccggtctcgatgacgtcgccctgcttgatgcccttcggcgcgatgatgtagcgcttctcgccatctgcgaagtgcaggagggcgatacgggcggagcggttcggatcgtactcgatctcggcaaccttggcgggcacgccgtccttgtcccaacgcttgaaatcgatgagacggtactgacgcttgtggccgccgccgcgatgacgggaggtgatacggccgtaagagttacgaccgccggtcttggacttcttgcgaaccagcgacttctcaggcgtagaacgagtcagctcggagaaatccgagacggacgcgttgcggcggcctgcggtcgtcggcttataaacgcggatagccataatgtagttcttcctttaacttttctcggctaaccttcagttaccaaagatgtcgatcgtctggccctcggcgacggtcacgatcgcacgcttctgggaagcgcgctggccgaaaccggtgcgagtgcgctgcttcttgccagcgcggttgagggtgttgacgttcgtcaccttgaccttgaagatctcttcgattgcctgcttgatctgcaccttgttcgcatccggagccaccacgaaggtgtactggccacggtcggaagcggcgtagctcttctcggagacgacgggcttaagaatcacgtcgtgagcgggcttgtgaatagcgaccatctaaatcaggcctccttcggctcggtcttggcagccacgaaagcctcgaaggcttccttggtgaagaccacgtactgcgaggtaatcacgtcgtacgtgttgagctgatcgacgaaaatcgggtgaacggtcgggatgttgcgcacggagagccactcgttgatgttgtcgcgagtgaagacgaccgtggtgaacttgtccgcggtaatcggggccagagcggcgacagcggccttggtggacggctcggtgataccgaactccaccacggcaacgcgaccggcgttggcgcgatcggacagggcgtagcgcagagctgcggccttcatcttcttgggggtgcgctgagagtagtcacgcggctgcgggccgaacacggtgccgccgtggtaccactgcggtgcacggatggagccctgacgagcacgaccggtgcccttctgcttccacggcttcttgccgccgccggaaaccatgccacgagtcttggtggcgtgggtgccctgacgagcagcagcgagctgagcggtgacaacctggtggatcagcgggatgtgagcctggacatcctcggcggaaacgccgaagagagcctcaggagcttcaacggtgccggtggcctggcccttggcgtcggtgacgttcagagtaacgtttgccatggtttatcaggctcccttcacagccgagcggacgagaacgatgccgcccttggggccaggaatggcgcccttgatggcgaggatgccgttctcgacatcagcggagacgacggtcaggttctgggtagtggcggtcacatgacccatgcggccggccatacgcttgcccttgagaatacggctcggagtggcgcatgcgcccacagaaccgggacggcgctcgttcttgtgagaaccgtgagtacggcggtaggacttgaagccccaacgcttgatggtaccggcgaagcccttacccttggtggtgccggtcacgtcgacctcagcaccctcttcgaacaggtcagcggccagttcctggccggcctcgaactgatcgacgtcgtcggtgcgcacctcgacgaggtggcgacgcggggtgacaccggccttagcaaagtggccagccagcggcttggtcaccttggtgggatcgatggcgccgtagccgagctggacagccttgtagccgtcagattcctcggtcttcacagcggtcaccacgttggtggacacgtcgacaagagtgacgggcacgaagaagccgttctcgtcccacacctgggacatgccgagcttcttgcccagcagagccttgcgattagacataatgcttcctcctcccttacagcttgatttcgatgttgacgtccgcaggcagatcgatgtgcatcagggagtccacggccttgggggtcgggtccacgatgtcgatgaggcgcttgtgagtgcgcatctcgaagtgctcgcgagaatccttgtacttgtgaggagaacggataacacagaagacgttcttctcggtcggcagcggaacggggccaacaacagttgcgcccgcgttcgtcaccgtttcgacgatcttcttcgccgattggtcgatgacctcgtggtcataggacttaagcctgatgcggattttctgtcccgccattgccgtccgccctttctagcgatgttcgttgtactgtttaccaacctgcttctagggcaccggcgcgcatggcctcccttggacatacgtcctctggcggtcatccgacatcagtgcgcggtttccggctgtcacttcacttgaagtggctcccggcccgcgctcgcttttttaattccaatttgcgagcccaaatcaggcaacttgtttattcaagcattgaggtgggacagtggagttcgcgcgtgtcgcgctcatgccgttcgtattacctcgcggcatagccgctcggcgtctgttcgattgtcgcaatgcaggtctcacatctttcttattgagaaccattcgctgcgatatcatgacagatatgacttcccgccgcaagactcttaaacgcgattggttcgacaaccaacctggcgcatgggtaatggttatgctgcccgctgtggctggcttctttatcggcgggcctaatcttgatacgctttggctattggcgacgtgggccgtgtgctattgcgtgcagttcagcgccgcgcactggttcaaagcacacttttcacgccgttatctgccgccgatgctcacttatgccgtagcgctcatcgtcatcggcttgccattcctgattacgcataccggcatactgcgttgggctcccttatatatagtgctggttgcgctgtcgatgctgtcctcgtggctgaggaaggagcgctcgctgtggggcaatgccgtgtcggtgattgccgcgtcggccatggccacggtgatcgcgtcgtttggcagcactgttgagacggcatgtgttatgcccatcaacgcagcacatgcctcgtgcgcagccgctgatgtcaccgccgcacgcaccgcgattcggaatatgccagatttgagccagatattcgaccttcacgcctggtggcccgcgggttcattgcccgtgagcgggctgattgccaccgtgctgtttgcgctgacgcagtatgggtcggttttggtggtcaaaaccatgatccgggaacgcgggaagtgttcatacgtggcggcttcgtgggtatggcatgtggcgctattgctgctagccgccgtgccgtctggacgcagtccgtatctgattgcgatgactgtgctgctgttggcccgcgccgttgcgttgccggtggttacacggcgcacaaccttgaagcccgtggtgaccggcattaccgaggcgtttgccagctttattgcttttggctgcattattgcggcgatttagcgacgcttcagcgattccatggggtggtaattacctcatggggcggtaattggcccatggggcggacggtaaaattttaccttccgcagaatagagccgttttcgtacaccgccccatgggggttttcaccgccccatgggcaagttaccgccccatgagtgggttaccaccccatggaggtgtacctgctggctgagggagcaccacatatgcaaaggagcccggcccctgtaatggggtcgggctccttgtgtcgcgctatgcagccactaagctgcaacaccgcggttggtggctactgatggtgccaccaaccacaaaccgcctgcaatcaacgctcggaggcttcctcagtggcggcctcaccctcgcgctcgatgcgcagcttgtggccttccgcctgggagacaccgtagtaagcaccgacggcgatgtccttcatgtcgttgatcagcgggatgcgcgggttggccggggtacactggtcctcgtaggcgcgcatgccgatctgatcgagcacggaccagaagtagtcctcgtccacaccgcaatcctggaagctcttgttcatgccgagcttgttgtcacggtagtcctcgacggccttcgccaggttctccacggcttcggccggggtcttgccggtgtcgatgccgaggttgcgggcgatatcctggtagcgttccggggcgatgtacttgttgtacttcggccaagaagtgggctcctcaggaatctggccgttgtaacgaatcacgtacggcagcaggatggagttggtacggccgtgggcgatgtggcacagggcaccgatggtgtgggccatgccgtggcacatgccgaggaacgcggagccgaatgccatgccggccatggtggcggcgttgtgcatcttctcctgagcgttggtcttggccaggccgggctcgccattgacggactcagccaggttgtcccagatgagcttggccgcgtgcagggccatgccgtcggtgaagtcgttcgcgtacacggacacgtaggcttccatcgagtgggtcagggcgtcgaagccggcgtcggaggccagcttgcgcggctgggtgcgagccagcaccgggtccacgatggccacggacggggtcagcgcgtagtcggtgatcgggtacttgtagccggtcttgtgatcggtgatcacggcgaacggggtgacctcggaaccggtgccggaggaggtcgggatgcacaccagcttggccttcttgcccagcggcgggatcttgaaggcgcgcttacggatatcgaagaacttctcgcgcacgtcggagaaggcgatttccgggtgctcgtagagcagccacataatcttggaggcatccatcggggagccgccgccaaccgcgatgatcgtgtccggctcgaactcctcgcgcatcatctcagcgcccttttcgacggtctcgacggagggctccggctcgacgtagtcgatgatgcggaaggtcacacggttggagcgggcgcgcagctggtcgatgatcttgtcaacaatgccgagctgctccatgaccttatcgcacacgatgacggccttctcgatgccgtacatgtcgcgcaggtacttgatggcgttcggctcgaagtaggtcttggccgggatcttgaaccactgcatgttgttgttcctccgagcaatgcgcttgatgttaacgagattcacggcctgcacgttgccggacaccgagttgccgccgtaggagccgcagcccagggtcagcgacggggcgatggcgttgtagatgtcgccgatgccgccaagggaggaaggctggttccagatgatgcggcaggcgtgcatacggacgccgtactcacgcacgagctcctggttgttggtgtggatggcggcggtgtggccggcacccagcttgagcatcttctcgcacatctcgaaggcctgctccttgttgtcggccttgagcacggcctgcaccggagcgagcttctcgtgggtcagaggctcgtcgtcggagacttccttgcactcggcggccagaatggtggcgtcggacggaatctcgaagccagcagccttggcgatgaactgcggggacttgcctggcaccgcggagttcagcacgggcttgacgccggaaccggcagtgcagccgaacatgtactgttccagcttggccttctcttcggcgttgacgaagtaggccttacggaccttgagctccttgatgagctggtcgtagacgtccttgtgggcgatgatggcctgctcggtggcgcagatcatgccgtaatcgaagtgcttggagagcaccagatcgttggcggcgcgcacgatgtcaacatcggtgtcaacgtaggccggggcgttgccggcacccacgccgagggcgggcttgccggaggagtaagcggccttgaccatgcccggaccaccggtggcgaggatcgtggccacgcccggatgcttcatcagggcgcctgtggcctggatggacgggtgctcgatccactggatacagttctcgggagcaccggcttcgatggcggcgtcgcgcacaatcttggcggcctcgacggagcacttctgcgcgccggggtggaagccgaagacgatcgggcaacgggtcttcagggcgatgagggacttgaagatggcggtggaggtcgggttggtgaccggggtgacgccggcgaccacgccgacgggctcggcgacctcatcgatgcccatcacatcgtcttcgcggatgatgccgacggtcttctggccggccaagtagttggtgacgtgctcgcaggcgaagatgttcttggtggccttgtcttccacgagaccacggccggtctcgtcgacagccatcttggcgagaacgaggtgcttgttcagagcggcgatggaggccttggcgacgatacgatcaacttgcttctggtcgaggttctcgaattcgacgagagccttcttggcgcgggcaaccagcgcgtcaacttcggcctcagctgcggcctgcttctcttctggagtcggcttggtagcttcgaccttcttctttgcttctgccacttggggtcctcctcgatcttcttggggtatatggcaaagttctgggccatcgcctcgtcacctcagttgcaccagcgggataccgcctcagtaaccgaaaatgaccggtgatgcgttgtcacattgcatatgtgacctgaggcacaatatactgaacggtccggcgcgacgcatacgcacaaaatcgacggcgtttcacgtgcgatattgaacagtttttgttacgagttgtgcgaaatatcgaacaaatcctcactctatccggcgatttggtactttttgttcactttttaccgaaaatcacatgcctgcaaacaacacaatccgagaacttttttaaagtaagttttcaaaagcaatcattttctccacatttctagaaagttggtttaaaaaagtacccaaaatcgcctacaaatatacgattgttgcctcataacctccgcgtcgaggcacatgaaagccactttcataaagtaaacttgcatatatctcatcgcacaaaggggtaaacatgagggcaatgccatcgaccgcagtgaaagcgcacaaccgcagtgccatggcccagtatctgtatggccatagccatgtcaccaagcaggaactggaacgcgaactcggcctcagcctgcccaccatcacccaaaatctacacgcactagaagatgacggactcatccgcaaaggcgaactgcaggattccaccggcgggcgcaaggcgcaaaattatgagttcaatcccgatcatcgcactgccatcggggtagtgatgcggtccaacgaactgcgcctgtgcgcgattaacctgtacggcaacgtcatcgaaaaacgcaacgatgccctgccttaccgcaacaccaacgtttactaccagcgtatcggcggcatcatcaacaacttcgccgccgacgtcgaaaagaagcacggcaaggtgctcggcgtctcgttcgccatccaaggcatcctctcccccgacgccaccaccatcatcttcggcaccattatgggcaacactgggctcacgctcgaaaccatcagccaatcggtccattacccgtgcatgatgatccacgattccgatgcctcagccatggccgaactctggttcgactccacgctcaccgatgcggtgtgcgtctatctggagcgacgcccgggcggcgcggtgatcgcggggggcaaactgtatcaaggcccgaaccagtgcaacggcgccatcgaacacatgacgctggtgccgggcggccgcgaatgctactgcggccagcgcggttgcatggacacctactgctcgccggagaccttgcccgaggattacgaaagcattcccggcttcttcagcgtgcttgagcagggcgaacggcatcatcgcgagcgcatggatgagtggctggattacgtggcgcaggccatcgtcaacgcgcgatccatcatcgcgggcgacgtgattgtcggcggtgaagcagcccagcatcttgaagacagcgacatcgaggatctgaagacgcgcgtcatcgcacgcagcccgttcggcaccgaccatttcaatctgcgcaagagctactgcgccgaagatcagaacatcatcggtgccgcgttgcggttcgccgagaattatctcgacggcatctgcggtgctgcggaacgcggcaggaaatcaagggcttccaccaaaagtgacaacacgtctacaatggaggtatgaaaaacccaccgttgcatcgttacgccactcgcccagggctgtacttcactgacgacggtggggctgacgtcgttgttcgttccgaaactgccgatcaggtttggctgtgtgtactggagcccattgatgagcccagcgctttcttccaagacgccatccgcctgttcgaggacccgaatatctcctttatccagcagattcatgagttcccggtatgcacacgcattatcgaacatttgtatctgcgcgagaccttgttccgcatgaccgggccgaactacggcctgtggtacgtgcacctgcccaaagcatgggacggcatgcgttatggctaccgcgtggacggcgcatgggacccgaaacacggcgtgcgcttcaatccatacaaattcctgcttgacccgtatggcaagggcatcgacggctccatggagctcacccccgccgccttctcctatgaatgcgatgtcgtggaccgcaaggtaatcggctcggcatacggtgccatgagcaccgtagactcgctcggccatatgccggtgtccgtggccatcgacgatcgcgatacccataagcatgagggcgacccgcagcacccgcatgtgccgtggcgcaaaaccgtcatctatgagatgcacgtcaaaggcttcaccgccaacgcaccgtggctgcccgaatcattgcgcggcacgtacgccggactcgcacaccccaccacgctcgcctatctgcagggtctaggcatcacatccatcgaactgctgccgattatggccaagcaggacgagctcttcctgcaagaacacagccgcaagaactactggggctactccaccctcagctacttcgcccccgaaccctcctacgccactaaagccgcccaggagaagggcgcggccgccgtgcgccaagaagtcatagacatggtgcgcgcactgcacgaggccggcttcgaagtcatcatggacgtggtctacaaccacacatgcgaaggcggcgtcgaaggcccgacggtctgctggcgcggcctcgacgacctggcctactatcgccatcaaaaatccaataccggccgactcgaagacaccaccggttgcggcaatacgctggacttcaccaacacgcatgtggtcacctttgccatcgactcattacgatactgggccaagcgtatcggcatagacggtttccgcttcgaccttggcgtcacgctggcccgcctggaaggcgaattcacccatcatcacccgttcctctacgccctgcgttccgatctgctgctgggcaacctgaagctcattatggagccgtgggatctgggcaacctcggctggcgcaccggccaattctccgtgccgttcgccgaatggaatgaccgcttccgcgatacggcccgcaccttctggcttgaggatgtggacggcggctccgatttcgggcgtatcagtttgcaggagatgtccacgcgactctgcggctcggccgatctgttcgccaccgaaccagggcgtggcgctccggcctccatcaatttcgtgtcctgccacgacggtttcacgctgacggacctcaccagataccgctccaagcacaatgaagccaacggcgaaaacaataatgatggctcgtcggtgaaccattccgccaatttcggcgtcgaaggcgtcaccgatgatccagacgtcattgcggcacgcgaacaggcggccatgaacatgatcggcatgctgctgctctcgctgggtacgccgatgatgctcgccggcgacgaattccgcaacacgcaggacggcaacaacaacgcctactgccaagacaacgacatcacgtggctgaagtgggattggatgtattccaccaacaagacgcgcgaaatgcgccgcttggaaaccgtgtctcgactggtggcgctgcgtaaatcactggacctgtatcaccacgaggatttcttcacccgactgacccagatcggcctactcaagccctcaagccgcgtgcagtggttcctgcccgacggtaccacgccgatggagcgtgactggttcgatctgggcgtacgtagcttcaccatgcgattgctgtccaacagtgaggtggacgtgtgcattgtggtcaacggcaccgctgacgaccgcacattccgcctgccgccagacacccactggacgcctaaatggtgctcggccgaaatcaacggccgccgagccgggcatggcactcaggtcgaggaatgcgatttgaacggtgacaccaccgtctggacgcagcatgtaccggacgccagcgagacagtactcaagatggtcgaagaagtggccatgcagcgtacggaatcctcgactgagaatgaagcggataccatcaaattcgcgatgccagtaacagatcacgccgcaaacggcacctcgtccgcgcctcgggatgaggtatcagctgatatgcccgatgcccctgtggatgatacaccggacactcccgtcgacgacaatgtctggaccatgccggcgctgagcatcacgctgatgaagcaggtgtgagtcacactcaagacatcgcgacacaaacacaaaggctctccgcggaattccgcggagagcctttgtatgctcggtacaggacaagcgaaattaacgcttggagaactgcggggcgcgacgtgccttgtgcagaccagccttcttgcgctccacgacgcgagcgtcgcgggtcaggaagccagccttcttcagggcggcgcggttggcatcacgatcgatggcgttcagagcgcgggcaacgccgaggcggatggcgccggcctggccggtggtgccgccgccgtcaacgaggacgatagcgtcgaacttgccttcgagcttgagcagaacgatcggggagttgacctcacgctgcagcagcttggaggggaagtactcctccagagtgcggccgttgatggtccacttgccgtcacccggaaccagacggacacgggcgacagcctccttgcggcgaccggtgccgtagcccggctcaatcgcggaggtgccggtgccagcgccagcgttggtctcggtggtgtagttggtgagctcctcttcggtctcgacaacctgggagtcgttggtgttttcagccatgattcttatctcctctcaggtttcacttggcctgctgcgagacctgggcgatctcgaagacctggggcttctgcggggtgtgcgggtgctcggcgccacggaagatacgcaggcggtcgagctgcaccttggccagacgattcttcggcagcatgcccttgacagcgttcttgatgatgcgctcggggttcttctcgagcagctcggcgtaggagtcacgacgcagaccaccaggacggccggagtgcgagtagagttccttgcccatcttgttgccagtcagagcaatcttgtcggcattgatgatgatcacgtggttgccggaatcggcgtgcggagcgtaggtcggcttgttcttgccgcgcagcaggattgcagcctgggtggcgagacggccgagcaccacgtcggtggcgtcgatgacgtaccagtcatgagtcagatcagctggcttcggagtgaaagttttcactggattaccttttctatattgtgttccgggtctcagctgcttggtgtggcttggtcagggccgcatccaagaggcgtcgaacctcattatccgtgggctccctgaaagtcctcgatggcgagtgggatagcgctttgaaggaccccttagggaaacacaacaatccactagtatatcgccgggcttgacatagggcaactggggacactccattgggtttatggcttctcttcccctatttatggtttctctcccacccacttcggctaaccgactcacctacggtgaggcaattccctgccttctctcagctatcgcttctttcaggcctcgtctacggacagtccactggactgtccgcttaacgactcggctcgtcagagggaggtaaagcgggtcaggaattgaagatttgggcgaagcgttgggcaccgggggtgtcgaagagggtttcgagcggtaccacgttgcccttggcgtcggccagtgggatgcgccagttcgggtattcgttgttggtgcccggctggttctgcgcacgcttctcccccaccgcgtcggtgatcgaggcggcgagcagcttgcacggcgaacccttcagtgcgtggtacagcgcgtcgacgatatccgcctcgtgatcctcacgatgttcggcaaagtcggcatcaagataaccctgctcgaccagcatggccagcatcgcatcctgctcggccttggcggaggcttcgaattcctcggccgggccggtcagcaagcccagacgctcacgaatcttgacgtgctcgtattccaggtaaccggcggccggcggcaaatcatgcgtattcacggaggccaatgcatacggacgccactgggagggggcgcggaacacgccgtcgcactgctcgaaccattcaacggcgcaaccgagaataccgtggctcgacagggaatcggccacatggtccggcaccacgccgaggtcctcacctacgaccacgccgccggcgcgagaggcctcgatggccagaacgcccagcatgatgtctgagtcgtagtacacgtaagcgccatccatagccgaacggttctcgggaatccaccacaggcggaacagaccaaggatgtgatcgatgcgcaccgcaccggcacgggcgaacatgccatgcaccatattgcggtaggcctcgtagccggtggtctccagattgatcgggctcagcggcggctggctccagttctggccttgctggttgaacatgtccggcggtgcgccgaccgtggctcccttggcgaagcgctcgggattccaccacacgtcagcgccggaggggtgcacgccgacggccatatcggacatgatgccgatatgcatgccggcgtccttggctgcctgttgggcggaggacagctgctcggcggcaatccattccagccagcggtagaagtccaaagtgtccgggtactgcttgcgcagattggcgatttccggggagttgcgattgaacttgcgctcccagttgctctcctcgccgttgggcgccccccacttgtcgtagcacaggcaccacgtggcatacgcctccaagtcggaaccacagtccgccttgaattggtcgaatacgctttggcgttcggcggtacggccggccttgaagataatccacagggcgtgcatcttgctgcgccacatggcgtcacggtcgatgagctgggaatcaccgttcagcggttcggtgtcggcatgcagtccgtcgacggcattcttgtcgccctcgctgagcgtggcatattcggcgatcgcctcaggacggatgtacgtgaagttgatcaggcgacggcttaccggcagatacggcgacggggtgagcggggacaccggctcggcggcatgcaccggattaatgagcacgaagtcggcaccggtcttctgcttggcgtccaccagcatggtcttcagatcctcgtaatcgcccacgccccaggagttggaggagcgaatcgagtacagctgggccatccagccccacagactgccgcccttcatcgggtcaagcagatcgacgcgatcaggtgcactgatcaaagtggcgtcttgcacacggtcggcgaccttgacgtgcagcgtatggtaaccaatcggcagatcggcgggaatgaccacagccgcattcgaaatgaacgtaccatccaagtcgtaggcctgggatccatctccaggaccaacttcaatggtgccttgatatggctcgccattctccagcgtgatgctcgccgaaggcacgtccagaataccggtgttcaccagcacccggtcctcgctaccggcgatatgcagcacggtgggtgccaccaatcgggcgtaacgctcgttcagaatgcgtcggatggcgatgagttgggcgctctcgctggaggcgtcgatgcccagcgctgccagcacctcgatcaggacgtcatcgtctatctcgtggtagtcatggctcatgcccaaataactcgtgccgacaccgaccaacttggccagtcgaatcaacggacgggccagacgctcttcactctcggtaatctcactcatagccccagtctaacgccgtttgattgcgccacaccgtaagaaaaatgccatgattccgccaaattatgtactttttaccctcacatagtgagatgtgagcgctcacaatggtggacagggggtgattgccggccaaatttgcgcggcaaaacacagcaatagtgtgcttagcggcggctttccacggcgtgccgcacctcagccgaggggtcgttggccaatttggcaagcatcgcttcggacgtattggggttcagtgccacggcacggcggaccatcgaagaaagcaccgccggtgctccctcttcggattcggtgccaagtacgcccaagaaatccaatgtctccgcatccgcagtggggtcctgcgcaccctcaagccgcatcttccagctggtgcgcttgtttttcaacgccgtatcccggaccgcaggcaccgggtccttggtcagacggccgaccagccaattcttgtcgtccccgttggcggccacggcttgacgcacggacggttcggggtcttcggagagtttgaccaatacgttcgggaacggcatggtgtcggcgaggaacacacgatcggccaccggggtgtgcgggttgccggccacagcctccaaaagtgcggtggcgcgggagaacgccgcctgatcggcacggtcaggcaacggccgacgggcgaattcggacagttcggccgggtcggtggaatggcgcagacgctcgtatgtagcggtcagcggttcgaaatccaccggagctgcggactcggctgcggactgcgcgccttggtcctgctgctgggcgtccgtgtcggttgcagtctcggccgcggcctcggttgcggcctcggtgggctgggtctgctggctggtggtgttctcgtcggtcatgatgcccagcttagtcatacaggcgtcacgcgagcggaaccggaatgttgaccatgtcaatcggagccggcaccacagcggcattgaacgcttcccgcacacgctcctcgaatcgcgcgcaatcatcctgcggcaccaccgcggtcaactcgacgttcaccgcatacgattcatcctcctgactgccaccaagctgcgccaggatctgctggaatcgggccaactgcgggtattcgaggcgaacccggtatcgcttggcggtcatgatgcgggcggcgcgggcggctttcatcgccaatgatgcggcggatgagtacgcgcggaccagcccaccggagcccagcagaataccaccgaaatatctggtgacggcaaccacgcaatcggtggtgcccgactgcttgagtacgtcgagaatcggcttgccggcggtaccggacggctcgccgtcatcgctcatgcgttcggacagtcgcccatccgcgcctccgcacacggcggcatacgccacgtgtcgggctttcggatgctgctcacggatcgcagccacgaacgcgagcgcctcgtcgagcgtatcgacatgggcggcgtcgccgataaattcggactttttttcgacgagcgaatcgtgggcaggatcgtcgggcgtgttgagaatcgtctgcatgagcgtgttccggtggtcgactggctgggtgttcgattgagcgcgaggctaggcagggctatcagcgttcggagacgacgacgttatagtcttcgccggcgaagtaggcggtcaggcaggcgatcatctggcgggtgagctccttgaacgcgccgtcggcacgccagccgacgtgcggggtcaggacgatgccgggcacatggcagatggcgtcgtcggcggtcagcggctcatggtcgaacacgtcgagtgcggcgggaacatcgcccttttgcagtcgggcaagcagcgcaccggattcgatgacttcggagcgggcggtgttgatgaacagggtgccgggcttcacatgcgcaaggttctcggcggtgacgatgccgcgcgtggcgttgttcagcggcagatggacggagatgacgtcgctggtttcgatgagcttgttgagatcgtcgaccggagtggcaccggagcgttcgaaatgctcgggcggcacatgcgaattccatgcggcgacctccatgccgagggcgcgggcgatgccggccacggtggagccgatgccgcccagtccgatgatgcccatgcgacggccggcgagttgcagtccatcgccgctggtccacgcccagttgccggccttgacgtccttatcgagttggccaacgcggcggatgagctcgaacagaagggcgaaggtgtgctcggccacggcgtgatcgccataatgttcggcgttgcagacgcggatcttcagctcgcgcgccttatcgagattgaggtagctggcgacgccggtaccgcagaacacgatgcacttgacgtgcccctgcccgctgatggtgcgcagcagatcgtccgaaatgtggtagccgcccaccagcagggcgtcggcatccttcagacgctcggctatggtcgcctcgtcggacgtgaattcctcgaacatacgcacgcgggcaacgtcgtggagcgcggggaactgggccttgatgggctcgatcatcgagtcaagcacggacggcatcacgacgaggggcagatcggtgcgttcgctttgggtttcgtaaatctcggtcatgggctccacattaggaggccggcgggaaaagcgtcaccttgcggcttcccctccttgagaccaagccgagcaactattgctttgccgcctgctcctgcgtgatgttccattccttgacgacgttctggtccgcgcccatcgaatagatgacatcccagatgcgttggcgtatctgagcgtcgtaggcttcgtcccaacatgtgcctatgggatggtcgctggatatcgggcaccattggtagttgccttgatgcacgttggcggtgggcacccaatcgatgcggttgacgcgccacgaccccttgacgcccttcttgccggcgaactggatgcgtgcggtcacaccctgattgttgaccaaggtttccggcgtgttcgccgactcggtgacggcgttgcccagaccgtagataatccacgtgccgttatagttctcgatgggctgcgcacaatggcaaccggcaccgtaaataacgtcgaaggcaccagtgtcggcaagctcatgggcttccgaaatctgccaggaatcggcgtaatcaaggtattcctgcaccgagtgcatggcgatggccaccacatcggcaccttgctcgcgggccttgttggccttgtctaccgcgcgctggatgtcgctgtcgtgattcgggtcgccgtcttcgcgcagacgatccacctgccagtcctcgtcggcggtcatgccgttgagggagaccgtgccggtgaccagacccagcttgccgccgccggtcggggaatcgatgaccaacggtttggtggagtcggcttcggttttgtacgagccggtctgggcgatgccattggcctcaagcgtgccccacagacgggcgatgccatccgccccctgatcccaggaatggttggtggcgtgtgtgcaggcgttgtatcccacgttgcgggcggcatccgccacttccggcggaatgttgaagatcgggtacgcggcatatgggccgccgcgctgggcgatcggggtttcgaattcgcacacggcgatgtccgaagcctgaatgtactgcttcatcggcgcgaacagcgggtcgaagttgaaggcggtgccatccgtggcgttggggttcgggccttggaaatggctccacaatccctcatggaacaacaaatcgccgttaaccagcatggcgatgcagtccgtatccgggcaatccggtgaattgccgtgatgttcggtcaccggtttgggcgtgttcttcgctttattcaacgcgacgtccgacactccggcgtgtgcggggccattgccgtccgtgcgatgggttgcgaaccatgcgccgatgcccagcgcaacggcgagcacgatcacgaacacgataatcagcgccgcacggttggttcgtgtcgagttggagcgatgttgcccctgcccagcgatatggctcatctttgcccgcccttcggaactcttcttctctctctagggtaccgcccatctcggtcaagtactgcggggagggaggcgatgggcaagcgattggacaagcaatatataaaccggttaatcttcaatcaccattcacgaacaccacgcaaaagtctcacttagtggacatttttctttcgtcgctcggacttttcccgacgtgccgcactcgttcgcccactaaaatggcggtttggaggcggacggacaatggcgtacctccgactccgcttaccacaagcggagaccgcccgtcctcggttatttcaggagttacttaacccggagtttccggaaaacaaaaaagttccgagctttcacccggaaccttaatcggcggagtcagagggattcgaaccctcgagccgtttacacgactaacaccttagcagggtgcccctatcggccactcaggcatgactccacgttacgcaataatgcgcaacagcaaattactgtaccacgtcctgcggatacggcgtgccgaacgacacattattgaacgtccgcgggtgcggcgtcgccggagaacgtaacgataaccgcgcaaatcaccaacgccacaccgacgatttcaccaacgctgggaatctcgccgaacgccagtcccacggccaccgccatggcgggattgatggattgcattaccgaaaatgcgccggatgtggtgcgtcgcagcgtgatctgctccaccacatagggaatgaacgaggccatcagggaaatcacaaacagcagagccagcagcttcagcgagccgccgggctcaagcgcccacgtggcatcggccttggggtgaaccacatgagccacagccggcacgccaaggaacagggactggaccagccagccgatggtcacggcgatgcacagattatccagcgaattgccgccagccgccacgcgccggccggtgatgatatacatgccccacatcgacccgccgatcaaaatcgcaatcagaccatacaaaaacgtgccattgccggacggattggccaatgatatgccagctaacagcaccacaccgaccgccgcgataccgataccgacccgctcgcgccagcttttgccggtaatcaccgccaccgaaagcggtcccaaaaattcgatagacacggcaatgcccatatccatattgctgatggccacataaaacagggtattcatcagcaccagcgagcagccgagcagtacgaccagcccccagctgcgggcgtcgcggtgaaacagttgcgctcgcttcgccttgttccagggcctgcgccacagcagcaacagcaccgccatgaatcccacgcgataccacaccgagtacagcggatcgagctgggtgaacgcaagtttggcgacggccgtagccaaataaatcaccagtgcctcaccaatcacgataagaaccacgggaacacggttgaggataccgaccactgccttcttcatgaggtttacgctactcggagagccgggacagcgcgcattgacttggaaggcgttacggacagtgacgcaatgtggacgattccgtggaatcgcacccaccatgcgaaacagccgcacagtgcgtaaacccttggaattccggcgatattcggcattatgacaatgagcgccgcgtcatgcgcgccacatagtgagcatgacctcgttcggcattcctacaatggtggcatgagcaccgcaccgagacttgaggccgccaaacgcgattggggccacgacgagaccggatgcaccgtgctgcatatcgacatggatgccttctatgcctcattggaggtggcgcgcaaccccgggctcaaaggcaagccggtaatcatcggcaccgggccgcgcgcggtggtgtccgccgcgagctacgaagcccggaaatacggcatcaattcggcgatgccggccgcgcgcgcccatcggttgtgcccgaacggcatttttctgccagtggatatggcgtattaccgcatgatgtcgcaccgaatcatgcatgaggtgtttttgaccgtcaccgaccggttcgagcaggtttcggtggacgagggctatatggatgtgtccgccgcactgctggagtgggggcggccgagcgcgatcggcgcgtggattcgcgctcaggtggccgagcgcttccacgtgacgtgttcagtgggtatcgcctgtaacaaactggtgtccaaaatggcctcgaccaatgccaagccggacggcatgctgctgattcccgcggcccgctcggccgaattcgtgcagatgatgccattgcgtggtattccgggaatcgggccgtctttggagaagcggcttaatgcttggggcgtgcattcggtggctgaattggctcagctggatgaggctgcattgactcgtgccactggctccccggctgcggcacgtggattatgggcggcctcgcacgggttggattcccgcgaaattaccacggtacgcgaggagaaatccattgggtccgaggaaaccttggccgaggatacacgcgatatgcgcgtggtgtgtgggctactgcgttcggcctgcgacgaagtaaccagcacgctgcggcgcaaggggctggtggcgcgcacgctgacggtgaagttgcggttcgccgacctgagctatcagacccggtcttttacgatggagcggccgaccgatacggccggcgtgctgtacccggaatgcgtgcggcagctgaaagtcatgctggggctaccggcctcggcggagtctgccactcccctgcccaaaactattcgcttggccggtatgagcacgtcttcgctcagtaaggcggcggctacggccgtgcagccttcactggatgacatgctcgaagaggccgacaatgcccgcggccagacctcacaggcgcgtttgcatgatgccgaggccgcactggacgctgtgcgccgcaaattcggcaacaaggccgcccagtttggggcgtgaacggctcaacgccacttacgatctcattacgccgtgagacgttcgcaggcggaacggatggcctcgtcggtggcggtggcggagaaacgcaggtaggcgggagcgccgtagaattcgccggggctggggatgatgccgatcttggcgagctcggccatatcggcccagcagtcgccggacttggccttgacccatacgtacagcgcgccggagggcatttgtgccgaatagccatatgccttcagtgcgtcaaccagcgcggataggcggcgacggtaacgcctccattgctcgtgcacagcggctgtgtccttcaggcctgcggccatggcggcctgcactgggccagggataatctggccgatctgcttgcggtattcggccatttccttgaccagccggtaatcgccggcaattagagccgtacggtagccggccatgttggactgcttggacagcgagtagagcaccaggatgccagctgccgaaccttcacacacatgtggattcagggcacatggcgtggcggagagactgaatgcggtatcggaggcgggctcgttggattcggccaccggtgcggcaggcacagacgcagcagatgcagacgcggcaggcgcagaggacgcggctgtattgcggcgcaccgaacgccagtccattaacgcatagcattcgtcggagagcaccacggcaccgatgcgacgggcagcagccacgatgtcggtcagccagtcagcggagatgacctcgccggagggattacacggcgagttgatccagatggccttgacgttcggaatattcacccaggaatcgacgtcggtcacatcatcgactttgaccacggtggcgccggcaagttgggtaccgatttcgtaagtcgggtaggagacagccggttggacgaccacatcgccttcgccaaggtgcagcaggctggccatcagcgccacggcctccttggaacccacggtgggtacggcggcagcgttgatggatttcagatccaccccgcgcagttcgcggaaccatgtatcgatagcggccttaaggtcggcggtgccggcggtgaccgggtatccatgggcgttgggggcgtctgcgccggcaaccagcgcctgctggacactgctcggcaccgggtccacaggcgagcctacggacaggtcgatcatgccacccggcacggttttggcggtggctttgaagccggcgatacgagaccagtcgtatggcgacgaatatgcgtggaagcccatgagaacccctttcttggacggtatgttcctaagatacgacgaaccctcggccgtgatagaccgagggttcaatccgaactatgcgctgtgtgcagcgcttatccgcaaatcagcttactggttctgcggcggcagcgcggcgacctgttccgggtctttgccgattggaccattggcggaagcgccgcccaaatcgccgacttcagcgaagaagttgacagcggcatccttgtaccaagcccactcgtccggcagatcatcctcatagaagatggcctcggtgggacacaccggttcgcatgcaccgcagtcgacgcactcgttggggttgatgtacagcgagcgggaaccctcgtaaatgcagtcgacggggcactcgtccacgcaagccttgtccttgacatccacgcaaggctgagcgattacatatggcatggaatcctccttaacaaatactgatacaagggtacgcgcctgttgggacgctcctcgctctcagccgttaacggccttatcggtttcggcggacagcgtttcggtcaggtcgcccttgccgaggcgcgcatgccagtagccgtagccgaagtagatggcgaagccgaccacgagccacaccacgaaacgaatccaggtgagcacggacaggttgagcatcaaccagaagttggccacggcgatgaggatcggaatccacgggctgccgggcatcttgaaggcgcgcggcaggtcggggcgcttcttgcgcataatcgggatggagatggccaccagcgtgaaggcggacagggtgccgatgttgaccatgtcggagagcacgccgatgtcgaagaaggcggccacgagcgccaccaccgcgccgacgacgatctgcagagcggccggagtgccatgcttgccggtcttggacaggccgcgcggcagcagaccatcgcggctcatggcgaagacgatacgggtcaggccgagcaacagcaccataaccacggtggccaggcccagcacgatgccgaagctgatgatcttggcggcccagtcggcgcccaccagttcgaaggcggtggccagcgaggggctgtcttgcttggcgagatcggcataggagaccatgccggtggtcaccacggccacgagcatgtacatgacaatgatgagcagcatgcccacgccgatgccgagcggcacgttcttgtgcgggttcttggtctcctcagaggcggtggccaccacgtcgaatccgatgaacgcgaagaacacgagcgccgcgcccgagaggatgccaggaacgccgtacacggatggggtcatgccggtggcgaactgccacaacggctgggtcatcacgccggtgacggcggaggagccttccacggtggaggccggctggctcggcggaatgaacggggtgaagttggaggccttgacgtagaagaagccgacgatcaccacaaagaacacgatggcgatcttgagcacggtcatagcaccgtccacgcgggcgccgatcttggtgccgaatacgagcagcgtggtaaagaacgccacgatgataatcggggcgatatcgatgtggaaggagccgaacgtcaggttggtgttggcgttccagcccatcaggcgcatgaaatcgttgaggtatacgccccaatatttggaaatcacggagccggccatcagcatttccaggatcagatcccagccgatgatccaggccatgatctcgccgaccgtggtgtaggtgaaggtgtaggcggagccggccaccggaatcatcgaagcgaattcggcgtagcacatcacggctgcgccgcacacgatgccggcgatcaggaagctgatgatcacggccgggccggcgtggaaggcggcggcctgcgcgcccaccgagaagatgccggcgcccacggctacggccacacccatgattgacagatcccaccaagtcaggttgcgcttgagcttgcggccctcttcaccggtttcggcaatggtctgttcgacggatttcgtacggaacagttgcatagtgctcttcttttttctctgttgtttgcgcaccaaatgcgcacaataccgacaatcgagtatagaagagcccgcgtgtcttgtctattaataagacttagagtccgcaatatatgggattaataacccgctccatcaatcaatagcgcgattacagcacaccgacgcagaccggttcgggcaccaagtccactccgaacgcgctcttgactgcctgctgaaccgcgcgcgccaaagctgcgatatcggccgcgctcgctcccccacgattggtcaaagccagcgtgtgttgcgtggatagactggccggcgcgtccgcatcgaccttatatcccttatggcagccggcatggtcgatgagccaggcggcggacgtcttggtgccgggagtgccgtccggcagagtcgcgtcgaacttcggcgcatcttcgggcagggccgccgcttggtcggcggtcagaatcggattcataaagaacgagccgcagctgtggcgattgtagtcgggagcaggcagaccgtcatcgccaacgggaatgccggcggcctcattgaggaaggccagacgctccagatcggtcaggatattggcctcgcgcttggcggtggccatgtcgggcaaggcgtagcgagtggggtcctcgagcatgcccttggcggcacgtactgcgagcacggctttgcgaatgtcggcggtggccatacggtcgcccacttcgacgccaagcgctttggcaagctgtccgtaacctaccgtgccttcggccgagtgggtcagggcaaaggtgacggaaagcaccacgtaacgtggcgtcgggaagaatcggtcggccggctggccggggccggcgtacatgctggccttcagtgcggagtatcgatagccgaatcgaagatcagcgggtgtgaggtcgcgcgttgttttggtgtctcgatcccagacttccaccgattcgaccgaagtggcgacttcctgcccgtaggcaccgatgttctgcaccacggaagcgccgactgtgccgggaatgccggacagtccctcgacgccctcgagcccgagctctacggtgaaggccacgaaatcatcccaattggcaccggcctcggcattgacatgcacggtgcgatcctcgccctctgccggtgcagcctcgtccggcacagtgatgaggcgtcgggcgtctcgaaccaccacgccgtcaaaaggcttatcggaaacaagcaggttggagccgccaccgacgacgaccaagggcaggcctttggaatcggcttcctccacggcttcgatgagtcccacgcgcgtggtcggctcgatgaaatgggcgatggggccgcccacgcccatggtggtgatgtctgcaaagcttgtcatggcttactatcttagtggcgcaggtgcgatatcgaggcaatcatcggctgaaacggcagaacgcccgcgtctgaacgaaggtggcgcgggatttctgccgttttggcggcccgaaacgacagaacgcccgcgaggggttcgttcagacgcgggatttctgccgtttctcacgcgatgcggatactgattccgcaccctgccactcgcctccggaggcaatacgcaaaaacccggccgaatgggccgggttttgtaaagctgtgatacttgcgatcaacgagtctcgcggtgcacggtctgcttgccgcagcgcgggcagaacttcttgagctcaagacggtcgggcgtgttacgacggttcttagtcgtaatgtagttacgctccttgcactcggtgcaggccagcgtgatgcccggacggatgtcggcgctcttagccattgtcattcacctctgtgttcttaggtatagtgcgcgcccaccggttagcgggcgcgatttgtagcgaggaagaggctcgaactcttgaccttacgattatgagtcgtacgctctagccagctgagctaccccgccagagagccccgagtgagaattggactcacgacctcttccttaccaaggaagtgctctaccactgagctatcggggcgtggcggatagtggattcgaaccactgaagcacgaagcggctgatttacagtcagctccctttgaccgcttgggaaatccgccagtctgtttcccgccgcggtgtttgacctcaacaggcaacttggctatataatcacatattttccaagtacgcaaatcgacctctacgtgaaccttgttttaccgcggaattctgcggttttatcggcgtgtctcacaacgtggtttcagggtccgcttcggccctgcaaacagccccgaccaaggctgcaccccgcacttctaccaatcatttttcttatatggtgttccagaaccttgcaatggcgcggttttcgagtggcgtcgcctgcttgcggcggcacagcgcatgccggcatgctgggcgcatggcttctaatcttgtacatcacggacaatcattcgacgaccagccgctcggattcggcacgctggccattcacctcggcaacggggtcgacgccggaaccggcgcgatccgtcgccccatcacgctggcgaacacctacgcgctgccctacgacgcctcggccttggcgattgccaagcatctcgaatcgctggatgtggtgcgtttcgtggcgtaccccggtctggaatcgcacccgcaccacgaggtggcggtcagccagctggcccgcccggactccgggttcggcggcgtgctgtcgttcggcctcgacaccaatcatgacgggcacaaccggttcgtttccaagctcaatgtgattacgtcggccgtctcgctcggccatgacgaatcgctgatcgtgttcctcggcgaggatgacgagcgccagtacctgtacccgcctgagttccaccgcggcttcttccgtctggccgtgggtctggaggatacggacgatttgattcgcgacatcgatcacgcgctggtggaggccggattcgaggtgtgagaccgcaccgcgcgcatgatttcggcctcttccgccctgctgccgccgtcagtgagtcacaagatggctcggtgacgacgatggcagggctttttacgtcggcacggggacaatacctggcggtctgccgacgatgacggcacttatcgtcggcagaccgccagtttttggaccgtcgccgacacaaaacgccgatttgccgtcggcaatggtccaaaaactggccctataacgacaccaacgcggctcagcatcagcacatcgccatttcgtggcccactgccgacgctggcctcatgccacggcactcagcgtcggtagagagacaaccattggcacagcgacgacaccacgaacctgcgacacggaaaaaaacaacataccgtcgacctactgccgtcttgtgcaaaatgtcttaagccgctcggccaagtcgccaactgagcctcttccatagggaccccaatccgttacccagtgtagatgcggtgcaacgccgaactcaactacgttgcgcgcatgcacctttatgcatagcaggcatggctgggcgtttggtgggagcagctttcggctcccctctctgagggggagcccctttccgcctagcaagagaaaaccccgactatccgcgggaacagtcggggttgttgaagttcgctaggcgactaatcagccgaggatggcgagaatgtcgcgggcgccgacgatgaggtagtcctcaccctcgtaatggacttcggtgccgccgtacttggagtacagcaccttgtcgccgaccttgacatccatcgggatgcgctcgcccttgtcgtcacgacggcccgggccaacggccaggacttcaccctgctgaggcttctccttggcattgtccggaatgtacagaccggaagcggtctgggtctgggcctcggcctgcttgacgatgatcttgtcttccaacggtgtgagcttaatcgacactgtgggtcacctcgtatctacttgtagttcgataatgccgcgccagaacgcctcaagaggctgacgatcacttgcgttgtccctttgcgctaggacacatcgtagcgcgattattagcactctgccaactcgagtgctaacgctgtgagagaaaatcgtcgaatcgcaacgctcagttgccgcggcgggcaagaatggagtccaggcctgcgcccaacgaatcggtggtcgccgctggcgcttcgacgtcggcacgctcctcggattcgtggaatgcggctcgctgggcggcgtttgcagcctcgtcatcggcgtccgtatcggcatcatcgcgctgctccggctcagtgtctacagcgtttccggcgctgacagccttggcgtcgtccgcggccttgacggctcgggcctcgtcaatcaacttttccgccactgcgggttcgacaggttccgccttggacacctgacgggtcgacttgatctccaagctttccggagcgttgtcggcgttatgttccccacccaaagtgaaggagatgagatcctgcgaggtggacatatcgaagacgtccagtgctcgggcagggcgtacgctgaccagttccgacgtggcatcggcagcggcagcggcatcgtcgcgctcatcgcgctcgtcacgcaccgtaagcgatggttcaactcgaggggcgacggacttgtccgactcaatcgacttgtctgtgcgaacggaggcatcaggtgtggcggaagattcgctggtttcggcagcggacttacggtcggcggattcatcgaccatagcagacggctcggcggcaggcttatcggcggcggactgtgcaatatcagacttctcagactgtttggcgtgctcttccgcggcctgatatgcggcggcggactgacgcaacgccttggccttggcctgctcaatctcggcatcgcgtaacgcgcggcgaatctgccgctgttccatgacctcggtggcagcatcctcaatctgctcggcaggcttctcggcaggcgcagttacggccgcaaccggttcggccttgttcacacgcttgctgtccttggactcggcagacggtttcttggaccagcccgtaccgctatgagcccgctcgtagcggaccaccttgcgctcccattgccgggcctggcgtgaggcattggctcccagcaccagcaccagcagcaacagcacgaacggaataagagcaagcagcggactgaaatgcagggggaacgatacggcaaacaccaacacggttatggcaagcaggcatacggcgagaatctgccggcggcggatggccgcgcggcgcagttcccgcacatgggcgatgtgctcagatgtcagcctcgctgacggtgttgatgctggcattgctgcccctttcgccttatgcggcttgatgtctccgaatcgtctgccgttctctgcatcaacgatatgcagggaaggcgaataacgatcctgccggtgctcgtccacacgtttcatgccgttggccgtacgtacgggcagccatacaacgataataatcgccacaatcaccagcacgacgacagtgctcagtgactcataacccatagagtcaaggataggagacgtgccgacgaactggggctttccgtccgggcgtgtcggagcggaattcttccggtcgacgcttatctggaaccggcggcggcgagtctagcggcgaacccttgccccatatcttcagccaacagcgcaaacgttacgtggtcacgccactggccattgacatacatataccgctcgcgcagtccctcatgatgggctccgaccttacgcaccacagccaaagaacgcgcattatccggcagaatggcgatttccagccgatgcaacgcgggcccgaatggggctccgagcgcccaatcggcaagcatggccagtgccattggcgcgaatccgcggccggcgcaccgttgatcgacccaataaccaaccacgccggtacgcatggcaccatacacgatggctcccaacgaaatctggccgacgatacgcatctggtattcgatggcgaagatcacgccgacgccatgctgctcgttacggcgctgccgctgcacccattgattgaatgtgatggagccgccatgcatcgggtcaccggattcccaaggtgccagccagtcgttgttgcgccagcgcacttcgttccagccgtcctcatcatccatggtcagggggcgcaggactatcggaaaaccgggatgggtgagacgtggcgggcggatctggtggtccagcttgaacgcctctttaatcgactggaaaactgacacggcctttattgtagccatatgaaggtcttgcgccgctaccgtggccactttcgttttacgatggaaacactagattgtgcggtatgagcgaagtgggcagtggcatgaatatcggcagcgactacagcggcacagagaaaacagagaagacggataaagcgacgctgcgccaccatatactgtctcggcgcaagcgcgttccagcggaagaacgcggagcggccggtgaattgctggtgcgacggttcccagcacacatgattcaggatggtcccacagtggcggcatatgtgtcgatgggttcggaaatcgaaacccggccactgttgcgatggctgcgggctcatggctgccacgtgttggtgccaaggttggggtctgggttggaaattggctggagtgtgctggattcattggaatcattgcgctcgatggatgcagtgggtggcgcgaacaatgccggtagctgcagctctcccagcaccgtccatcacagacccgatgagccaactggcgcagttctaccgcccgaagcgttggagaaggccgatctggtcatcgctccggctttggcagtggacccgcagggcaatcgtctggggcgtggagccggctggtatgaccgggccttggctcgccgcaagcccgcatgtcccctgattgcggtgtgctggccgtgggaggtgttggacattgatttgccggccgaaccacatgatgtgccggccgacggagtgctgacgccggagggataccggcggcttagctcatcgggcctgttgagctggccggccggccaagatactcggcgcaagccagactgaccaaccagccacgcacactggccgatggaaccagagtggcaacagcaagctggctagtaagaccgtaacgccaatgtgtcagggcggcgactaggatatgaacggttgcgtggcatggcgtttgggccatccgcgagaaatatgactttgttggaggaatccgttgcctacctatcattaccgttgcaagaactgcggctatgacttcaccgaacagcagtcgttcaatgacgacccgattaccgtgtgccccaagtgctcgcaggagcaggtgcgcaaggtgtattccgccgtgccgattgagttcaagggtcacggcttctaccgcaccgacaaatccggcaagtaaggtctgtacacccgcttttcctctgtaaacgacggtgtcgacggcggtatgccgcggatattggcactacgggcactgtctgttgcacgggtttgaagcgttgtggataacttggcaagctagaaccacataggtcgatttggcttgcgcttacgaaaaacttcaggtcaccatggttgcatggtgaccttttcgtttattaagccgcctgcgcgcggctcattgcggcgacggcgcatggcggatgccttgcgccgactcactgctgcgttgtgcgtgggactcgcagtgctgtttgggcttgaagccgtattggccgtggtggagaccgagccgatggtggtggccgcccgctcgattcgacggggtgacattattctggccgccgacgttcagttggctgatatgccggtatctgcggcaggcccgtcttggacaggcaatattgaggatgtggtgggcaaggtagcgcaaatcgatatcgaagcagccgatcccatttccacgcatatggccagagatgcgcccgtagcaccgaccggcactacggtgattgaagtccgcttggccagtagcgtcgacgatgtattggccggcgatcaggtgagactggtttccgccgtcggttgcgaaggtgctgattgcacgctggccgagaacgccacggtgatgaatgtcggcaaaccggatgcgactggcgcattgggaggcaacgaccgactggtgtcgttcgcaatgccgccggaggccgcggccaaggttatggagctgcaacaggccggagcgattatggccgttgtgcggtaggaagcggaatcggccttcggccgatactgtgttttccgcagcctgtcggctgcggaaaacacagtgttggggcgcacagagtgcgccccaactcctactcgcgctcgttaaaaacggcccaatgcggcggcagttcgccgaggatgcgtttgtcgtcgtcggattgccgttgttggtcggtctgcatgtctccgggctcgagtttgacaccgtcagcgtcaaactgctcagtgcccttcatcaccacgcgcttgtgcttgcgcggtgtgcgccgtgtagccgagtattccgccatggttattcaacctcgcgatagatctcaccgatacggctgacgatacggtcgacttccttatcggggttcacgaaggcggcgacactccagacggtcatcacattccagcccaaggaaatgagatcctgtgccgacaaacgatgacgcctacgcgtggattgcacggacataaagttcgcgtcatcggtctgcacggccaaggcaaacggcttgtccttcaatcccaccacgagcggaatcttcacgcccttgtcgaatccataatcaacagcagcgttcagtcctcgcgcgcgcaacctgtcggcgatatcgtcgaacagcacgttgccgcctgccgcatcacgcaacggaagcaccggacggtcgtcaagctgttcggcccacgtcaacatggtcttcaggaaccgaggaccggattggtgcagacgttcttcatccaaatcttcggaaccaaaggccgacacaatatccaagctgtggtccgccaatgccagggcatccagcaacagtccgcgaccgcctgtgctttcgagcggaccgaactgctgaagcagacgtccgtgcgtggttttcgcatagcacatcgacagaatcacgtcagtggcacgacctccggccacgtcacgcaaggaaaccaaccgcacatggcgcaggaatcggcccatcgccttggatttgcctgccaacgacttcaattcggcacccaagcgtgtgcggaatgcgtcggtcaacatcacgaccacaagtcgatagctggaaggaaccacggcaaaaccggcggcacgttgcgtaatcagacgcaccacttcatcaatctccggctggctggattccaccagaccagaagacataaccggcacaccgctcgcttccacacggtggaatcgcacctcaccggcagccggctcggtggccacatcatagcgaacaggaccatatccctcggattcaaggaatgcggacaggcgcggcgcacggcgagacggggcagcatccacctcgatatgaggcaacgtgtcgatcagctgcttgacgctttcgctggttaccgtcgcgcagtgggcgatcaccaccacctgctgcacgcggccgatgatggacagcaactcgatagcgggaatgtgcgcgcacgcatcgagaatcgccacatcagccagcacacccggctcggtgagtgcggcgagcgtacccggcgcggccaccagaatcggcttggccgcggccagaatctccggatgatcacggcgaatcctgctcagcgacacactggcgcgccctgccagcacggtgtgcatctggttggcttcctgagtgcgggagaacagcatgtcgcacaggcggcgcatggattcctgcgacaccatcggtccgatggagcgcacgtgctccacatcgacctgcgcaaagcggtcggatgcggcctgcagcgcggcaccatcctggttggagatgatggcggacgaacgcacaatgtcctcaaacacggtggtccaccaggccagctgcacttcgccgcgcacctgctccacgctcactcggcgagcgttgagatcggcgaccagttcgttcagtccggcagaggcgaattcctgctccagcaggcaacgctccggcaaggtgtccagtgccttgcgatcatccagcagtgctttcaggcgtgcttccaccttctcgaaatcggcggtttccagattgccaccagcgggtgtggtggaaagcacggtatccagcgcggtcatattgctgaccagcgcctcttgggtggagatgatctcgtcgagcttgctgggcagcaccggccaaccgccgtgaggcacgaactgatgccactgctccccttgcttggcgactaccttcaacgcttcgtgcaagtcctcgacctgcgcgccgacgcgcagcagatccttggcttccttgatgtggcggcggcgctcccagaatcccatcgacgtgccctcggccttgcgctggctcttcggcttggtggcctcgatcatggagctgatgtctcgctcgaaaatctccggctggaacacgtcaagcactcgtcgcagattcttcaaaaccgtaacctgacgctcccactcgcgggtggtgggaggaaccgggaatccgcaggtctgcacggtgcgtgccacctgctcacgggtggcgggcaggaagcgacgcagcaaatcgtccacgcgctggtaggcggttactgcctgttcttcagtggtgatggacgccttgtaccatgcggtgtcttccgggccgatggtgtattcgccgagctcgccggcgcgttccatcttgccgatccatgtgtcaatatcgttggcgatgctcagggcacttgactcgtcaagtcgaacgtgggtggcagggtgcgtcgggagcacggagatacgggccagattctgaatggtctcgtatgcggacacattccacttatcattgcccccgtgcaggtcgcccaagtagcgggtcaagcgcgaacgcacgcccacgagttcgtcggccaactggtcgaatcgctgggtggcgactcccggttggaatccgactgcggcaatcagctgcttatcaagcgcggcgttggcgtgttcatcggatacatccagtacctgcgccttcatctcattggcggaggccgtctggatgaacagacgcttctgctcggccacgccgggcacgtacagcacggaacgaccattcatcaggcagcgcgatgcgatggccacagcctgctccgcggtgcccttcgggaaggcgccgtcgaccacgatgctatggccattggcggcaagtgacgcggcatatcgcaccgtattgtccacatcgccgacttcgtactcagcatgcgggtctacgtcgaaaggactgtattgcggaatattggcatctttgagcgcggtgcgggcggattcgtcgccggcaagcgcgtccaacagcacattgccggtggggccgttctccagctggtcgatgaactgtcggctttcgctgatcatctgcgacgaggggtccatgaagcatccgagcacaatctggcgctcgatggcgaagtcggagatacgctccgacgcttcggacgaaatacgggcgaacatcgcggaagtttcgggagtgccactgtcatagctggcaccgtcaaacagggaatcctcatccaggaacaccccctgctcacgcaatgtattgacgaacgcgacgttcagggtcacgcgaccggtgaatcgaatggtggtcgacaagccatcatcctcgatcgtgacgctcaccgggtacaacagcaccggcagcgcgttgcccttccatgtggccacgccgaccacgagcgacaactccgccacgccggaaatcctgcgtttggcggcctggtcatccagcacgcgcccaatatggcgttcggcggccttaagcacacccgtgtcgcggaacaacgaatccaaccggacatggccggaagcgaacagctgggcgatgccggagggatgggcatgggtcatctccagcttcgcggccagttgattcacatcctcgagcggcgatggcggctgcatgctgcggtattggtcacgccagcgacggatgcgattcagaccttccgtgagattctggttctgagtctggctctgggtcatctctcgactcactttccaaccgcttcgcggtattcctgatagcccttgttgtgagacagggcttcgtcaatatcggcctcgccacgggcggcgagccaagaatacatgtcgtcgtacaggtacggattcatggcgaggaacgccagcaattcgggatgacgggcgacttcgaattgaacattgaaatcttgcgtggtttttgcctcgtcagaggtcaggccatcgacttcgactgccggctcctgtgctttcagctcgcccttggccacacgctcgaacaccgagccgggctcgaagaccggagtgtgtacgcccgcgtggagtccgatatcatatgcttcggataccgactgctgggcggtttcggcagccggctgctggtctgctacgcctgctgcggtggcttcttgatatgcttcggctgcggtccgctgctgatcgtccggtacgtcagctgccggctggtcggtttcagactgggcggttgccggctgagcggtctcaggctgggtgttttcagattgagcggcttcggcttcccgggcggcttcaggctgggcaacttcagcatgctgttcgacagtgtccgccggctgagaatcgccggcattcctggtattcggagcggactgaacgttttcggctgacttgcttgcgccagccgctgcatcggattcaacaaccgccgccgacgccactgccggctcgcttgtgctgggagcgtgcttaacaacggcatgggcgatggcatctactggaacaataccggagatcctgctgtgcttggatgcaggcgttacaatcgtcgactcaggttcggtctgctgcttcggcagtgccacggagttcatggcctgctggtttttgcgttcggtctcctgctcggcatgctgggccaacgcatccgcgaacagatcacggggtatggccggctcatcgtttttcgtcactggctgcgtgatattcagcgagccaagttcaagctcgtcgaccttgcgtcgaacattatccgcgctgaagatggcggtcggctcgccggcccgcaaatcaagaatatcgtcgacggacatatccgccgcatccggctcctgcggtgcttcgtgaaccgcatagccaaacaaatcaggcaccttgaggtcgagcggctttgccactggatcgtcgacacgaatgaagtccgcaggcacatcgccgaactgcatgcgcatgggagacgtcggcaacaggaactcggcattggccggcaagcgcaacaaatcgccattttcccgcaccacatacgatccattggtcgatccaagatcacggaccgaggccgtgccattgctttttaccgtgaacatggcgtgccgtttggacatcgatttggtttgatcggcgacgtcaaggcgggtgttgccatcatcggcaagggggcgtaacggcttacggccgatttccacgcactcccccggcttgacgctgatccggtcgacaccgttgatcttcaccgtccactcgctcaccgtgaccgccttcctggacacactatttgaccacactacgtgccattgtgtcatcttttaccggcttttggcggattactgggcacagaattgacaactttcgctcattgccagctttgtgtttccacgccggatcgcgttctccgcctcgtcctcgtcaactagtctactcagtatgcggaaaccccgcagcctgaaacacaggtgcggggttcctcgaaaagctgtgattgcggcttatgccgcacaaatcacttgagctcgacgctggcgccagcctcttccagctgagccttggccttctcggcatcttccttcttggccttctcgaggacggccttcggagcgccgtcgacaagagccttggcctcggccaggccgaggttggtgatggcgcggacagccttgatgacctggatcttcttgtcgccgacggcggagaggatgacgtcgaactcatccttctcttcctcagccggagcagcagcgccagcaacagcggcaacagcggcaaccggagcgacagcctcgacgtcgaacttctcctcgaaggccttcacgaactcggagagctcgaccagggtcatctcgccgaaggcttccagcagctcatcgttggtgtacttagccattatggcttcctttcaatcttggcggcggacgaagtggtagatccgctgcctaataaaccttattgtttaaattatcgaagcgactgattcatgccgtgagggcgtaaatcaggcagccttctcctgcttttcgcgcagggcgtcgatcgtgcgcacagccttggtaggcagagcgttgaacaggtacgcggccttggccatcgatgccttgatgtcgccggcgaattcggcaagcagctgcgggcgggacttgaggtctgccagcttcttggcgccctcggcatcgtagacagtgccgtcagcggcggcacccttgatgacaagagccttgttgtccttggcgaagtcacggatgaccttcgcagcctcgatgaagtcgcccttcacgaaggtgatggcggtcgggccggagagaatctcgtcgagaccctcaatgcccgcttccttggcggcgatgcgtgccagcgtgttctttgccacggtgtaggaagtatcgcggcctagcttttcacgcagatcggaaatctgcggaacggtaagcccgcggtactcggtcaggtagacggcgtcagcgttacggaattcttccgtaagctgagcgactaccgcttccttttcgggcctcttcatggcgttccttcctaagtcggccgttgacttggagttcggaactttcggccgggcaacaaaaaagccctgcgcacaggcagagcaatataatctcgcgaagcgaccttcgccggcccttgacgggcttatatctctcaacctgcgctggcttggcgaaccaaacttcggaaatgcactcgcgcgcacttcaaccaacggtctgtggtttacggatgattagattacggatggtcagcgacattgcagaattcgggcgtgtcgcggggcattacagcgtggcggcgtactgggctacggacgcggtgacttccttcagatagtcgagcgagcgacgccagtggccgggcacctcgatcgaatggttggcatccgggtattcgtgcacgtgcggggtgagcgcgttggcgcgggcttgatcgtagaacgggtcggcggtgccggcgcagatcagcggtgccgggccggagtatcgggagctggcggcgtgcgactggccggcctgttccgcgcggatgatcgcccttgcttcggccacgctcggggcctcggattcggcgacgatatcatcgccgacagccggcaccggaatcacccgggcggatggatcgaagtcggcgtgatgcagcaccggggtcagcagcacgaacggcagaccgtagtgtgaggccacatgtgggtaggtcatcgtcgtcagcgacttgccgatcagcaacaggcgagggccggacggggtgtcggaatcacggttcggcgagccagctgcgccatcggccagcacggtagcagaatcatcggcggcaacgccatccccggaatcaccggctttacccgcgccggactcgcgcgcggcggccacccagccgtcaatcgcctgattgaggaccggaatcaccgtggacaggtcgtcggaagcgttgcgtacgttcatgcggtcgattcgccagccggcctcgaccagagcctgggccgaccagtagagcagcggacggtcgcagttgtagccggtgccgggcatcagcagtacgcggccgtactcctgaccgggcttgacgacattcttcttccaagaggtgatgctgacttcgacggccggtttcatcgcgcgccttccttccacgggtgtgtcctgcgtgtcccctgagttgttccgaattattctggcagtcagtctactcccggacccgttcacgttgcctccacaagctataatcggccacggttctgattgggtgcgcagcgcctgacgcgcgttgggcaggccgatcagggcgagttgcaattctcgccggggccagccgcagcattatgcacgcggtgcgcagccccgcataaacccaaggaagtagagagtaaatggagaagttcttccatttgaaggaaaacggcacgaccgtctcgactgagattctggccggcctgaccacgttcttcgcgatggcttacatcatcgtcgtcaacccgcagatcctgtcgcagacgggtatgccgtggggcggcgtgttcctggccaccatcatcgcggccatcatcggcaccctggtcatgggcctgttcgccaacgtgccgtacgcccaggccgccggcatgggcctcaacgcgttcttcacctacaccgtgtgcttcggcctcggcttcagctggcagcagaccatgtgcatggtgttcctgtgcggcctgatcaacatcctcatcaccgtcaccaagatccgcaagatgatcatcctggccatcccggagtccctgcaacacgccatcggcggcggcatcggcctgttcgtggcctacgtgggcatgctgaacgtcggcctgatcaagttcactcccggcgatccgaaggccgccgccaagggcggtgccgttgcggctaccccgggtctggccaactttaacgacaaggtgctgtgggtcttcctgatcggcctcgtactggccattgtgttcaccgtgatgaaggttaagggcggcatgctgctggccatcgccatcaccaccgtaatcggcatcccgttcggcgtgaccacctggtccaactcgcagtccatcagcgagaccttctcccagctgccgcagaccttcggcgcgatcttctccgccgagggcttcccggcactgttctctgatccgaccaagctgccgctggtcatcgtgaccatcttcgccttctccatgtccgatacgttcgacaccctgggcactttcatcggcaccggccgccgcaccggcatcttctccgccgaggatgagaaggctctggagaacggccacggcttctcctccaagatggacaaggccctgttcgccgactccatcgccacctccatcggcgccatctgcggcacctcgaacaccaccacctacgtcgagtcttccgccggcatcgccgcaggcggccgaaccggcctgacctccgtggttgtggcgatctgcttcgccttgtccgcgttcctggccccggtcgtctccgccgtgccgtccgccgcaaccgccggcgtgctggtgatcgtcggctgcatgatggccgcttccctgaaggaagtcaagtgggacgacatcgccgaagccattccggcgttcttcgccgccgtgttcatggccttctcctactccatctcctacggcatcgccggaggcttcatcatgtactgcatcgtgaagacctgcaagggcaaggccaaggaggttcacccgatcatctggactgtggccgcgctgttcattctggacttcgtgtgcatggcgattctgtaacgctgattgacaacggattagcctttaaggattaatccgccgccatacggcataaaggccgggctctcacaagggcccggcctttgttgttgccacagtgatcaacgcccatgagtaccttcgatgatcatccgccattcttgatgcatgggaatagttgtcaaccgacaactaaacgtacatggcggcagcacgagtgccttattcaacatcgaaatatgcagcgcgaagaagccgaaaaaccaaaaaggcttctataccgaatgaaacggtatagaagccttttggtttgcgatcaagcccttctcacccgagagaagctagagaacgatcagtcctcgaatgccgaaccgttaagcgggaagccctacgggcttcccgtaggtgaggggagcggctatgccgcgaccgatccgtgagagggatttagtcctcgaacggatcaaagtcgcgacggacgcggcgacgcgggcgctcagtacgctcttcgcggtcggcgcggtagtcgtcgtagttgtcgtcggtggcgtagcgcgggttacggtccgagccacggccacggccacgggaaccgccacggcggtcatcacgatcgccacggtcatcgcgatcggaagagcgacggcgacgcggacgatcatcgtcacgggagtcgcgagcatcacggtcatcgcgatcgtcgaagtcacggtcggcagaacgacggcgacgcggacgatcatcatcgcgatcatcgcgatcgaagtcacggtcatcggagcgacggcgacgcggacggtcgtcgtaatcatcctcgaagtcatcggagcgacggcgacgcggacggtcgtcacgatcgtcgaagtcacggtcatcgcgatcggagcgacggccacggccgccacggcgatcgtcacggtcaccacggccacggccgccacggcggtcatcgcgatcgccacggctcgggcgggcgttgttctcctgatcctcgaaaccaggaatggccagggagatcttgccgcgatcatcgacaccctgaacgatcacctcaacggtgtcgccttccttgagcacgtcttcgacagcgtcaatacgctcgccgttggccaggttgcggatctgggagatgtgcagcaggccgtcggtgccgggggtgaggttcacgaaagcgccgaacgacgtggtcttgacgaccttgccgttgtaggtttcgccggcctcgggcacgtgcgggttggcaatctggtcgatgatggccttggccttctcagcagcctcgccaccctcggaggagatgaagacggtaccgtcatcctcgatggcaatttcagcgccggtgtcttcctgaatctggttgatcatcttgcccttcgggccgatgacttcgccgatcttctcaaccgggacggaggtggtgatgatgcgcggagcgaactcgctcatctcggccgggccgtcgatgcactcgttgatgacctcgagaatcgtggcgcgggcttccttggcctgctgcagagcggcggccaggatgtcggcggggatgccgtcgagcttggtgtcgagctgcagggcggtgatgaactcggaagtaccggccaccttgaagtccatgtcgccgaaggcatcctcggcacccagaatatcggtgagggtcttgaagatgtgcttgccatcaacgtcgccggacacgaggcccatggcgatgccggcaaccggagccttcagcggcacgccggcagccaaaaggctcagcgtggaggcgcacacggaacccatcgaagtggaaccgttggaaccgatggcctcggagacctgtcggatggcgtaggggaactcttcgcggctcggcagcaccggcacgagagccttctcggcgagggcgccgtggccgatttcgcggcgcttcggggaaccgacgcggccggtctcaccagtggagtacggcggcatctcgtagttgtgcatgtaacgcttggactgcggaccggacagcgcgtcgatctgctgctccatcttgagcatgttcagcgtggtgacgcccagaatctgggtctcgccacgctggaacagggcggaaccgtgcacgcgaggcacaatgtccacctcggcggacagggtgcggatgtcgcgcaggccacggccgtcgatgcggtagtcctcggtcaggatgcggcgacgcacaatctggcgctgcagttccttgaaggcgttaccgagttccttgtccttctcggcatcgtccatatcggtgaactcgtccgcgagcacctcgcgcacgtgctccttgatctcgtggatgcggtcctggcgcggcagcttctcggcgatggagagggcctcgtccagatccttgtgagcgatctcgtcgatgcgggcgtacagctcgtcggtgtactccgggaagagctggaattccttggtctccttggcggcgatcttcttgagctcgtcctgagcctcgcaaatcaccttgatgaacggcttggcggcctcaagaccaccggcaacgacttcctcatcgggcttggtctgaccctcgtcgtagatgaggtgccaggcgttcttgccggcaccggcctcgatcatggcgatggcaacatcaccgttctcgatcacgcggccagcgaccacaatctcgaacacggcgcgctcacgctcgctccaacgcgggaaggcaacccactggccatcaatcagcgccagacgcacaccggagaccgggccttcgaacggcagaccggaaatcatggtggaagcggaagcggcgttcagggcgatgacatcgtaagcgtcatcagggttcacggcgagcacggtctcgacgacctgcacttcgttgcgcagggtgtgcgggaacagcggacgcagcgggcggtcgatgatacggcaggcgaggatggcctcggagctcgggcggccttcacgacggaagaacgagcccgggatcttgccggcagcgtacatcttctcttcaacatcgacggtcagcgggaagaagtcgtagttctccttcgggctggaaccggcggtggtggtggacagaatcatggaatcgtcgtcgaggtaggcggccacagcgccatcggcctgctgggcgaggcggccggtctcgaagcgcagcgtgcgcttaccaaacgatccattgtcgattacggcctcaacggccttgatttcgggaccctccatagggttcctccttctttaattttctatttattcctacatactgtgttgcggtttggcgactcgcttgaaccgcaactgtcctcttcagcggacgtcacataccttgtttcgactggccccttggccgtcgttcctcgtgtcaaccccttcattcgggttctctcgtcggccttacctactggctacctgcgtgcgtaccgtttccggtttcggcgccctactggcctatcctctaaccctcttgccgttgttgccgttggctggcgatatgtaaaacgcccgagcaccatcctaggtactcgggcggaagtcttcaattatcgacgcagacccagacgctcgatgagggaacggtaacggttgatgtcaacgcgcttgaggtagtcaagcaggcgacgacggtcaccgatcatcagctgcataccacgacgggagtggtggtcgtgcttgtgctccttgaggtgctcggtcagatcagcgatacgcttgctcagcagagcaacctggacctccggagagccggtgtcaccttcatgggtcgcgtacttagcgatgatttcctgcttttcttcagccgtcagtgccacggcatcctccttatattgctgcgcggtgctaccggcccgatgccggcgcgctctctatccgcgggcgaaatacgccaagggtcaattatacaggagcaccagacaccacgaatcagaccaacgtcagcaggccgccaaacatcacaacaagcaaagcaatcgtctcaatcacaaaaaaaagataaacgacgcccaactgcgcgtcagcacattcaacggcgactcttttttaatcgtcaccaacaatcccacccacagcaccgcgaaaacggcaacgccaataccaactgaaataatgccaagattcgccgcattcgccaatgccgacgactctccgtacaccacatatgtcgcataccaaaaatcaattttcagaatgcgcaggccggcaatgagttgctccgccgccaagccaatcacaaaaaccgcgccccacaagcgccgatgggcgtcaacaaccagcagaccaaggccggaaacggcaatcagcgtcaccgtccaggcaacaaacgcggcgccgcgcggctcaagcgcgctcaaattatcaagcagccactgcgtatcgttcaccgcaatcgcacgcccccaccaatacggcaccacaatggccgcaatcaccagcagcgcataagccagccacaatgcaggatgcgagcgcttacgctcaatatcggccagcgacagcgtcgattcgggaatggacgccaccggatgcttggaaacatcgttatgtttggaaacatcgttgggcatgggcgaaacaccatcggaccgcgtatcgatttcagcctgcacctcaccgctcgcctgctggtcgaccggctgtttctccacgctggaattcaccgccatctacgtttacctcgcgttcgttgttcgacgccacacctgtctgcacaatgcgtcgtctcatgccgcgacgcccatgctaggacggtattgtatcgtgagtgcgccatacgataatgacatggcgccggacataacgccgcaatacctgattttcgctaatcgcaaccatgcttcggcggacgacataagccatacatatgttcataagggcgaaccatatccgaattactcactccgctaacatcaccacataacggcaacatagatacacagccatacttgatatcaggagaacgccgtcgattcgaaatgaaaactgccagccgcccacacaccagctcctttgtttccaaaatcgcacattctacgccgatgtcatgctccaccatgtctcacgccgcggtctcaacataacaggatgggttgtacgaatccacgttgccgagcattcgcacaacccaccattgcgacacatcactgattccgcacattcaatcgctgcaaccaacaggctgcggcgatatttcagcgcgaagagcggcgtatccgaatgacactgatgccagccagcatcagggcaattgcagacagcaccatcggtgttacggacgaaccagttgatgacagttcagatgaattatcatcagcagtagaagactgttgctggccgccatcaccggtctgatcgccgttacccgactggttaccgtcaccggtctgatcaccaccaccaggatttccgccatcaccagactgacggtcaaccgccaattgcgcgagctgcaaactcagtgcacgctgcggggcatccacctcattttgcgtggaaggatcggatgccaacgcctgctttgccttatcaagtagcgtgagcatcttatcccactcatccataggatattccgcagactgcagagagtcagcctgatcaatggccgaacgcagcttagacgtatccacagctttgccgtcagaagtcaacacgtcgctcaagtcatagtaatcaaaatcgacataaccacccgtattctccttggcgtaattgaacaagccgattcgataccccttaaagtgcgacaagctccaatcgtaagtcagcggcccctgctcgtcgccaagcttggaccattgcttaccgtccagactgtaccaatactgaatcgtcaacttaccactcgcattatccagtgtgttgtccgacttgatccacacattggtcgcatcatctggcaatgtcactgtgccgcccgatacaaaggcctcttcagcgtcacgatcaatcgtatcgtcaacgatattaccgtccgcgtccttcacgccattgtcgtagacacgcttgaccacgcccaacgttcgctgtccattttcttgacgcacagcggcataggcaaaactacgggtatatgtagcgaggcctgcggtgtctccatccttcatatgactgacatccatgtgggtttccacagacatggatccgccaaaggtacgctgcgacaaaacgttacgggcggtttcaaaatatgtcaggtcgccataagtgcctttcatatatttggccgtggcggaaaccttgtgcccattggtcaaacgcaaccagccttcacgatcagtgagagaccaatatcggttatctggattatgtccccattcccataccaaatcaagattcgaaccattgggttggtattcttcggcgaccggatattccttctcatcagcaagaccgatcagggaaatatcgtcgatgacgtaatccatgcacgtgccttccgcaccccacgcggtttcgacaatgagtttggaaccttccacattagcgtcggatgggatggagaactcacctgtgatagtagtcgtctccccacgtttcactgttcctgtggccacacgattaattgtgccgtctgcatattgaatcgccacataaaacaggtgggaagtcacagccgatgaatcgacgccgtccatctcatggtcgtatcgaatcgttgcactggcacgatatgtcacgccctgctgcaattttccatccatagattgacccgggccagcgccattgtattcgccacgattcgtcacagcaagactcgtggttccagaaagagaaccatccgtaatcgcggtaagcgtaccattccactgaggggtccacgattcagtcccgttttcgaaatcgccattgtccaccagctcgattccaatcagagaatcgtcaacctgaggaggctcctccagagtccaccaatcctgatcctgataagactgatgaggcgcgtcattatcaaaatcgtccgaattgaccagggaacgctggcgaaccagattctccaaatcagcaggcaaatcaatcagtttgtcgtaggtgtccgacgcgcttacctgattattgtccccaaacacaggccatccgtcatcaccccacgttgcaggaatcaaaccgggaatacgtccggtcggatatgtgtctcggaagaagaatccatgccaagacgtcgtgccatcaccgttgtcgacttcaacaaggctaccttgtgcgaaagcacctagataatacttttgggcttcgtatttggagccatcaagcaaatcagtggtgcgcagcagcatcaccgtacgaccgtctttgccccagtaaatcgttggagtatagaaataatcaccgattttgaaagtctgagatccttcaaatccggtaggagtctcaccaagatcatcagtgaactgttcggcagagatgatattctcatggctctccaccaccgtggttaaatcatcggacagcctatattggttgacgccggagataatccaaggactcccttgctcatcaaaatacaatgacggatcatggaatccccgattaagggcaatcttcgtccaaggaccattctcaatatcatcggtgtagtagatataagcgccattaaggttgttcgtattgaataacacgtagaagcggccattgtgatagcgcagcgacggagcccactcgccttcgccatacgagctagctccattgcgcaaggatgaagcatcgctcatagaaatgcgatcatacacgtacgtgactatccaccaattgaccagatcataggatttcataattggagatccgggactgagctccatagtggtactcaccatgtaatacacatcacgaccgtctttgttattcggatcgtccttcgacacacgaataacactgatatccggaacatccgtgttcaacatgggaatggaatacgtgccatcaccgctatcagtcgtggtgtaactgccatccgatggcgttgaagatggcgttgaatcatccgcaaagaccggcattggcgccaaaatcaacccacaagtcgacaacaccgcgatagcactagccgaaattttttgtcgtaaataattcataagtcttttaacctttcatgataagcactcaacatcgagtgcgtattccaatagcatgcccgcacaaatcagcaatgaatgacgataagacattcccgcatatggataagtgatggacattaccactgccaaaacttacgcttgaacaagtaccagttctaggtttcatgtgcggtcatcccgaggctgccgctacgggatgaccgcattaccaagaggtaactagcgcatctcgcgacgcactcgcgctacgatcacaccagtgagagccaagcaagcgacaatcacagcaccaggcaagacagaggaaccggtttgtgccaaatccacgccatcgtcattggagccgtcggcattgccatcagtggaatcatcagccagcttcagaccggcacgtgcactattcaatgcagcaagcgcatcttgaacctgctgttcagtagcggattcatcctgcaataccgcctgagccttctgcaatgcgtcagcaaacaccttccagctctcttccgtgtaatcggaagcgttcaggctggaattctcattcactgcgctctgcaaatcagacttgtccaccggagtcgaaggagtttcatcctgcgactccgtgaaagtgtacgtagtgatgtcgtacagctcatcctgagcattcgcaccaccatcggatttgaaggagaacaccacatgatgcacccctgtcacaccctcaagggtggtcgtgtaatcggcgtactcggatccatcaccggcaggaatcgaaatagaagccacaggttcggaatccggatcatcaagacgaatctcaaggatgcctccggctttgccagctgcagtcacagtcagcgaagaggcgccgttattcccgaaatcgacattcgccaaagacgtccactcaccattattaatattgctgagcttctgaccttcggaattgtctgtagtcatatcgaccacgcgcacaccagaagtcaggtcatatgcgttctgaatgccggaatcccatgcaatggtggaagctggaatgcctccatcttgatacgcgtccagattcttcaccgaagagagaccctcatatgtcattgcaatatcggcaatggaaccatcctcgttaaccgtaatcggatcgagatgagtatttcggtagccatgcgccgcgtcaagattaccgccgttcatcaattcctttgccaccgtttgcgcatggtaggtcatataccactggtcgccaagttgaaccatcgcgtgatgattgttgccgccaacaccgaaatacgtgctcggattcttcagaatctcaccctgataagtgaacggccccatcgggttgtctgaagtcatatacgcgatattgccgtaaccgaccgtgttaccatcaattacgttgtcatggctgaaattagtgcaatacgagtagtaataagtaccacctatcttggcaatcccggagtcctcaaacatggcaggtgcgtctatgacctgagcctcaccttcggtatgcagcatgtcatcggacagtttaataacgcgagccgtgttcggatgttcttcctcgcctgtcggaacaccacctccgtaatacaggtagccctgcccgtcatcatccacgaacaccgcgggatcaaacagccagaccacaccagcggattcaggagtaccgcccttaatcaacagctcaccggtttcgtccttccacggaccaacaggagaatccgaggtcagcacaccgataccgctgccgccattggcgaaatacaggaagaacttctctttaccgttgatggtcttatgagcgacggcaggagcccaggaattgctggcccaggtggccaccccctgttctccagccacacgaatgtaaccctcattacgccaattgaccatgtcatcactggacagaacattgatggtctttacttgagcgaacgaattgtccttgatctgcccagtactgtcatattcatagtcataattcaacgagccatcagcattcacagaagtgccatcacccgtagtgtagatatatacgcgtccgttgtattccatagcccacggatcggcgccataccaataatcgataatcgggtttgaatagtcgccgaaagccttggctgccgttgccgtacccgtagtcggcggcacgaatgaggaaccagaatccgaaccggttacggaaatgtcgtcgacaatgaagtcggcattgctcgtgccatacttgttttcaatcaccagcgagggactggtgaaatcaccactaccacctaacgttccagtacctgaaatttgtgtccactcacccgctttcgccgttccggtcgcaatctggtcacatccggaaccattacccgaacaaacagtgatattgaattcaccgtcttccgtggccttgacccacatacttccggtatatgtctgtcctttttccaccttgccatcaagagactggattgcaccagcatcagaggatgtacgatcagtaacgctcaaggcgccactgccaccatgcacatcatccgcagtgacggcaatggacgatgcggagctattccacaccgttccagacttccaaccattaagatcgtcttcgaatccgccgttgacgaccaattcgacgggttcatcggccgacgccgcagtcactccgatagtcgctggaaatacagcccccatgcaacacagcacggatgcagccgcagcagcaaccacacgaccggttttccttgtttgcaatatgtgaatgttataaaccattcagttccctttcctgaatgatggagggcgactccccccccccatcattttttcttcgccgcacaatcgaatcccacgttggttacgaccacatcgcggctcattgcaaagccatgccagaggaacgtccctcaagggcagccatgcaacagccattgtataaatgagcgcatttcactcgcgatcgtccttgataacaaattgataacgatatgcacaatgaaaataagttcacataaacgcaacgcaacacatcaaatatgacagtttcatatgccaattacacactttgcataacatatttcaacaaagaatggagacgtacaagcgaactcatctgatgccaccactcatcgcctataaagctggcgtgtcgcgccacaataacatcacagccgataaaacgacaccccgaagttgagcctcattcaacaatgcggccagcttagacacacaaccaacgcttcgcttcatagcaccgaacattgattccagcacagtcacgaccatcttctttgaaggcaatcgtgtttacgccccgggttctaaatagaagtgcaacaccttgtctaaggttggaagtgttcagtttctaacttaagaaggtgttgcactcatgggtcaacgatattcgcacctgtcgtccgaggagaggatcctgatcgagaagctgcattgcgaacagcatctgagcatccgtcggaccgcggagaggatcggccgggacaagtccacggtgtcacgcgagctgaggcgcggcctgtggttcgcgtccaacgagaacgggtcgtaccgtccctaccggccgaaacggctgaagaccggggcgtggacctcgggtccgttctattcggcgctggccgcgcagaggaaggcggacctgcgccggcgcggatcccgcaagccgcgtcgcatggactcggaccggcttcgcgcctgggtgctggactcgctgcgcagggggtggagcccggaactgatcgagggacggttgaaggcccggtacgccggcgacccgtcgatgcggatcagccacgagtgcctttaccagtggatctacgccaagccgcagcgggcgctggacctgcgccagtacctggcgcgcggcaggaaacgccggacgaggaaaaagggcaggaaggcgaaagggccgcgcatcccgatgcgcgtgcccatcgcggaccggcccgaggcggtcggatccaggaaggggttcggccatttcgagtcggacacggtggtcggcgccgcgccgtcgaggcgctgcgtgaacacgcaggtggagcgcaggagccgcaggctgttcgcccggctcgtcgacgacaagagcgcgtccgccacggccagggccgaatacgagatcttcaaggacatcccgccggccgcgcgcgtcgaccgcacgtgggacaacggcacggaggcgagcctgcacatgctggtggacgaggcgctgggcatgctcacgtacttcgccgacccgtacagttcctggcagcgtggcagcaacgagaacaggaacggcaggatccgccgctatctgcccaaaggaaccgggttcgaggacttggcccaggaggacctcgacgcgatcgtcggggagatcaacgacacccccatgaagctcctcggctacaaaacgcccaacgaggtatgggacgaggagatcgccaggctacaatcgaaggcagccagcccgaacacaagcgttgcgcttacaaattgaatccgggccgccgaggcattcgccgacgaactgctagaattgcaggaccaacagggggtgttgcacctctaaatagacatcgggcacacggtttgcgcggcggtgagcagtgagtggtgagtattgagcgacgtacggcgactcacgtgcgctcacacagtggtgagcaatccgccgaacaacaccacgagcagggcgatggtttcaatcacgaagtacagaatgaaactcgcccagcttttggtcagtacgttcagcggcgaggtcttccggataatcaccagcagaccaacaaacaccagggcgtatacggcgatgccgatcgccgcccccataatgcccagattcgcggcatttgccagaccggcctgcttgccgtagaccacgtacgtggaataccagaagttgagattgagcatgctgagtcccgcgatgaactgctcacaggccagcccgagcacgaacacgatcagccatggccaggacggcgagacgaccaccgccatcgccaatccgacgtacgtgatcaccacggccacccaaccgaccagtgcgataccttgcggagacactcccccgagcacggccacaatggagtcagtattattcaccgccagcgagcgaccgaaccagtatggcgcgatgatggcgcacagtacggcaagaataatcaacgcccaacgcaacggatgggagcgacggcgctcgatatcagccaaagacaaatcggtctcgggtatggaagcctcggggtgcctggaaacctcgacggtctctactttgccgcctacgatttccgtcgcctcgttaggttcttgctcgttggattcctgctccatgcaccgcctcgccgattacctgcttattgccatgtattgccatgccgattattgcgatgcctatcttagcgtgcgtgttgggcaagtacctgatgtttcctgtggtttcgcgcactgattggatacagacaggctactgctgttgcccgtctgtatccggcgacttgtccgccgctgtatccgtctgttcctcaggcaacgtattggcagcctgttccttacgccgcctgccgtgcagcagggcctcgagcatgtcgacctgacgctccagttcgtcgatacgacgtacctgctgcgaaatcagcaagtcgcgtaggtcattgttctgctctttgcgggagacggggaagatgatggcgcgacgttcgggcgatacgtggaaatcggattcgctgccggtaccagccggaagtgacgattccgccgagtcgcgccaagctctcgctgctcgcgcactctccggaatgtttggtgcgcccgcggctcccgagcggaaaagctccgaatctgaagcccccccccccagcttattttccacgccggctttggcattgccggagttcaggatttcgtcttgcgattcacgccagcgggcaaggcaacgttcgatgcgcttgtacccgattagagccggatccaatccggcttcacggaacatgcgcacgggtgaggcaccttcgttgtagtggactacacagtaacgcttgaaatcatcggtataggtgatgcgcttcgccgtggcttccgccactgccgacaacgacttcagatacttgatctcctcggggctaaaagtccctccaccactggtcatcctcatcccttacactcgttggaaggctcattgcacaccccccttgattatggggtgaatgccatagttcgggatagtaatacttataattcggacatgcctaacccctagtagggtcgtttttatccccgtttaagtggagcctgagtagtggctggacggcaactgaacgataatcggcccacgaatggggtatacaggcccatccttcacctcccctacgattgtgttcgcttggcgattgttaccgagcctgcgtgaaacgtttgttgtggtgaaacacaagttattttcgatgcccggccccattacattcaaatcaaaatgccatacattgcccataagattcggagatggtccacaagtcatccgtctgagatgccgccaatatgacaaatggccgatctgaataatcagatcggccattgttatagctgctcagttataagcagcagtcaagctcacgcgttgagagcgcgcttggtggaacgggacttgacgaacacggtcaccgcggcacccgcgatcagcagaccgatcacggagaacagcatggttccggcggcaccggtgagcggcagctgggtgatgttcttgacgttggtgacctggaaggtgcccttgttgtccttggacaggttccaggcatccttaccagcgaaggtggcagcagcatctgcggttgcaccggtagtgatcgtgaacttgccaacgaaggtgccgttgtagccagtcgggaccttcgtctcaatcacggtgtaggtggtgttgagcttaagaccgttcagagtgtacttaccctcagcgttggattgcagtgtgtccgtggcgccttcagggtaagtgccatcagcattggcggtcggcagagaatacgcaccgttagagccattgaacttaagcggagtcttcgctttgagctcgtcagcggaaagaccgctaacatcgccttcgtacacttggaactcagcaccagtcagagcagcagcgttcttgtcgactttctgccaagtcacggcaccagccttggtggtttcttccttgctgctcttcaggtcgacaacgccggcagcggcgagaacgccagtggcgttgttcacggacggcgcggcgcccgtgatagcagtgccagcgagaatcggagcattgccattccacacgagcttgtgagtgtcattatcttcgacgaccagctttccactctggtcgacaatcaagtacagaccaccctcagcgaaggtgaaggtctgggtcttgccaccgttagaagccgtcggggtaatgtccgtgacagccagatccttaagcgcgttcacaaaagcggtggtctgcgcggcggtcagggtagtgttgcccagccaggcccactcgttcagggaatcacccttggtctggtcgttgtaaccagcagcagcgaaagcagcatccactgcctcaccggagaccaaaccctccagctcaacgccagtgttgccatcagacacatacttggcgagctcaacgtacttgaacatgcgcaggttagcctgcaggtcagcggtgtcaaccggcttggtgtagaactggtttgcatccgtggcgttgactgtgatagtcgtgctggagatgttggcctcagccgcgttggcggtggtggcgccgaaggccatgccaccgagcagggtggccgcagcagcgacacccgcgaaaagcttcctcaacttcatgagaaaccctctcttccttattgtgattgattttcttgcaatcgcggaggctgcagacccacagcagggcctccgtgatccgcaaatccttattgttttttcggggagggaagccttcatcgactcccctcagtccgccttcggcggccagctcccctcagcgagaggagccaaaaccacctcaagtttcttgaaatcagaccagctgacgcttacgccacaccgtgtagcccgcagcagccaacagggccatcaggcccacgccaccgccgaacaccatccagtcacgaccagtcgtgccaccggtcagcggcagactggagatagccacatacttgttcgtgaactgtgccgactccgtattcgttcggtcggaatcgttctcgccgtactcgtaagagacaacggcatccgtcctggagaccgtgaccttgacggtcaccttatcgttgtcatacttccaaccggcagcaggcttttcggtgtcctccgaagcctcgaacgtgtagaccaaattgtcagcaccggtcggaaccctgaacttcaggtccccattgccgaagccaaccgtcgcgctcgcgccgctagcagtcaattcgtccttggacacagtcgtagtcagtccattgttggccaagccggtaacgtcagcgcacttaccagcattcgcatccgtgctatccacgcacttcaggttgaagccgaagtccgaattagcagcatgtccctgcacaaccttcgtcaccttgacatccgaagcgggcaaggtcacgtaagaaggcgtgttggttaccgtgaaggcaccggattgtgcggtcaaaccttgtagcttgaggtcagtcttatcaaccttggagtcatagccttcaaccttgacctcggaaaccgagtatgtgtgcccctcagggccggcaggcaccgtgaactcgtgagtccagttgccggcggcattcagagttgctgaaccgttggcataatcctcgccgtcctgcttgagctggacctgcacggaatcattcgcgtgattctcgttgtcgtcggaccaggtcttcgtcaccgtaatcttggagaccggaagggtgatggtcggcttctgcgggtaggcggcggtctgcggatcgctcgtcgtcgtgccgccctgcgaggaggtcaccacggtcttgtagtcgacagtggcgctggagttgtcgttcgtgtagaagttgttgtcgccggaggcattggcatcgtccttgtggttcttaacagcctcgtcgaacgcagcctgcgtcggcttgacattgaagctcaccgtgtaggtgacgccgtcctcaagcgtgtcgtcgttggacatgaccggccaagacacggtgccatcagccgcaaccgtcgcctccggggcgtcatcccacgccgtgatctggccgttccgggtcttcgtgtacgtgaagcccgcgggctctccattctcggaggcgctgtcggagctcacgacccagctggacagcctgtcgtgaatcgtcacgtcggcatactcagccgtcttggtgatctcctgataaatggactcgaagatgttgttcagctggccggcatccgtggcggccttgtagtagctgctggtctcggcgcggtcaccgaggttggcgttccaagactttccccacaaatgctcactgctcgttgcagtggcatccgggtagttgctggagatgccgtgcatgtacttgttcaggttgctcgaggtgtcgccggggttggcaccgctgacgacgccgatcgagtagatggtcgtcccggcgtccttcaggctcttcgccttgttcaccgcggtggcggcgacggtggggtcaaacccgctgccgtggttcggctcgccgtcggtgaagaagatgacgaccttcttcgcgttggcgcgaggctgatacgttagcgccgcctgggcgcggttgaaggcgtagtcggcggaggtcgcgccggacgcgctcaggccgttaaccgtgctcgtcagtccggagacgtcgtacgtcaggttgctgacgatctgcgtgtagttgtaggaggaccagccttcgcggtaaaagtcattgccgacgctggtcttctcggtgccggcgaacttcaccagggcgatgcggttccgctggctctggtcggtaatcttcgcgttctctgcagccgtcgcattgatgaatttattgaccgcggtcttgagcgagtcaatcttcgtaggctggttccaaccgctagcgatcttttcggccatcgaaccggacacatccaacaccagcacgatgtcgagtggctggttcgtcacgatctcgcccgtacccgcgctcttcgcaccggtgacgttcaacgccaccgtgtacgtgccgtcttcattggcggtaacggtcttctcgcgggccggagcagacaacgtcggatcatccggcacgccgtttgttccctcggtggaaagaggagcaggcgcgctggcggccgccttctcatcggtggtctgcgattgtgtcgtggaggcattcccatcgtccgccatggcggtcgcgctcacgccggcgacgccgccaagcatcgctacggcggccacgacggccactagccgtttgccactcctgcccgctgcggcccctaccgctgcgaaccattctgcaattctcttcataaccttgcctgtctcttacgatcacgtacgccaaaacccggcgttacgcttataaggcgttacggtattaagcaaaaagcacgaatgcgtgcacccgggtagagggaattttttacccgacactgaaaagaaccttggaatttttgaaaagtggcaccctcgtcatccaccctgcgataacgcacttttcttctcgacggggcgtgccggtcccaccatctgggaactgaggcggatttgccgccgctgcgcgggggccggagttactgacgaccgtcagtatgccactgctccgcatgtgtgcagtatcacataccgctacgcatacacggagacatactacatgcaatttctgtgaacgcaaacatacgactcaccaaggccgtgttctgttgcgggcggtggtgttacgggcaatgttgtgggtagtaccctagccacaaacctatatagtggagcggatgacgggaatcgaacccgcgtaatcagtttggaagactgaggctctaccattgagctacatccgcgttaaacgtcgcttttggcgacttgagttattatacatatttcttcggggatggcaaacgcgtgtggctgcagcaggaccagcaaatctagttgatggattgcggctttgccgaggactcccctcagtcgcctacggcgacagctcccctcaaagaggggagctggaaaccgtcgaaatcacaaatggatgagctgggactcgtatggttggaggtcggcgcccatcgcattcagaatcacgaaccagcagttttcgggcagcgagtcgagcttgtcgatctggttcttgagcaggcgcacgtcgcggctggtgagcgcgccccacaggttaaccatgatggagacgttgtacagcatgtagcactcgggggcctcgggcgctattccacagaaatcgtcaccaccgcggaggcaatcgaaccatcgtggctcagggaaatatggatatgcggcatcgaccccgcaccgatagtcgagcgctgcgccgaacgcgcattccgccgctcctgcatcactgcataaggcccgttatcggaagcagaggaataagcagaggaatagcgagcgccggcagccgaattcgcgtaatcagtttggaagactgacgccgcccccttacccagagacacatgcggcacaccacgggaatcgtccaagatctcgatttcaggccacgggaaattatcaagcgtgaacggatagggggcatcgccaagataatcgcaccaggctttgaggaacgcctccttgcccgcccatttggcggccagatggacggcctccccgtcattcttctggcgcgcgcggtcggatgcctgccgcacctcacgcacggagaacagcgcacgcatgcgagaccccggctccgccaactgttcggcgaatgcggccacatccaccacgtcatgccccaaaccacaagtattcatgcttcctattgtgtaccgcttcgcgcgtaatctctacacctcatcagaattggggcctgatttccatttcagggggaaaagattcactatgctggatgacctcgcgcaataccgcaaacatcttgggctggctgcctagccgtccaaaaaaacatccgcgccccgccccgaaggtctatctccgtttcgaggggcggattttgaccgttccggaggtctacttccgtttcaaggggctggtcatcctccataccacgagtatccgcagcataacgccaacgccattccgccgtttttacgccttgtctacttgggtaacagccccttgaaacggaagtagacctccggcgaatgccaaatcagccccttgaaacgcagaaagcccactccgagggaggggctttcgtatgttctgcatatttctctcactgagtttgtgccagcgagaaagctccaggggaaactcccctcacccgcttcgcgggagctcccctcaaagaggggagccgagatccggtgcgctactggctcccatcaaccgaggggagccagaggaatcaggcctcgtagtagccgtcggcaccgaggcgggcgtccgggttgaggagcatcgccttttcgacctcgtggtggtcgtagccacggtgatcctcgcggaagcgacggttgtcgatcggctcgtagagcgcggcgcgacccatcatgccttcctcgaggtgacgctggccggcggccaggcgggcgttggcacgctcacgccaggcttccagcgcggcctcgccatcggccttggccacggccgcttcgaaggcacccggatgaaccagggccacgaagccggaaacatgtccgaagccgagcgaggtggccagaccggccttgaccgggcgaccagcggtctcgcgaccgaactcgtcctcgccaccgccgatgcgcaggggcttcctaacccagaccatgtggtcgtcgcgctggagcttcggatccacgcaatcgagcgctgcgttcgccggaatcacgccggacttgaacagctgcgtcagaccgttgacctggaagatgcaggcaccacccttggcgtggccggtaagcgtcttctgcgagatcacgaacagcgggttgccgtcggtgcggccgatggcgtgggccagcgtgttgtgcagctcggattcgttcgggtcgttggcgttggtggacgtgtcgtgcttggagaccacggcgatgtcgtcggctgagacgtcgagcttagccaggtcgtgcacgagcttggagtccttgccaccgaggccggcagccagggcaccgaggcccggagccgggatcgaggtgtgagcaccatccgcgtaggagtggatgaagccgaccacggccgcaaccggcaggccgagcttttcggcgatgtcaccgcgggtcacgaggatcgtgccgccgccctgggattccaggaagccgccacggcgacgatcgttcgcgcggctgaagaagcgcgcgtcgatacccttgccatacatttcctccgagttggcggtggcgttcatgttgccgaaaccgatcacggattccacgccgatgtcgtcgatcgcaccggtgaccacgaagtcggccttgccgagggcgatcttgtcgacgccttcttcaagggagacggccgcggtggcgcaggcggagaccggctgaatcatgttgccgtagccgccgatgtaggactgcatcacgtgagccgcgaccacgttcggcagggcttcctgcaggatgtcggtcgggatctcgtggttgaggaagcggtcgaggtacagcttgcgcatcgacatcatgccaccgaagccggtgccctgggtcgaagccaccagcgaggggtggatggactcgaggatttcggccggggtgaagccggcgcccaggtaggcgtccacagtggtgacgatgttccacagggcgatcttgtcgacgtcgccgaccatcgaggcgggaatgccccatcgggtcgggtcgaagcccttcgggaactggccgccgactgtgcgggtcatggtggcgcggcgcggcacgcggatcatcgagccggcgtggcgggtcacgttccattcgccggattcctcatccggggcgatggtggtgtgagcctcgtccagcttgacgtattcggtggcgacttcgcgggtgggcacagagaaggtgacgtcgtggtcgaggaagacctcggcttcctcttcgtcagcaccgtccttgtagtcgttgcccatgccttcctcgaacgggcggatgccggagcgggccacgacctcgtcgtggtagcgctcggcgatgtcctcttcgggcacgaggttgccgtcggtgtcgtaccagccgggcttcgggctgtcggcccaagtcagcaggcccatgttccacgcaagttcgagcactgcgccggcgctcaggtcgacggtgccgtccgagtggatgccgagttcggcctgggcgcgcgtacgaccggagccccacgggcccagctcaccgacggaaacgatgacgatttcgtcttccggcttggcagtgacgttggtccaatcgttcaagtcgaccggggcctgcttggtgacgatcggtgtgggcagcgccttgatttgctgcccacgcgaggagtcggacagtccagtggaccgtccggcgacggagccatccgtttcctgagacgaggccgcagcagcttccttctcggcgtcggccatggcctccgcacgcagggccttgatgtcgatgggctcggagccgaggccaccggtcaggtccacatcgagcggggccttgagggcctgctcgcgcgattcggcagtgcacaggtcgagcagcttggccgcaatctgtgcggtggagtaggtgcggatgccgtgacgttcaacgacggcgaccagcgggtcgttaccgcccatcaggccggtgccacgcacccagccgatcttcgggtgagcgaaggtgacgcggctcgaccacaccttttcagcgcgggcacggttgacgatggcgtcaaaggcgctcttgacttcgccgtaggcaccgtcgccgccgaatacgccgcggttcggggaaccgggcagcaccacgtggagcttgtgctgcacgttggtgtcggcaccgatgtggctgaagccggcgatggcgcgttccacgccccacagcatcagtcgggcctgcgattcgaacaggtcgccggagtcggcgagcgtgccatggaccggcggagcggcgaacgggaagaacagggtcggctcccacgcgggcttcagaatcgtggtggtagcaccggaggtcttcttctgctcgtggcccacccagtcgaccagtgcgtcgacgtcgcggtagctggagaggttggccggaaccagccacagcttggcgttgccggtagcgtgctcgcggtaggcctgcttagcccaagccttaatggacggcttgaagctgtgcgaggtggccaccacagtggcaccgcctgcgagcaggccttcgaccacctgagcggcaatcgagttcgggctcacgccggtgacgatggcgatatcattcgcgtaacgggaggcgttcttgttggacgcaacctgttcgagggcctcggagccggccttctggaagacggccttgagttcttcgctctccgactcgttggcgaaccactgggcttcggcggcgatggtcttgccaaggccgatgaagctgccgttcagggcggcgggatcgttgtcgtagtaggcgcgggcgaggtcttcgcgggcggaagcccaccgatcatcgaagaggatggccttgttggcgtcgaagcgcggagcgacctgcttgggccagtcggagccaagttcggcttcaaccgcggccacgacggcggcgttctcgtcctcggattcttccggagccggagcggccacgccgagctcgttcagcacgaagcgggcggtggcggcgagcacgccgttggaaccggtgaccttctcggcgaaggcgtcgagcgcggcggaatcgaccacagcgccaccagcggcaccaccggcggacggcagggccacggcaacacccttgagctgggcgacgacctcaacggccgcatcaatcagcttgtcggcttccggcttgttctgcacggcggcggtgggcagcttagccaggtcgccgccacgggagctggcaccctcgcgagtgtcgagcagcagtgtggcgagcacgctggccacccaaccttcaccgagctgccatacgttggtcacgcggtcgcggatgtactgctgcttgacgccggcggcaccgaacagcgagcgcaggcggtcgcgcagcgcctcggagagcacggcaccgaacggcttgtagttcggggcggccttgttgacgatttgggcgagcttgtcgagcgtcgcttcagcagcaccgtccacgctggcgactcccagctcggagctgatgtccatgagcagctggttgcggcgagaagagacaccgttggtcagggtgtcggtggtgtcgttgctgccgatctggtcgagacgcaccttggcggagtaggccatgagcacgccgatggcatcggaagccttgaagggcaggtcggcgacggcggcaccggacggtgcgccagccgcggcctgccctgattgcaggccgcgcgaggagtcggacagtccagtggactgtccggcgacggagccatccgttgtctgagcagcctcagtcacggcatttgccggagcggcaccggaaccgagcttggcaacggcggaaccaccggcaggagcggtttcgaccggggccgaggccgcagcctcttccggctcatcgtcgggaaccagcgaatcggtgtcggtcatgtagacgcggccttcatcgcggccgacgttgtagacgaccgtatcgttgccggcgaactcgggcagatgcagggtcttggcaccgaggttggccagggtcggggcgttgccgaggccgacttcgacgtattcttccacgccgaggccgccctgttcgcgctgaccgaagagcagcgcctgggtttcaatccaacgcaccggggaggcgaactgccaggagagcagttcggtcaagagcagacggccgagcttctggtcgtcatcggcgtaggaatcccacacggccgggtcgtcgagcgcggccttgatacgctcggacggcacgacttcgaggatcttggcggcgaattccttggtcatctcgaacggggtggccaccaggttcgggatgtagcggtccaccagacggccacggtagtcgatgtaagcgggaagcagcgcgtcgagcttgtcgcggaattccggcacgcccttgcgcagcagtgtggagtggaacggcacatcgatgccgggcaccagcatgaacgcgggcttgccaccgaatgcggccacgcggcgggcggaatcggccttcagagccttgagtccggcgatcgtaccggcgatggcgtactgctggccggcgaggttgtagttcacgatctccaggaattcgccggacgccttggccacggattccacgtattccttgacgtgcgcgtcgtccacaccgaactggttcgggcgcagggcacccatgcggtagttggagcgaccctgtgcgtcacgctcgatgaggtggtgcatggtggaaccacggtggaacacgagctccagcacggtttccagcggaatcacgtcggcgaacgcggacagcgcgttgtattcgccgagcgagtggccggcgaagtaggcgggccagatgtcggcgccggcttcgcgcagacgagcggtctgggcgaaggccacggtggcgagcgccacctgcgtgaactgcgtcaggttgagcaggccttcggggtggcgataggtcacgccgttggcggtgagctccttcgggttatcgcgcacgaggcccaggatcgagaagccgagcttggagcgggtgagcttgtcggcgcgctcccacacgtcgcgggcggcggcggacttggcacgctcgtccagaaccatgccctgcttctggatgccctggccggggtagacgaaggcggcgcgcggcgcgcggaccagtgcggtgccgcgggagacgagctggccgtcgatacggcaggtgacttcgagggtcatgccgccgtggcgcaccttgccgacgcgctcgacggagatttcgacggtgtcgtcaagctgaaccatgccgtacatgttgtaggtccagccggcaatctcgtagtgggcacccttctcgtccagcgcctgcacggcgtgctgggcggtggcggacagccacatgccgtgcacaagcggagcggccaaaccggagatgcgagcgccacgagtggaggtgtggatcgggttgaagtcgccggaagtgcgggcgaaggcggtcatgtcgtgtggggcgacgaccttcacgcggcgcagcagacggcgcggcgtgggcgcgatctcctcgtgctcggcgtcgccgaactcgggggcgtctgccggcaaagcatcggagtagacgcggccgcgaatcgcgaaacgctcggtttcgcgggcaagcagcgtgccgtcggcagcggtgtgggtcacgtggatggtgaccacgcggccggaggcggactcgaagtaatcctcagcccaagacttcagggtgatggtttcaccggtgtgcttaagcaggtcctcctcgttcacctcaagttcgatgaggtggtcgaggtggacggcgttgagcaggccttcaatcaccgggtagcccttgacgtacacggagccgagcgccgtgtaaatcgccggccaggccgggccgaccagcgcatcgggagcgatgcggctgggctgcagggtcgtcggcagagcggcgccggtggccgcttcgtggtcgaagccgaggttggcggagagggtgtaggcggcggtggcggtagcaaacggacgctcgtcagaggtcttgccgtcaagctgcggcatctcggtgagcttgtcgccggtgatggcggtgttgccgatgcctgcggtggcggcgagcatcgcgtagacgtccggaatcaggcgttcgcggtccacgaccggcacacggccgggctcggtgccttccacgatgagcgggatgacgatatcgcgcacggcgtgcttggaggtgccgccgtccgggtcgttgtcccagtaggtgtcgaggtggatgtccagatcgtacttgccggccgcggcgtcaaacgcgcggatctcgtagtactggtcgcccagggcggtgccgtaggcggggttgtcggtgatgtggccgacccaggagatgttcggggacttgcggatgaagtcctcggcgctggtggcctcgccgagtgcggcgaaatcgtcgttctcagcggcatcggcggcctgctgttcgtcctgcacgcgcttgatggcggcggtttcgaagcggccgaggatgtcggcgatcggctcgtcgatggtggtgatgccggccacggagatcgggccggggatggcacgcacggaatcggcggagtagcgctggtcttcggactgccagagctggtcctgaccccaccaacgcagcaggtcgttgtcgatgacgggcacgaacggcatgggcttggggtattcgcgcacgagcaccgggaaccaagccacgtcggccggaaccaccttaagttcggcggtctgcgggtaggccagtgcgagcttttcgagtgcgggggccggatcggcgagaatgtcgtcgtgggtcagcaggtcagcggcagctgcctcttcagcagaaacgccatcagcggcgaacagcttggaggtgaattcgccggagtccgtgtcgttcacacgggcttcgatgcgctgcagcaggtgctggaagcggtcggcgtaagtcgggtcggcccacgggaaggcgagttcggcgaagcgctgcgcccactcaaggtaggtcatggaggccaggtctccgaagtaaggcttggcggtcttgttcagggcttcgatgatttccttgcggcgggagtcgagctcttcggggtgcttcatgacgcgcacgagcagacggccgcattcggcggagtcgttctcgagctcgtaaatgtcggcgtgcaggtggctcaggccggaggacatgccgccgacggacttgccggacggcacccagtgggcggcctgcggggcgaacacgtcgtcggacttggcgtcggccggaatgccgggcgtcttgacgagcagctgcttgacttcggggctggtgtgagcctccttggcggtcatcgcggcggtaccgataagcacaccgtcgaccggcatgtcgggcaggccgtaggcgtgggcccactggccggaaatgtagtcggcagcgcgttcaggggtgccgatgccgccgccggcgaccagcacgaggttgtcgcaggcgcgcacttcggcgtaggtggcggcaagcaggtcatccagcgcttcccagctgtggtggccgccggcttcaccgccctcaacctgaaccatgatggtggtgggggccacggccttggcgatacgcacaacctggcgaatctggtcaacggtgccgggcttgaagctcacgtacggcaggccgtcagcctgcaggttcttgatgagctccacggcttcgtccagctcagggatgccggcggagacgaccacgccgtcgatcggcgcgccggatgtgcgcttcttgggcacgatgcgggaggagccgaactgcaggttccacaggtaacggtccatgaacatcgcgttgaattcgaccgtgcggccttcctccagctcgtcttcgagggcagcgatgtggcggtcgaatacttcggcggtcacctggccgccgccggcgagctcggcccagtagccggcgttggccgctgcggccacgatttccggttccacggtggtgggggtcatgccgggcagcagcaccggcggcttgccggtgagcttggagaacttggtgaccagcttggcgccggccggggtgttgatgacgcgcggggcgaacgccttccagttctgggtgcgctcaggctcgctttccagcatggagagcgtggagcgctcggccagcgtggtggcttcgaccacgccgatgccggtgccctgcaccacgttgccgatcagcttgccgagcgtgttgccggggccgaggtccacgatccacagcttggacgggtcggcgtcgtcgaacagcgccttgacgcgggcgttccagtccacgtggttcaggagcacttcctcggcgagtgcacgggtgcgcttctggtcgaagccgcaggcgccggcccaggccacggtctgttcgacggcgtcggccatgagcggcgagtggaagggcagggtgacctcaaggtattcgagggtcgggttgaacacggtgccgccgtggagcttctgctcgcgcagcttggcctgatgctggtgttcgcgctcggcttcgagggcgaaagcggccaggtcttccgggtagccggacagcacgtggtggttgtcggagttggtgacggcgatggagatcgggccgcgagcgttgttgacgcgggccaccagagcctcaacctgttcgcgggtggcgcccttgacggagagcatcgggctggcttcgccgtacttggggttcaggcccagttcgcgcacgcggcgggttccggcggcgccgatcagggcggccacggccagaatctcgttgagggtcttgccggcggcctcgatggagccggcggcctcgatggcgcgggtcatgtgcacggcgagcacgccctgggagtggccgagcacggcgagcggcttggcctgggccacgctgtagccgaggtgttcgaggtcgagcagggcgccgagctgggtcagtgccacgccttccacggacgcggtggcgtcggctgcggcgccgaggcgtgccgggttcggggcgaagccgaacaggtcgaccggacggccggtggtggccagcaggtcggcggcgaccggggtgagcagtcggccggctgcggcgacgtggccgcgcagggcctcgtcaaggctgggatcggtggtctggtctgccagggctaccggccacggggtggactggccggcgaaggcgagcgcatggggctcggtggctaggcgattgaggaagaaggtggtcattgctttccttacttgtgtttggttgacgtcttcaaaaatcagaggggctggttgccgtggtgtttggtggtgcgcttgacgcgccgcttggtggcgagcgtggccagcgattcgacaatcacctcacgggtctgttcggggtcgatcatgccgtcgatctgcccgatttccagtgacaggttcgcgttgacggtgctggtctcgtactccttgatgtacttggcccgcagcgcatcgacgtcctgtccggaggccttggccttggccaggtcgtggcggtggatgatgttcaccgcgccggccgcgccgagcaccgcgatctgggaggagggccacgcgaagttcaggtccgcgccgatggccttggatcccatcacgatgtacgcgccgccgaacgccttgcgcaacaccacggtcaccatcggtacctgtgcgttggcgtaggcgtagatcaccttggcgccgcggcggatgatgccggcgtgttcctggtcggagccgggcttgtagccgggcacatccacgagggtgaccacgggcaggttgaacgcgtcgcacaggcgtacgaatcgggcgactttctcggacgagtcgacgtccaggatgccggcgagcacgttcggctggttcgccacgatgccaaccggcttgccgtcgatgcaggcgaagccgacgagcgcggaggcgccgaacagttcctgcacctgcacgaattcgccgtaatcgacgatgcaacgaatcacttcgagcatgtcgtagggctgacgttcgttggtgggcacgatggtggcaagtcgcttggcggtctcgcgttcggcgcgggtgacggcgtaggcgtagaccggcggcttgctttcgctgttggacggcaggtaggcgagcacggtgcgcgcatagtcgatggcgtcggattcgtcctcgccgaggtagtgggccacgccggacacccggttgtgcacttcgccgccgccgaggtcggccatggagatggtctcgccggtcgaggccttgaccacgtccggtccggtgacgaacatgttcgagttctcacgggtcatgatgatgaggtccgtcagggccgggcagtagacggcaccgccggcgcaggggccgagaatcaggctcagctggggcacgaagccgctggcctcgcaagtcttgcggaagatgcggccgtactgggtcagggcggccacgccctcctggatgcgggcgccgccggagtccacgatggccacgatcggcactttgaggtcgatggccatgtccatcagtcggcagatcttctcgccttcggcggtgccgagggtgccgcccttgacggagaagtcctgggcgtagacggccactttgcggccgtagacctggccgaagccggtgatgacggccgcaccggcgttgccgccggcgatattgccgccctggaagcggccgatctcctcgaacgtgccggtgtcgaagagcaggtcgaggcgttcgcgcgcggttttcttgcctttggcgtgctgcttgtcgcgggcgcgctcttcggcggcgcgggccagttcggcggccttggccacagcggtgcgcagcggctggtgggccgaaggctgggcggcgttggcggccgaggccgcagccgcggccttcacggcctgcgaatccatgatgtcagtcattgccaccctccttcttggcgtcggtggccttatcggctccttctgacgagggagctgtcgacgcagccgcctgagggagagatcccggcgcagccgcagcagccttggccttgccggcgttcacgtccagcgtgaccagcgtgtcgccggcctccacgccgtcggccgggccaacgaaaatcttcttcacttcgccggcggccggcgcgtacacgtagttctccatcttcatggattcgagcaccaccagaaggtcgcccttggccacttgctggccttcggacacgttgatgcgcgtgaccacggcctgcatcggggaggcgatgacgccggatttggcgccgtcgttggccgcagcggcactggaggccacgttgtgcagtcccgcaccgcgcaacggctgggtgggtcgcttggcaccgcgggcgcgggccgagccggtgatgttctccacgatgtcgagtggcacggtgagcttgacgcggcggttgttcatctcgatgacgaacgtctccgacttggacttgtcgggcgcggccggggcagcggcacccggggcggcggccaaggaggccggctggccggaggcggcggaagccggtgtgcggttcaggtacgtgcgctccagccacttggtggacacggcgaacgggtggccatgctcggcggtgaagtcgtcgttgcggaagatttccttgaacagcggaatcggcgtgggcacgccttcgatcacgagctcgtcgagcacgcggcgcacacgggccacggcgtcgagacggttctgggcggtgacgatgaccttgcccatcatcgaatcgaacttcggggagatggtgtcgccctgttccacaccggtatcgatgcgcacgccggggccggccggccactggatcttctccaaggtgccggagccgggggtcaggttggtggccgggtcttcgctggtgatgcgcagttcgaagctgtggccgcgcagttcgggggcgcgggtgagctcgccaccggcggcgatattgagctgttcgcgcaccaggtcgaggccgctgacctcttcggagacggtgtgctccacctgcagacgcgggttgacttccaggaagtacactttgccgttcggggtcaccatgaattcgcaggtgcccaggcccacgtagccgaccgtggtgaacaggcggcgggagtattcctcgagcgtgctgatgatttcctcggacaggaagggcgcgggtgcctcttccacgagtttctggttgcggcgctgcagcgagcagtcacgggtggagtacacggtgaagttgccgtgcgagtcgcgcccggactgggtctcgacgtggcgtgccttgtccacgaacttctcgatgaagtattccttcagatcgccgccttgcagcgcgtcgtggttcatgtagaagcggcgcagctcctcgtcgtcatgcaccacggtgatgccgtggccgccaccgccatcagtgcgcttcatcatgatcgggtagccgtgggtgtgtgcgaagtcgagcagcgtgcgcacgtcggtcaccggttcggacaggccgggcactggcggcactttggcgcgtagggccacgcggcgggcggtaatcttgtcgcccaaatccaccagcgcggtgtggtgcgggcccacccagatggcaccggcatcctcgaccttctgcgcgaagctcggcacttcggaaaggaatccgtagccggggtgcacggcatccgcaccggtcttgtgcaggatgtcaatcagcagatcttcgttgaggtacgtgtccttgtaggtgtcgccggagagcaggtatgcctcgtcggccatgtccacatagcggctattgcgatcctgttcggagtagacagccacggtggagatacccatctccttggccgtgcgcaccacgcgaagcgcaatctcgcctcggttcgcaatcagcagttttttgacgatagaagccatagtgtcaaattgtgctctctatatggaggagagggcaagccgcgttcacacaaaagctttcacgcccttttgtaggctacgaacaaacgcgcgcgtaggttccggcaacgtaaccgttggcgcctgctatcaaaaacgttgcaaatccgccgattgcacatccttgcgcgccggctcaagaagttgacgttacggttgtgttcgtcaacttatgacaaatcgaaatcgacaattttgtaaattggtacgaaaccgcacgaaatcgaacacctctacgatggcaaccgtaagttcgggggaaggctcatctgcgggcgaacggaaggtgaccggaccggcatcggtccatcgccgcacgattcgcccgcacagggtcggattcatttgggaccgtccaccatatggacggttcggactgtcggggataccgcacgacccgccggaacctcccctcatccatcgcataccgcccgccgttcacggcgatatcacgcaacataggggtcattgatatgcagacttcacacaccaccgcatccgctgcggccaccacatcgctcgcccgtcgtatcgtcgccgcatcctggaagccggtgctgttcgccgtgctgatgtggctgtccgcggccgccggcgagattccgattccgggcacgccggtgccgatcacgctgcagacgttcgtggtgatgctcgccggtcttatgctgccgtggcgtcaggccggcgccgccgtcgccacctatctggcggccggtgcggtcggcctgccggtgttcgccggcggcacctccacgctggccctggtcggcccgagcgccggcttcctcttcggcttcctgccgggtgtggtggccatcgccctgctgcgcggcaagtccgacacttcgtccttcgcggccgccgcgcgcaccgcgggccgctacctgctggccgcgctggtcggcggcgtcgtggtggtgtacgccttcggcttcgtcatccagtccgcgctgaccggtgcgccgctcgccgccgtggccctggcctccatgggcttcgtggttggcgacgccatcaaggccgtggtggcctctctggccgccgccggcctgtccaagctcggtcgctgacctgagctactagctagctactggccggctattacagcactcccacatcggcggtgcggaccgtatggtccgtgccgtcttgtgttctcaggatcagtgaggcgtcttcgttgaggccgatggcttcgccggtcagcgtggtgccgtccgtgaagtgcgcctcgacctgacggccgcgcgcccagcacaccgccttcacctcctcgcgcaacgactcggcctggcccttcgggtcggcgatgaacttcaccaaccgctcgcggaagccctcgacctgacgttcggccaccgcatcgcgcatctcgccgaacgacggcagcccggagacatgcagctgcagcgaggtcgattgcggcgtgggcagccgacaggcgcccaaggccaggttcaggccgacgccgaacacgatgacgacgtcgtcatcggcatcagcatcagtaccggtaccggacgacggcggaatcaccagttccgagagcagcccgcccagcttgagcccgtggcagaacacgtcgttcggccatttgagttccagcgagcagtccggctggttcggcgcggcaccgtattcctcgatcatgccgttcagggcgtccagcgtgaccagtccggcgatcatctgcagccagccattgacggattcgtcggtggcgatcgcgcgcggaatgcgcacggcataggacatcgtcgagcaacggccgggctgactgacccacttgtgaccattgcgcccacggccggcggtctgccggtcggcggccaccacggccaccgccagttcgccatcctggtggtcgggcaacgtcaacgacccgtcgccaatcatctgtacggccagcgcgttggtcgaatcggtttcgtccacggcgaccacatgatctgcgacggctgtagttctgggtagctgcggcgttgcagctttcaacgcaatcatcatgggcactacgttacctcgattttggcgcgatatgcccgcgttattccatggaaaagcgcgcaaaatcaactattttcacccacatagcccatgttaacgttcacaacttcggaaattccgcattcgccgaccccacgcatgcacccggccgtcatattggcttgcgaacaacggcgatgcccggcagacatcgaatatcaaccgttgacctgtgcggctaccatatattgtcatgacgtcaccagccaccgcgaagcttgccgccgtatccagccgccagtcccacccgcatcttgcgcgcgcgggcgctgccgcgcgctggacactggccgtgctggccggcctgtggcttgcactgtgcacggcggtcggcccgctgtactgggacgaggagaacggcaccctcgcccattggaactgggccaataccgcaatattcgtcgtgtcattcctgatatatctcggaatcatcacgctgatggtgcgattcgcagcaggccagcgcatactgccgagggctatcggcgagcgactacgtcaacatcagcggaatagcgaaacatcacggcccgccgccgatcagcaggccagccaaccagccaagacccgtcgtaccgttcgcgctatcgtcacgtccaccgtcactgttctggaccgctggatcacacgcggcacgaaccggttctggaagcttatgctggtgttttttgtcggctggctctgggtgccgaccactctgctggccgcattcggtgcggacctccgctcacagatccgtgaattcagctgggcctggaaccagtggaccggcctgaaacagccctatatcggcttcttctccttcgtgccgatggacatctaccccactgcgcactacatgtggccgtccgatcccacgtatctgaccgaccagcacaatgtggtactcactgtgttctatggcgcgatggtcacgtttgcgaggcatctgaccggctcaaacgatgccggtatcgtgacgttggctgccctgcagacgctgttcgccgtgttctgctgcgctgccgccgccaatcgattcctgaaccggccttggataggaaaaacggcaacggattccgccgctcccccacaggccggaggattggctcgattcctgattctgctgttctttatggtctgcccgctggccgtgttttccactatctccatcaccaaatcgccgctgttcgcgttctcgttcgtctggtggttcagcgtctggtatgaactcgtccagacctggcaccccgccggcacccgcaaacatcctcagacccctgccatcgccacgcccgtccacttgccgcgtcacagtttcatcgcctttatcctggccacgtcggtgatgctgatttccgcgaaatatgcgtggtacatcatcgctctgcaaatcgtgctggctctgatcgccgaccgcaagcgctgggcgacttacgtcgtggcgctgctcatccccaccgtactgattcacggcggcatctccttcgccatctcctctggtgcgatcatcggcggcgatccaatcgaaagccgcggcgtacagctgcaaatgatcgcccgcgtggctcagcgcaatccggacggtatttcagacgaagccaaaaagaacctcgcgcccgtcttcaatctcgatcagatggccgacgcttactcccagcaggatgccgacccggtgaaatcctccggtattcaggccaagaaggtcagctacaagtggcgcacggtgacgcccgaggatatgaccaatttcaacaaggcatggttcgaaatcgtcaaggacaatccgatcatcgcgctggatgcgttgctggccaaatgcttcggatacttcaatgtgaacgatcagccgtacgtatcgatggattattacgtggccagcgattacgtgcagaaaaactccacatggatcaaggattacaaccatgactggcgtgagcacatcgccggcttcactcgcgtatggggcggtattcccgtgctcggctggcctacgcacggcaatttctacgtggtgatgacattgctgatcggcgcggccgaggtgattcgccgacgttggctcaccctcatgacccatattccgctgctactgctgatgggcgtgatgattaccgcgccggccaataatttcgagcggcacatgttgccggttgcgtttgtattcggattcgtggtgctgacgtattggcgagagtctttggctgaaaggcaacgccaatcagcgacgctacactagtgactatgtcagattttctcgaacttcttgctgccgacgttgccgattcgtccgcacccggcatcgccgcgaccaaccgcgtacgcaccgtgctgttcgagtgcctgttcaatcatctggccgacgaacgagtggagtccctgttcaccatcctcggcttcgagcatgacttcgattgttacgccatcgccggataccctgcccggtccgccgcacgtacggccaaggaaatcgagaaaatcgtagccgatttcggcggtgtgtgtctgaccgccaagcgcccgatcggcaacagcaccgccgtagtggcgttgattcgtccggtcggtgcggccacgccggaaatcatctgcaataccatcgacccgtcgttcgccgccgatcggccaatcgccttgggtccgcagcgtaccggtgccgatggcgcgatgcgttcgattcaggccacgctttactgtcttcaggccgcgccggctctggccgccaccgtgcagccatcgccgcgcccgttacgcaccgacgacgccctgcccgaacgtgcgttgatcggcgacgcggacgcccgtgacgaactggtccgcgtggtctacggaagcctgacagcagcaggcccggatgatccgacgctgctcaccgtctccacattcctgaagttcggcggttcgctcgagaccacggccaaggagctcaacgtacatcccaatacgatccgctaccgtttgaagcgcgccgccgaatccaccggctgggatgccaccgacccgcgcgaggcgtacgtgctgatcaccgccatcgcgctgggtcgtgtggccgaagcgcagcggaccgcagcgtagtcgggcagaagcataaccagcagaaccgtagccggcaaaggccatagctgaccgggcataaccgtccagcccgacagcctagcgggccgaatcaggctgcctgaatctcgtgtacgccatcgtgcagtaacgcggccaaggattcttgagtggctaacacttcgtccacgaatccaccggcggacaggctggcgatcacgcgaccggactcgttgtccacaatcggtacaccaacggcaccgacacccaacgtcacatcctcatccgacagtgcatatccacgttcgcgagtcaagcgaatatcctcgcgcaactgttccacactgaccagcgtgttctcgttatatgccgggaacggcgctcctgcaagatagcgttcggcatcggcatcctcgaaatacgccaaggccacgcggccggccgcgccagcatgcagaggcagcacgcggcccgggcgcaggatcagcgaatcgatggcatgaccttgcgcgcattccacgcataccaattcagtgccggagaccacactgaggaatgaggtcatgccggtttgcgcggtgatggcatgcatgaccgcaatcgcaggctgccattcggtacgagacgtgcgagcggcatcagccaatcgcagccagtccagtgataatgagtagttgccatccgtatccgttacggcccaccccacatcgaccagtccatccagcacgcggtatacggaggatcgcgggatatcacaggcgtcggcgatatctgccggagacaggccattctccgccgccaatgcgtccatcacacgactcgccttgtctaaagcgcgggtcggttcacgtttgtcttccgccatcgccgacgttccttccccccccctgacttatccctgactcatcgtattcaactgttcaggccaagataatcaccactgtatccaaggcctcgcgacacctcgcggccggcagtctgcaccaattgcaccatgtcttgagccgatgccgttgccggtttcccatctaccagacaggccagctcaggttccaaggagcgggaaaggctactcagggcgattgccgcttgaatctctccggcgtgattgaataccggtacgctgatagtcacggagccggccatggtctggccgacgtcataggtgaagccgcattcgcgtatatgacgagcctgtcccattgctgtggcacgcatcgtggagaatgtgccgccgagctcgttgttataggcatagtgttccaacagctgctcgtagcgagccgggggaagccaggccgtcagtacatgagagggagcgctcatgctcagaggcaagctattgcccaccagctgtgcatagctttgcaatgcctcacgggtgcgtgtctcgatgcacaccgtgcgcaatcgcctccgaacgaacagaccccagatgccgaactggccgcgatgggcgcggaaggtacggcgagcgatctgctgaatgtccagtctgctttcgatttggccgccgatacgtacgcaatcgatgccaagccgatactcgccacgattgatgccgcgttccgcccaaccgactgcggcgagattatccagcaaacgatacgttgagcttacgggttcaccagtacgttcgcttatggtttttgcggtgcttggccccagttccgccaatacatcaagtactgccttggatttcaccaatgcatctacgcttcggtcatcacggcttgacgccaccatgcgcgtcacctcctgacctgtttgttgatacctcagccatcttaccgggtattcagcgggttgccgcccaaaacgtactgggccccggcaggagtatcccgtcggggcccaagaggtttctggctcccctctttgagggggagccgtccgcgcggcggaccgggggaggcccgagacgctaaggcccaaggacgcgagaaacaccccgacgcgcgggtgtcctgatatggggaaagccccttggggcgtgtgctccgaggggcttcctgtacgtgtgatgcggcggcgtgctactctcccacaccctgtcgggtgcagtaccatcgccgtgccaggccttagcttccgggttcggaatgggaccgggcgtctcacctgagccatggccgccgcaaatcttctcttgtacggtcagacgctggggtctgccggcctgtggcggcctgggaaccggacagcggacgcggatatgtcgatgtttcgtcttgtggccagacaatgctcattgccgtctggtgtcgtttgcaggaggaagatgcggtccaaccgccaggggttggaatgttagtgttgcctttcgtccgttagtaccggtcggctccacccctcgcggggcttccacgtccggcctatcgaccacgtgttctgcatggggactacaggaactcgaaggttccacggaatgcttatcttggagcaggcttcccgcttagatgctttcagcggttatcccttccgaacgtagccaaccggccgtgccactggcgtgacaaccggcataccagaggttcgtccacccaggtcctctcgtactatgggcaggcctcctcagcattccaacgagcgcagaggatagagaccaaactgtctcacgacgttctgaacccagctcgcgtgccgctttaatcggcgaacagccgaacccttgggacctgctccagccccaggatgcgacgagccgacatcgaggtgccaaaccatcccgtcgatatggactcttgggaatgatcagcctgttatccccggggtaccttttatccgttgagcgatgccgcgtccgtacaccggcaccggatcactagtcccgactttcgtccctgctcggaccgtcgtcctcgcagtcaagcccgcttgtgcacttgcactcgccacccgattgccaaccgggctgagcggacctttgggcgcctccgttactctttgggaggcaaccgccccagttaaactacccgccaggcactgtccctgaacaggatgactgttcgaggttagacatccaatgcgaacagagcggtatttcaccttacggctccgcgcgatctggcgaccgcgcctctcggcctcccgcctatgctacacaatccacaccgaatgccaataccaaggtatagtaaaggtcccggggtcttttcgtccttctgcgcttaacgagcatctttactcgtactgcaatttcgccgagctcctggtcgagacagtggggaagtcgttacgccattcgtgcaggtcggaacttacccgacaaggaatttcgctaccttaggatggttatagttaccaccgccgtttaccggggcttgaattcaccgcttcacccgaaggctgacggatcctcttaaccttccggcaccgggcaggcgtcagtgcatatacagcggcttgcgccttcgcatgcacctgtgtttttggtaaacagtcgctaccccctggtctgtgccacccccaaaagctcccacagcaagtgtgttcaccatcgggggtctcccttaaaccgaaggaacgggagtgatttgccgagttccttgaccaggattcgctcgatcgctttggtattctctacctgaccaccagtgtcggtttggggtacgggcggctttgagcctgacgccgaagcttttctcggcagccgggatcaccggatatcgggccataaggcccccatcatcgcacctcggacccatgcgggacggatttgcctgtcccacgccctgcgtgcttgaccacggaagaccacctccgcggccggctacccttctgcgtcactcctgcgctgacctactacaaggatcggtcccaacaggccagggcatcccgcccccgaaggagcagtaagcccggacccggaggttagtactccaagcctcggttttggcggctgaaagccggtacgggaatatcgacccgttcatccattcgactacgcctgtcggcctcgccttaggacccgactcacccagggacgatgaacgtggccctggaacccttggtcatccagcggacgggatcttcacccgtctctcgctactcatgtctgcattctcactcccatgaagtccacggcgcgttcacacggccgcttcgcccctcatgggacgctctcctacccagtacaaaatactgccgcgtcttcggtggtgtgcttgagccccgctacattgtcggcgcggaaccactagaccagtgagctgttacgcactctttcaagggtggctgcttctgagccaacctcctggctgtctatgcgactccacatcctttcccacttagcacacgcttcgggaccttagacgacggtctgggctgtttccctttcgacgacgaagcttatcccccgccgactcactgccgggatacgcgtcaccggtattcggagtttggttgctgttggtacccgatacgggcccgcaagcatccagtagctctacccccgggacgtaatgacccgacgctgcacccaaatgcatttcggagagaaccagctatcacggaatttgattggcctttcacccctagccccaagtcatccccccggttttcaacccaggtgggttcggtcctccacgcggtcttacccgcgcttcaacctgctcagggctagatcatcccgcttcgggtccaggacacgcgactcaaacgccttttaagactcgccttcgctacgcataccccacacgggttatgctcgccacatgccactgactcgcagactcatttttcgataggcacgccgtcaccccacaaaagggctccgacggattgtaggcgcacggtttcagagactgtttcactcccctcccggggtacttttcacctttccctcacggtactcgttcgctatcggtcagacaggaatattcaggcttacccaacggtctgggcggattcgcacggggttccacgggacccgtgctacttgggagacgcgatcggcagaccatgcgcgttcaggtacggggccctcaccctctgcggcccggtattcaacccggttcccctgacacatggttttctgcaactgccggccggcccgtcggagccggcgcacgcgatcccgcaacaccccgcgcgcaacccccgacgggtatcacacgcgcaaggtttggccatcatccgctttcgctcgccactactcacggaatatcctttcctgcaggtactgagatgtttcacttccctgcgtaccccccggccgaagccggtaccgacccatgacggtcggtgggttcccccattcggaaatcctcggatcaaagccctgttggcggctccccgaggcatatcgcagcctcaaacgtccttcatcggtcctgtctgccaaggcatccaccatacgcccttgcaagcaacacacaccacgaaagtgcatggccgcaagattcctctagcaaattcccagacgacaaatcatcacactaaaaatgatcacaaaacgatcgaaacgaacaatagagttcgattcgaaatcaacagcaaaacaaagattcaaaaacccttgttttgctcgcgtccactatccagttctcaagccaccacgcaccgccacgccatcgcgccggcacacggccggcccccaggcacgacgggcatcgaatcgcgccaggcaaaaagcctggggtggcgatccgggagcccaaaagcgcatccataccaccccgcacccaccgcacgaccggcagggcaaagccaacgacgtcttccacaccagcaaccccgccgccatcgcaccatgcgacgcgcggggcgcacaccgtcggacgaacatccgactgaattctccgtagaaaggaggtgatccagccgcaccttccggtacggctaccttgttacgacttagtcccaatcacgagcctcaccttagacggctccatcccacaaggggttaggccaccggcttcgggtgctgcccactttcatgacttgacgggcggtgtgtacaaggcccgggaacgcattcaccgcgacgttgctgattcgcgattactagcgactccgccttcacgcagtcgagttgcagactgcgatccgaactgagaccggttttcagggatccgctccgcgtcgccgcgtcgcatcccgttgtaccggccattgtagcatgcgtgaagccctggacgtaaggggcatgatgatctgacgtcatccccaccttcctccgagttaaccccggcggtcccccgtgagttcccggcataatccgctggcaacacgaggcgagggttgcgctcgttgcgggacttaacccaacatctcacgacacgagctgacgacgaccatgcaccacctgtgaacccgccccgaagggaagccgtatctctacgaccgtcgggaacatgtcaagcccaggtaaggttcttcgcgttgcatcgaattaatccgcatgctccgccgcttgtgcgggcccccgtcaatttctttgagttttagccttgcggccgtactccccaggcgggatgcttaacgcgttagctccgacacggaacccgtggaacgggccccacatccagcatccaccgtttacggcgtggactaccagggtatctaatcctgttcgctccccacgctttcgctcctcagcgtcagtaacggcccagagacctgccttcgccattggtgttcttcccgatatctacacattccaccgttacaccgggaattccagtctcccctaccgcactcaagcccgcccgtacccggcgcggatccaccgttaagcgatggactttcacaccggacgcgacgaaccgcctacgagccctttacgcccaataattccggataacgcttgcaccctacgtattaccgcggctgctggcacgtagttagccggtgcttattcaacgggtaaactcactcacgcttgctccccgataaaagaggtttacaacccgaaggcctccatccctcacgcggcgtcgctgcatcaggcttgcgcccattgtgcaatattccccactgctgcctcccgtaggagtctgggccgtatctcagtcccaatgtggccggtcgccctctcaggccggctacccgtcgaagccacggtgggccgttaccccgccgtcaagctgataggacgcgaccccatcccataccgcgaaagctttcccagaagaccatgcgatcaactggagcatccggcattaccacccgtttccaggagctattccggtgtatggggcaggtcggtcacgcattactcacccgttcgccactctcaccaccaagcaagcttgatggatcccgttcgacttgcatgtgttaagcacgccgccagcgttcatcctgagccagaatcgaaccctccacaaaaaaacttcatgaaaagcatccgaatagatgactctcaaaacaaaaattgacgagcacgtccttaaggaaggacgccctcaaaaaacctcacccctcatcaaaccctcccgggtacccgaccaccacgacaggcaatcaggcgaggaatgaactggcaatcattgactataaagaagtagtacaaacacgctcttgagttctcaaaccaccaccactcacccacctcgcagctccccggaggagaaccactcgctgagcggcagcaagggaataacttacacgcattcacggactcgcgcaaatcgggcgcacgaagataagcccaaatcgttgaaacgacaggcttcgctcggcgtgtcgaaatcgacgtttcgcacgtctatatcttcagtctagaactagatatcgtcgaaaattggattgaaaattttggtcgatgggcgtgtcgcgaattacctcttacggcgcatgtggtgcaccgccaattatcggaatcatcattgatccagtacaccgataagaaccattatgttcggattactatctgctcgccagtcgtgcgccaatcaaccgcctggtagcgatgcggttgccgtaccgcttgccttggcacgaccaacgaccgaatggcatcagcacattcagaaccgccggtccgatccatgcatcgcagcacagatcagtcgtggtcccacgggtatggggaggccccgttgccgtgtgggtgccggaggtgtcctgtttgtgtccgggcatgcgagaagccccgggtgtttttgtgggggtgtgtgggtttgggtcgtgagtgtttcgggtatgcgaaagccccttggggcgtgtgctccgaggggcttcctgtacgtgtgatgcggcggcgtgctactctcccacaccctgtcgggtgcagtaccatcgccgtgccaggccttagcttccgggttcggaatgggaccgggcgtctcacctgagccatggccgccgcaaatcttctcttgtacggtcagacgctggggtctgccggcctgtggcggcctgggaaccggacagcggacgcggatatgtcgatgtttcgtcttgtggccagacaatgctcattgccgtctggtgtcgtttgcaggaggaagatgcggtccaaccgccaggggttggaatgttagtgttgcctttcgtccgttagtaccggtcggctccacccctcgcggggcttccacgtccggcctatcgaccacgtgttctgcatggggactacaggaactcgaaggttccacggaatgcttatcttggagcaggcttcccgcttagatgctttcagcggttatcccttccgaacgtagccaaccggccgtgccactggcgtgacaaccggcataccagaggttcgtccacccaggtcctctcgtactatgggcaggcctcctcagcattccaacgagcgcagaggatagagaccaaactgtctcacgacgttctgaacccagctcgcgtgccgctttaatcggcgaacagccgaacccttgggacctgctccagccccaggatgcgacgagccgacatcgaggtgccaaaccatcccgtcgatatggactcttgggaatgatcagcctgttatccccggggtaccttttatccgttgagcgatgccgcgtccgtacaccggcaccggatcactagtcccgactttcgtccctgctcggaccgtcgtcctcgcagtcaagcccgcttgtgcacttgcactcgccacccgattgccaaccgggctgagcggacctttgggcgcctccgttactctttgggaggcaaccgccccagttaaactacccgccaggcactgtccctgaacaggatgactgttcgaggttagacatccaatgcgaacagagcggtatttcaccttacggctccgcgcgatctggcgaccgcgcctctcggcctcccgcctatgctacacaatccacaccgaatgccaataccaaggtatagtaaaggtcccggggtcttttcgtccttctgcgcttaacgagcatctttactcgtactgcaatttcgccgagctcctggtcgagacagtggggaagtcgttacgccattcgtgcaggtcggaacttacccgacaaggaatttcgctaccttaggatggttatagttaccaccgccgtttaccggggcttgaattcaccgcttcacccgaaggctgacggatcctcttaaccttccggcaccgggcaggcgtcagtgcatatacagcggcttgcgccttcgcatgcacctgtgtttttggtaaacagtcgctaccccctggtctgtgccacccccaaaagctcccacagcaagtgtgttcaccatcgggggtctcccttaaaccgaaggaacgggagtgatttgccgagttccttgaccaggattcgctcgatcgctttggtattctctacctgaccaccagtgtcggtttggggtacgggcggctttgagcctgacgccgaagcttttctcggcagccgggatcaccggatatcgggccataaggcccccatcatcgcacctcggacccatgcgggacggatttgcctgtcccacgccctgcgtgcttgaccacggaagaccacctccgcggccggctacccttctgcgtcactcctgcgctgacctactacaaggatcggtcccaacaggccagggcatcccgcccccgaaggagcagtaagcccggacccggaggttagtactccaagcctcggttttggcggctgaaagccggtacgggaatatcgacccgttcatccattcgactacgcctgtcggcctcgccttaggacccgactcacccagggacgatgaacgtggccctggaacccttggtcatccagcggacgggatcttcacccgtctctcgctactcatgtctgcattctcactcccatgaagtccacggcgcgttcacacggccgcttcgcccctcatgggacgctctcctacccagtacaaaatactgccgcgtcttcggtggtgtgcttgagccccgctacattgtcggcgcggaaccactagaccagtgagctgttacgcactctttcaagggtggctgcttctgagccaacctcctggctgtctatgcgactccacatcctttcccacttagcacacgcttcgggaccttagacgacggtctgggctgtttccctttcgacgacgaagcttatcccccgccgactcactgccgggatacgcgtcaccggtattcggagtttggttgctgttggtacccgatacgggcccgcaagcatccagtagctctacccccgggacgtaatgacccgacgctgcacccaaatgcatttcggagagaaccagctatcacggaatttgattggcctttcacccctagccccaagtcatccccccggttttcaacccaggtgggttcggtcctccacgcggtcttacccgcgcttcaacctgctcagggctagatcatcccgcttcgggtccaggacacgcgactcaaacgccttttaagactcgccttcgctacgcataccccacacgggttatgctcgccacatgccactgactcgcagactcatttttcgataggcacgccgtcaccccacaaaagggctccgacggattgtaggcgcacggtttcagagactgtttcactcccctcccggggtacttttcacctttccctcacggtactcgttcgctatcggtcagacaggaatattcaggcttacccaacggtctgggcggattcgcacggggttccacgggacccgtgctacttgggagacgcgatcggcagaccatgcgcgttcaggtacggggccctcaccctctgcggcccggtattcaacccggttcccctgacacatggttttctgcaactgccggccggcccgtcggagccggcgcacgcgatcccgcaacaccccgcgcgcaacccccgacgggtatcacacgcgcaaggtttggccatcatccgctttcgctcgccactactcacggaatatcctttcctgcaggtactgagatgtttcacttccctgcgtaccccccggccgaagccggtaccgacccatgacggtcggtgggttcccccattcggaaatcctcggatcaaagccctgttggcggctccccgaggcatatcgcagcctcaaacgtccttcatcggtcctgtctgccaaggcatccaccatacgcccttgcaagcaacacacaccacgaaagtgcatggccgcaagattcctctagcaaattcccagacgacaaatcatcacactaaaaatgatcacaaaacgatcgaaacgaacaatagagttcgattcgaaatcaacagcaaaacaaagattcaaaaacccttgttttgctcgcgtccactatccagttctcaagccaccacgcaccgccacgccatcgcgccggcacacggccggcccccaggcacgacgggcatcgaatcgcgccaggcaaaaagcctggggtggcgatccgggagcccaaaagcgcatccataccaccccgcacccaccgcacgaccggcagggcaaagccaacgacgtcttccacaccagcaaccccgccgccatcgcaccatgcgacgcgcggggcgcacaccgtcggacgaacatccgactgaattctccgtagaaaggaggtgatccagccgcaccttccggtacggctaccttgttacgacttagtcccaatcacgagcctcaccttagacggctccatcccacaaggggttaggccaccggcttcgggtgctgcccactttcatgacttgacgggcggtgtgtacaaggcccgggaacgcattcaccgcgacgttgctgattcgcgattactagcgactccgccttcacgcagtcgagttgcagactgcgatccgaactgagaccggttttcagggatccgctccgcgtcgccgcgtcgcatcccgttgtaccggccattgtagcatgcgtgaagccctggacgtaaggggcatgatgatctgacgtcatccccaccttcctccgagttaaccccggcggtcccccgtgagttcccggcataatccgctggcaacacgaggcgagggttgcgctcgttgcgggacttaacccaacatctcacgacacgagctgacgacgaccatgcaccacctgtgaacccgccccgaagggaagccgtatctctacgaccgtcgggaacatgtcaagcccaggtaaggttcttcgcgttgcatcgaattaatccgcatgctccgccgcttgtgcgggcccccgtcaatttctttgagttttagccttgcggccgtactccccaggcgggatgcttaacgcgttagctccgacacggaacccgtggaacgggccccacatccagcatccaccgtttacggcgtggactaccagggtatctaatcctgttcgctccccacgctttcgctcctcagcgtcagtaacggcccagagacctgccttcgccattggtgttcttcccgatatctacacattccaccgttacaccgggaattccagtctcccctaccgcactcaagcccgcccgtacccggcgcggatccaccgttaagcgatggactttcacaccggacgcgacgaaccgcctacgagccctttacgcccaataattccggataacgcttgcaccctacgtattaccgcggctgctggcacgtagttagccggtgcttattcaacgggtaaactcactcacgcttgctccccgataaaagaggtttacaacccgaaggcctccatccctcacgcggcgtcgctgcatcaggcttgcgcccattgtgcaatattccccactgctgcctcccgtaggagtctgggccgtatctcagtcccaatgtggccggtcgccctctcaggccggctacccgtcgaagccacggtgggccgttaccccgccgtcaagctgataggacgcgaccccatcccataccgcgaaagctttcccagaagaccatgcgatcaactggagcatccggcattaccacccgtttccaggagctattccggtgtatggggcaggtcggtcacgcattactcacccgttcgccactctcaccaccaagcaagcttgatggatcccgttcgacttgcatgtgttaagcacgccgccagcgttcatcctgagccagaatcgaaccctccacaaaaaaacttcatgaaaagcatccgaatagatgactctcaaaacaaaaattgacgagcacgtccttaaggaaggacgccctcaaaaaacctcacccctcatcaaaccctcccgggtacccgaccaccacgacaggcaatcaggcgaggaatgaactggcaatcattgactataaagaagtagtacaaacacgctcttgagttctcaaaccaccaccacaccagccagacgggaaaccaaccagaggaaggaacccgccgcgctgagcggcaacaggtgaataacttacacgcatgtccggattcacgcaaatcaggcgcacgaagataagcccaaatcgttgaaacgacaggcttcgcccggcgtgtcgcaaacagcctatttgcgctgttctgatatcagaataatccgttttgcattgccgatgcgtaacaaattcatgtgttcatcggcgtgttgcaagaattcgattgcgtgaccatccaggttcaccttctcgcaaccggtcatcgcatatgcaaaaagggacttccctttacgggaagtccctttcagtagctattgaagctcgctagcttcaggccagggtgttcgggtcaaccggaacgcccgggttcatcgtggaggtgatggttgccttggtcaggtaacggcccttcacggtggacggcttcagacgcttgacttcgtcggccacagccttgaagttctcgtccagagcggactcatcgaagctcatcttgccgatgaggaagctcaggttgccgttcttgtcgacacggaactcgatcttgccgcccttgatgtccttgacagccttggtgacatccatggtcacggtgccggtcttggggttcggcatcaggccacgcggaccgagcacacggcccagacggccgaccttgcccatcatgtccggagtagcaaccacggcgtcgaagtcgaggaagccgccctgaacctttgcaatcaggtcgtcatcaccgacgatgtcggcgccagcctcggtagcctcggtagccttcgggccacgggcgaacacgaggaccttggcggtcttaccagtgccgtgaggcaggttgacggtaccacgcacgagctggtcggccttacgcgggtcaacgctcagacggaacacagcctcgacggtctggtcgaagttgtaggagggcatgctcttgagcagagcgatggcctcgttggcggtgtagaggttgttgcgatcgacgcgctcagcggcttcgcggtacttcttggaacgctttaccatctgtccttctccttatcagtccgtaaccgtgatgcccatcgagcgagcggtgccctcgatgatcttcatgccggcctcgatatcgcgagcagacagatcttccatcttgatctcggcgatttcgcgaacctgcgccttggtgacagagccgaccttgtgggtcagcgggttctcggtgcccttctcaacgccagcggccttcttcagcagagctgcagccggcggggtcttgagcacgaaggtgaaggaacgatcttcgtaaacggtgatctcgacagggatgacctgacccatcttgtcctgcgtctgggcattgtatgccttgcagaagtccatgatgttcacgccatgcgaacccagagccgggcccagcggcggggccgggttggccttgccagcctggatctggagcttaatcagcgccgagactttcttcttgggagccatattatggttcttctttctataacgcggttcgaatggtcgccgtcctcaggttcggctgtctgccatcatgctcggtcttgactcattatttatccgtgcatgctgtaggcaatcggcctgtggtcggtctcctcccgcaacttatattgctgtgctgtgctagcgagtctcctctccagacacaagctttcctattatgcaaatccacccggacaacacaaaaagcccgaccacgatggtcgggctctgcaaagtttgggagttaatctagcttctgaacctggtggaagccaagctccaccggcgtatcacggccgaagatggacacgagcacggtgagcttctgagtggtgggctccacgtcggaaacaacggcggccatggtggcgaaaggcccatcggtgacggtgacctgatcgccaacggcgtaggagacctcgaccctgcgcttcttggcggcggcgggcttgtcgccggcggccttgagtgcctcggaagcaatcatcggagccatcatcgccacgacttccttgcgggagagcggcgccggatccttggtcgggccaacgaagccggtcacgccttcggtctcacgaacgatacggcgggcgttctcatccggccacatacgaatcagcacgtagccaggaacacgcacgcgggtgatgaccttcttgcccttctcggtgtgcttctcgacttcttccatcggcacctcgacctggaagatctggtcttccatgccgaaggaggcgacgcgggactcgatgttggtcttcacgcgcttctcgtagccggagtaggtgtgcagcacgtaccacttgccatcaagggaacgcagggacttggagaattcgtcaacggcctgctgaccggcatcggtctcctcggcctgctcggattcgttgacttcttcctcgtcctcatccagagaaacggtctcggtctgagtggaagcaacgggagcggattcagtcgccgccggagcgtcggactcaacatctgcattgtcgacggatgcgtcagattctgcggaaaggtcagcgaccggttcgaccggggcagctgcctcatcggcagcagcttcggaagcctcgacaacaggctcctcagccgggacggcgtcgaggttctcgagattcagttcatcactcatgcgttgttattcaccttaggttgtgcggatcagccgaacacccacagcgtggccttgcctagaccgaagtccatgccagtcacgagggccatcagcagcagcacgaagatgaatacggccagagaccagaagaacagttccttggcggtaggggtcacgaccttgcgaagctcgtcgatgatctgcttgatgaacagaccgatacgcatgaagacattcggcttgactgccttttcactcttgctcgtcttagccattccgtacctcgcgtcagctgcttgattattagaaacttggcagggaaggcgggactcgaacccacaacctacggttttggagaccgttgcgctaccaattgcgccacttccctaggtgaaaatccacctcggcatgcgttccgtagagaacgcttcgccacggcgaaaccgccaagtcgttatagtaacggctccggtggattatcgcaaatcgcgtgtcgcgcgcgtggcacgcgactcttctcagttagcccattccttgaatcgacgcatgccttcggctaggtcttcgtcagccagtgcgtaggagaaacgcaggtaaccgggagcaccaaaggcctcgccggggacggcggccacgtgggcctcatccaacagtgcggcggcaaagtcagcggacgtatcggacactgtgcccttgggacccagcggcttgccaagcaaagcggtgatgtccgcaaaagcgtagaacgcgccggtcggagtcgggcagttgacgccctcgatatcgttcaaggcggtcacaatcgcacggcggcgcgcgtcgaaggccttacgcatctcgtgcacctcatccagcgggccggccacagcagccaaagcagcacgctgggagatgttggccacattggaggtcatatgaccctgcagcttggcggcggccttggccacctcaagcggagcgaccatccagccgacacgccagcccggcatcgcataggtcttggccacgccgttcagcaccagcaactgcccgcggcattccggcacggcggcaccgatgtaggtggtgtgcgcatcgtcatagttcaggtgctcgtagatctcgtcggagataacccaaatgtggtgctcgacggcccaacgaccgatcgcttccacggtttccggcttccagacggctccggtcgggttgttcggggagttgacgatgattgccttcgtatgctcggtacgggccgcttccagcgcctcaagcgagggctcgaagttcacgtcggcaccggcgaatacttcgaccggcacaccaccggcaagcttcacagcctcggggtagctggtccagtacggagcgggaatgatgacctcatcgccatcgttgagcaagatctggaaggattcatacacggcctgcttgccgccgttggtcaccacgacctgatcggcattgacctcatagccggaatcgcgcagcatcttagccgcaatcgcttcgcgcagctcgggcaggcccggcgtaggcgtgtacttgtaattcttcgggtcaaggcaggcatctgccgcagccttgaccacgtttgcgggggtcgggaaattcggttcacctgcgccgaagccgacaacgtcaagtccggcggccttcatggccttggccttggaatcgacggcgagcgtagcgctcggtgccacagtgttgatacggtcggaaagagtctgccattgcgccatagtcatggctcccatgctaaacctacagcacgaaaaatcgccagagccgcactatggtgatggaatctgtcgtgtgacagattccatcagtcacacgagcacgagattgtcgcgatgaaccagtgggtgggcgtactgggggccgaggaaacgcttgagttgggcggtgttacgcccgagcatctgcggaatttcttcggaatcgaagccggcgaggcctcgggccaggtgttcaccgctttcggcatcgatccagaccggatcgccggcggaaaaatcgccatgtacttcgagcgcgccggccgccagcagcgaggcacgcccgccgcgaatcgcctggccggcacccgcatcgaccacaatcgtgccgcgcgggtcggcggcgaagccgatccacagacggcgtgaggagccgcgggccttaaccggtgcgaacacggtgcccaccggatcgcccatcatcgcagggcccgcgttcgaggcgcaggtgagtaccgtggggatgcccgagacggccgccacgcgcgcggcctcgagtttggtgaccatgccgccggtgccgaccttggagccggagccggagacttggatgtcgcccagcgcatcaatcacgttgggcacatattccacacggcgggagccgggctgcgagggcggcgcagtgtacagcgcgtccacgtcggtcagtagcaccaaggcttcggcccgcaccaggttggccaccaacgcggagagtcgatcgttgtcgccgaagcgaatctcgttcgaggccaacgaatcgttttcgttgatgatcggcaccacgccgaggtcaagcagacggtccagcgtgcgttccacattgcggtactgggtggcacgaatcgtatcttcggcagtgatcagaatctggccgacgcgaataccgaatcgaccgaacgcagtctcgtagcgggccatcagtagcccttggccgacggctgcggtggcctgctgagtggccacgtccaccggccgcgagtcaaagcccagaggcccgaaaccggcggcgatagcaccggacgagaccagcaccacacgtccgcccatcaatcggacctgagccaaggccgcggccaacgcgtcgagcttgtccgggtcgaggtgaccgctcggctgggtcagcgagctggagccgactttcacgacaatggttccggctgcggcgatcatgcgccgcacctcggcctgactcggagtgctcatttattcctcggtttcaccatcttcgctggactcaccgtggccgaacaggctggtttcgtcatggcgatcgtcgtcaacggtcgggtcggcccagtggccggccttgcgttcggccatcatcgcgtcgcgcacggcggcacgggcgtccatcatctcgtggtattgggcacgacgttcggcgttggagcggcggtgcgtgcgcgggtccagctcttcgagacgcagatccttgcctcgggcaccgaggttggagccgtcgagcatttcggcaccagcggagatggtcggatcccaatcgaattcgaccatacgggcaccacgaccgatgcgcacttcgtcgccggggtgagcacccttgcggcgcagctcgtcctccacgcccagcttggccaagcggtcagccaggtagcccacggcctcgtcgttgtcgaagttggtctgcatgacccagcgctccggcttgacgccacgcacctcgaagaacacttcgccattgccgagttcgcggcgctcgaccgtgaactcaagcgcactgccgccctcgtcagcacgacgcggacggcggcccttggtctccaatggcttgatgaccacgcgagcctcctcttcggcctgctcgcggttggccacttcctcacgcatctcgtgcaccagcgcagacaacgcgaagttgagctcctttagaccctcgtgcgaggcagtggagatctcaaagaccttcagcccgagtttctcgaactccggacgcacgaactcagccaattccttggcctcgggcacatcgatcttgttcagaatcacgatgcgcgggcgttcgggaatcgggatggcacccaacggcagctcgagcttgtcggcgtagagcgccaactcgttttccagcgcgtggtagtcggacatcgggtcgcggtccggttcaagcgtggcgcaatcgatcacatgggcgatgatttcggtacgttcgatgtggcgcaggaactccagtcccaggcccttgccttcggaggcgcccggaatcaggcccggcacgtcggcgatggtgtatcgagagtcgccggcgataacgacgccgagattcggcaccagcgtggtgaacgggtagtcggcgatcttcggcttggcggaactcatcgccgcaatcagggacgactttccggccgaggggaaaccgaccaacgccacgtcggcgatggacttcaattccaaaatcacgtcgcgctcttcaccgagttcgccgagcagggcgaagccgggggcgcggcgggtcttgttagccagggcgatgttgccgaggccgccggcaccgccttgggcgacgacgcagcggtcgccctcgtggcgcaggtcggcgagctgcgcgccgggatgcttggctttgccctgttcgccgcgcgcctcaaagacgacggtgccgcagggcacgggcagaatcaggtcctcgcccttggagccgtccttattgtcgcccaaacccatggtgccgctgccggcgacacgatgcggcatgaaacgatagtcgagcaggctggtggcgttacggtcggccacgaacaccacggaaccaccgtcgccgccattgccaccgttcgggccggccaacggcttgtatttctcacgacggatgccggccgaaccgttgcccccatcgccgcccttgacatggacggttactcgatccacaaaatcactcatattgattaccttacaaaaaagccgcgtccttacgggcgcggcttgaaaaaagcttgacgctatatcgctcaggcgatgacgtcgacaaccttgcggtcgcgacgcacaccgaacttcacggagccatcggtgagggcgaacagcgtgtgatccttgcccatgccgacgttgtggcccgggtggaagttggtgccacgctggcgaacgatgatgttgccggccacgacggcttcgccgccgaacttcttcacgccgaggtattgcgggttagaatcgcgaccgttgcgagagctggacgcacccttcttatgtgccatgattcatggtcctttctataactcaggcaatcgccgtgatcttgacgatagtcagcttctggcgatgacccttacggcgagcaacaccagtcttgttcttgtacttctggatgctaatcttcgggcccttggcttcgtcgttcacaacctcagccttgacggacaccttggccagatcggcggcggcaagggtgaccttgtcaccatcgacaacgagggagaccgggaattccacggtatcgcccttcttagcgtcgagacggttcacgaggatgacgtcgccaacctcgaccttttcctgatggccaccggccttcacaatcgcgtacattatcgttccttttatgttttggaaagctaccttgcctaacacgcaccgagcttgcggtcagacaccgagtttcgaatctacaccaccatgcggactaaatcaaatgatttttgcccgcgtgtcaagcacgacacacctgttactcttccgccgtgttgttggcagcgacggcagcggcggcaatctgagccagtttggctttgacgtcggcgctggaaccagccggttcgggagcgggagcggtgccgcgaccgtgcttgttggttttgacgaacgggtcgccaccgcgaagcgcgtagggatcgtcgtagtcggccgaaacggtcggctgatcatgcaggatgaaaccacggcccttgcaggtcgggcattcctcggagaacgcctcgaccagaccctggccgatgcgcttgcgggtcatctgcaccaaaccgagcgaggtgacttcggccacctgatgcttggtgcggtcgcgtgccaagcattcgaccaagcggcgcagcaccagatcgcggttggcgggcatgaccatatccacatagtcgatcatcaccatgccaccgatatcgcgcaggcgcagctggcgggcgatctcttcagacgcctccaggttgcaacgcgtcaccgtttcttccaaggacttgcccttgccgataaagcggccggtgttcacgtcaatggtggtcatggcttcggtgcgatcgatgacaatcgagccgccggacggcaggtagacctgacgctccatgcccttacgcagctgggagtcgatggaccacttgtcgaacacgtccttgccttcatgctcggccgggtcccacttctccagcttgtccttcaagtcaggggccatggtgtcaaggtattcctcgatacggtcgtagaccttgtcaccttccacgatgagcttgctgaagtcgtcgttgaagatgtcgcgcaccacgcggatggccacgtcgggctcgccctgcaggagcttcgggcgcttgccgtgccagaattcctcgcgcttggcgttgatgcgctcccactggcggaccagtgattcgagatccttgacgatggcgtcttcggatgcgccctcggctgcggtacggatgatcacgcccatgtctttcggggcgatcttggagacgatgttcttcagacggctgcgttcgcgctccgaaagcttgcggctcacgccggtcatgccgccggatggcacgagcaccaggaagcggccggcgagcgtgacctgagaggtcaggcgggcacccttgtggccgatcgggtccttagtgacctgcacgagcaccgggtcgccggacttgaacgccagctcgatgcggcgcggctggccttcgagacgagcggcatcccagttgacctcgccggcgtagagcacgccgttgcgggcctggccgatgtccacaaatgcggcctccatgctgggcagcacgttctgcacgcggccaaggtagatgttgccgacggtctgtacttcctgaatgtcggagacgtaatgctcgaccagaacattgtcttccaccacggaaatctgggtgtgatgttccttctcacgcaccaccatcaggcggtccacgttctcgcggcgtgcgaggaagtcctgttccatgagctggctctggcggctgcgctcacggcggttgtcacggcggcgctgcttcttggcctcgagacgagtggagccttccacatcagtgatctcgtcgatgtactgctgcttgcgggagcgtcggaccagcggctgttcgctgttctgactctggtcgtcggtgccctcgccgttcttgccgccacgacggcggcggcgacggcgagtgacggtctgctcctcatcgtcctcatcgcgatcacggtcatgatcatcgcgatcgtcacgacggcgggaacgcgtatcttcggcatcgttctcggcggtatcgtgctcgccgttggcaccggtttcgccgcgtgagccgcgacggcggcgacggcgcgaacgggtgcgggtggcgtcggattcttcgtcgccctcctcttcggcaatcggcgagtaggcgatatcgtccagctcgaggtcttcctcaatctgctcgacttcggcggctgcacggcgctcctgggcgttcaggcggcgggagcgacgggaacggcgggagtccgaggtgtcgtcggcgtcgaaatcgtcgtgatcggcgttggtatcgccggacgcggcgtcacgggaagcgtcacggtcggcggaggcgcggccgcgatcgtcgcggcgacggctgcgcggctgggcatcgtcatcgtcgtggctgcgcgagcggcgggagcgacgagacgggcgttcgtcggcgtcaacatcgtcatcacgagtgtcagcggtatcgtgcgcatccacggcggcgggcagtaccggttcctggaagagcagggacgtcatcggcttgccgcgacgcacggcctcgtggccagagggcagggattcgaccgcgtcgaacaggcgctcatccggggtgtcctcgtgcgtatccgcaactgcacggcgagaacgacggcgaaccggccgatcctcgtcatcatcatccatatccatagacgcacggcgagagcgggagcgaaccggccgatcctcgtagtcatcatcgtcggactggcgggagcgagagcggcggcgaaccgggcggtcctcgtcgtaatcgtcatcgtccacaaccgaacggcggcgggaacgtggggcgtcatcgtcatcgaaatcatcggcactgacagtgcggcgcgaacgacgaggacgatcatcctcgctatccgagtcggccactgcggaagcggcgcggcgcgaacggcggcgggttggacgttcggcggaatcctgggaatcgctggattcatcggaatcgctggaatcggctgacttggaatcggccgcagtgccggcatcgggaagcgcgggggcttcgaacagcggggcgcgttcctgcacttgcagttccagagaagcgccggcagcaccggtgccgcggaccacgcggcggccgccacgacgacggcgaacaggttcggcgggctgggaggcggcggcaggcgcagcgttcacggctgcagccgaatcggcattggatacggttgaattatcggttccgtcgttgacgaaaccttcacggttgtcagtgggcacaatgctcctcgcggcgcgctgcatcacgacgcctatttccaggcctatacgcttgtctcacaccacgctctcaccgtggccgcacgaaaacgcgccgcgtaaaggcaacttcgtctcaagtctgtcctgcgggtggcggacaccggcgcttgcgttgtctcattctcaagagccgcaaggggatcgacgccatctcgcacgctgatggttatgcagaaccaccatcctttagtatgccacatattttgtgcgggcgtggcccggcgaggctgacgttctctcggctcccctcccccgcggtgacagctcccctcagggaggggagctagagaggtgtcagaccagccagtcggtaaggattgcggccatggcggtcaggtcggattcaggcacctgctcgtcgtgcttgtgagccagcagcggatcgccggcaccgaggttgacggccgggataccgagctgagagaagcgtgccacgtcggtccagccgagcttggccagcgggtcgcggccagtgcgctccttaaccagtcggaccagatcctgggcgagcggggcgttcaggcccgggcgcgcggaggggctttcgtccttcatttcgatgccgtagccctcgaacacgccgccggtagccacatgctcgccattgccgagttcggcaccggcgtccgcgcccatcatcagagccttggcctcggccaacgacttgtccggggcgaagcggtagttgacgtgtacgcggcattcatccggaatgacgttcgtgcctttgccgccggagatcagcgtggcgttgaggccctcgcgataatcgagcccgtccacgttcacggtggccggctcgtaggcgttgagtcggttcagaatgtcggccgccttgtggatggcgttctcccccatccatgcacgggcggagtgcgcggccacgccgtgggttacgacgtcgaagcgaatcgtaccgttgcaaccgccctcgatgccgctgttggtgggctcgccgatgatggcgaaatcgccggtgatccaatcgggatgggcctcgacgactttgcgtaggccattcttttcggcgacgacttcctcatggtcgtagaagacgtaggtgaggtcgactttcggggtggtttccggcgtgcggccgtcgagcgtggcggcgaggtagagcatcaccgcgtcggaggccttcatatcggtggcaccgcggccccacagcacgcggtcttcgggatgagcgtgggcgatttcttcgcgaatcagcgaatcgccgggctccagccactttggtgggaaattgtcgatgaccggcacagtatcgaggtgcccggccaagatcacacggctcggcttgccgaagtcggtgctggccaccactgtgtcgccgtgacggcggacggtcaggtgctcttgctcgttaaggaaggcctcgacctcgtcggtgagggggccctcgtggtcggacacggagaagttctccatgatctgggtgagcaggctgttcagctgctcggcagtggatgcggtgcggttcaattcaagcgtcatgtgaacagcgtaccgcgtgggcggcgggcccagcacactcactacatgagattttgcggccgaatacatttttatgtgccacactggggtggcgaaagggaggattatgccaggtctaatcagcgccatgcaaggcttctgcgttatcggcatcgtaatcgcggtgggatatgttgccgcacgaatgcgaatcggcgggccgtccgctcagatggtgctcaaccggttctccttcttcgtatcgagcccgtgcctgatgttcgcgattctctccaaggagccgattttcgacatcttccacccctcgattatcgtggcgttcttctccgccgtgctggtaggcgtggtgtttttggtgctcaaccgtatgttcttccacctgaatgccccggacgccaccatcggtgccctgaattcgctgtacctcaattccaataacatcggcctgccaatcgccacctacattctgggcaatccggctcttgtggcaccgattctggtcatgcagcaggccatcttcacaccggtgggcctgacagtgctggacgtgaccaccaagggcaaggtctccatcaaggaaatcgccaagcagccactgcatcagccgctgcttatcggctcgctgctgggcattgtggtctctgcgatttccgctaaaagcggctggttcccagtgccgaaattcattttcgacccgatcgacatgatcggcgattcggctgtgccaatgatcctgatggcgttcggcatgtccctgcacggcaccaagccgctacagcagaagggcgatcgcccggccatcttcacggtcgcggtcctcaagaacatcatcatgccaattatcgcgttcctgctcgcctacttcgtgatgggcttccgcggctccgagctgtacgcctgcgtggtactcgccgctctgcccaccggccagaacgtatacaactacgcggcccgctacaacgtgggtctcaccttcgcgcgcgacggcattctgatgagcaccatgaccagcccggtgtttatcgcgatcatcgcggcgctgctgtcgtgatgggtgcgcagagaagcgttctcaatagtatccgtgcgcgcaaatgcacagatatcgcacaaacgaacatttgctcatccgcatatttgcggtgatttcagcgtttctacgttcgatttgcgtatacgaaagtacgcacagttgttattgagaacgattcgctgcgcagctcggctcagtcatcagcccgataatcggtcagattcaagctggccgccacatgattggacgcgaacgcgccgatggaaaccagcgcatagcacaacacaagcccgccgaagaagctggccagcgtggccggttcggtcatcgaagcggcgaacagaggggccataagcagcatggaacagccgccggccacgatcaccacgatgttgagcggggtgagtacctcgatgaatcgcgcacggttcaaggtcttgacatcagtgccctccaacaccagcatgcgatattcgccggcctgatcgtacacgctgccggcctgcatcacaccggagctgaccgcggcaagcacagcggcgaacacgagcgtcagaatgccgccggtgccgatgtcgcgaatgaacacggtgaacgggtcgttggcgtcatcgaccacggcggccgatccgaagaatccgcagatcgacgtgatgccggcgataaacacggccaacgcaatgccggacacattgcgccaggcgcgcttagggttgtcgagaatacggcgcatggcaatcatcgtggccgcatccttggggcgcttggccttggccttggcgcgagcggtgatcacccacgtgccgataagattcaccagcgcgaagcacagcagcatgaaaccgatgatcacgccgtacatcaccgcctggccggcctgagccagcatggccgggttcttgaagacgatcatggccaccaccacgactaccacgaacagcaccatacgggtgcctgagggcaatgcggtggcggtgcgcgaggtgacacccaatggggtgattgccacgcggcgcaaggtgaccagcgacgatatcagcgccaagatggccacgcccgccaaggtgattaccagcgccagcgggccgacccatagctgttcgaaggtgaaccgctgctcctggaagggaatcagcatgactgccggcatcagggcgcaatagccggcaatgccgataagcgcgccgatcagcgcctgtccggcggcgtcaagcgcggtgagacgcaccacctgaccggtggtcgcgccggccagacgcagggcggcgagacgggcgtcgcggcgggatgcggccagtcgtgcggcggaaccggcgagcgccacgaacggcacgacgagcagcatgcaggcgaataccgccaacgccacataggcggtggagaattgggccaggctcgtcgggtcgctgatctgccgtttccacgcggccaccgtatcgggccggcaggcaccgaagtcgaacgcgcaggcgacggtatgatcggccgaagcccgccagatgaaaccgtgtacgccgccgagcacggtgaggaagatggtggtggctgcggcgaaggcgatgattgccagcatcgaggtgtggccggcgctgccgcgcaagccggggcggtgaaacagccgccagagggcgaacgtgctcatcgcgcgcctcctgcggtggtttcgctcccgccggctggagctgccgagcgtagcgaggctgagggtggttcagcgccctcgggccacccccagtcagcctgcggctgacagcccccgccagcgggggcggagttggggttggcgtctgtctggtgcagacggccgtcctgcatcattacggtacggccgcagaacgaagcgacgttggggtcgtgggtgacgacgaccacggcggaaccgttgtcccgcgcggcggccacgagaatgcccatgacctcgcggccggtggcttggtcgagcgcgccggtcggctcgtcggcgaagaccacggcaggtttgacggcgagtgcacgggcgatggcgatgcgctgcatctgtccgccgctcatctcccccggccggtgcgtggcgagcgcgcgcaatcccatgcgttccagccacaggatcgccgtgtcggtggcggtgcggtagggcatgccgtcaagcatcatcggcagggcgatgttttcgaccgccggcagttcgggcagcagctggccggactggaagacgaagccgaagtcgttgcggcgcagtttggtgcgctcggcgtcgctcatgcggctcaggtcggcaccacggaagatgacggtgccggcggtcggcttaatgatgccggcgagcgcgtgcagcaaagtggatttgccggagccggacgggcccatcacggctaccgtctcgccctcccggagcgtgaagttcacgtggttcagggcgagcgtgtgcatggtcggcatggcgaagccgggctgggatggctgggatggctggccggcctgaatggcacccggtccggccgcagcgggattcgccgacgcataaccggctcccgtgccggctggtatcacgccggtgacgccgtgcccggcctgtgcgcgggccatgctggcggtgtagtccatgaccaggtcatgggcctcgatgaccggggcccactgctgggtgtgcgatgccggctgctggaactgttggggttgctgagactgctgaggctgagccgccggtcccggcgccggctgaggctgctgcaattgcgatgctgctgtattcatactcccgagcgtacggagcgaacgcccagccgaccatcgggctgcggtatgaacctttctggattaccggcccgctcctcatccgcaaggattagagatacgcaaatgattaatgaccggcaaccactattcggtgccggtcattatgagcattgcattcaggcgctacgcgcattattgcgcggtagccaactcgtccaggcgggcggcgaagcggggccagtcggtcttcatagcggtgaggagcttgcggttgggcacgtcgtcaatcgggacccagcagatttccatgctttcgtcgtcgtttgccttgggctcgacggtgtggccgggcttttcaaaggcaaacacggtggtgtaggcccacgggccatggtcctcgcggtaggagccgaccacctcgatgtcttcgggggtgatgttggcttcctcgtagctttcgcgcagcgcgccttcgatggacgattcgccgtccgcagtggcaccgccggggataccccacgtgccaccttcggcgctccacgcggcacggtgctgcatgaccacgtgagtcaccttgccgctcgccgagtcgcggcgagccagcagaatgccggacgcaccgttggtgccccaatgcttgcggccgcaggcgcagtccacccagccatcgccgggctggtgtacgttttcgaccggcggcagaatgccagcgtgctggttgcccgatgccttgctttccggttccagttcaccacggccgacattccacaggtcagtccacgtgatgcccagttcgccggccagatgccgggccagcggcaagctgaggccgatgatgccgtgcggatcgccctcaatactgtcgatgaacgcaccaccgaagccttccagcgtgaacgatccggcgacttccagcggctcgccagtggcaatgtaccgttcgacgtcggcatcggtgaattcgccgaaatggactttggcgtggcttgcgccgcgcacggtacgcccggtcgcgaaatcgatcaggcagtggccggtccacagttcgccggtcgcgccgctcatgcgcttcagtcgttcgcgggccacggcttcgctgtgcggcttgccgtagcattcgccgcccaagaggaacatcgaatcacagccgagaatcagcgggccgactgtcgcctcggtcagtcccggctgtccggcaatagcggtggcgatgggttcggtgatggtcggcatgtcgatgccggagaagtcgcgcgtggtggcgacttccgccttggaatagtcgatgggctggccagcggcggctttgcgcaggtcttcgacgacggcttcgcgttccgaatccttgatttccttggccttgagcgggtaggcaatcacgcgatcgccggttgcggcggcggcagtattggccacatcgcgatacgcacggtgaacggcctcggccttggctacggcaagaatcatcacacgctgcttgatgctcaaatcgtcgacggtgacaccttcctcacgggcggccgcttccagcgcagcaggctcatccacgtgcgagacgcgaattgtggggcagatacccgccgaatacagcacgtcacggcgaggcttggacttggaagcaagaattagcggaatggacatgacttaagtccttatgctcccgctggcgggagctgtcgaacgaagtgagactgagggtggtctctgccggtatggcggaccaccctcagaccgcctgcggcggccagctcccgccagcgggagccttctcctcgacttagcgacgctcgatttcgacgccggcggtgttgatgggcaggtgaagcacacgccagtggccggaagcaagctgctccgatgcgatctggtcgatggcttcgcgggcgttgccgtaatgcagcacgagcacgcaggggccggcaccggagactgcggcggcatagcccttggagcggaagagcgcaatgagctcggtggacggcggcatcagggcaccgcgatacggctggtgcagtttgtcctgcgtggcggtgaacagcagcgcgttggactgggcctgagcggccgcaagctcgtcggcgaacgccgattcacgggttccgccagagcaagcgcacgtatcggcatcctgagccggggcagcggcgacgccggacttgccctgctgggcggcctgagccagcaccacgggattcatcgcagcgggcagcagacccacgcgagacacgttgtagacggcgtccttgtatggcagttccctaggcagcgcctgacgggccttctcagtggacagctcatagtcgggcacgaacacggcggcggtgatggacgggtccaccgggtagttgacggcgtggaatccgccgtgcagcggttcaccaccaggaacggcgaccgagccgacgccttctgcggtttcgaagtcccaagagacggtcaggccaccgaacacagccggggccacattgtccgggtgtccttcaatctgggcggccatatcgaagacggccggacggttgaggtcaccggtctgggcgaaggccgcggcggcggcgatgccggccacgatggcctcggcggaagagcccatgccacgagcctgagggatgttgttggtcgcttccagcgtgaagccgagtcggccgaggccgaacgtggcacaggcacggcggaaggtggagaccacgaggtgggtttcgtcgcgtgggagggtgtcggcaccctcgccgtggatgatcacgtgggcaatgccgtcgttcgggtcgtcgttgagcgtgaaagtgagctcgtcatggtagtcgagcgccagacccacggtatcgaagccggagccgaggttggcggacgtggcgggcacgcgcacgtgaacgctattgcagattgggttcatggttgttccttaaaaaggagctccccttgtcaggggagcttgggtattcagctttcaactcacgggcagccgttcgaccgcctcatcagagggagcctagacggtgtcagtccagcacgcgcaggatggacgggtcaccggtgacgaagtcgagcgcctgcacggccttgacggtgttgcgcagggtttcctcgtcggtcaggtgggtcacgatgcgcagctgctggatctcgccgtcgtagccggggtcggtcatggtgggcttcagatcctggttcacaccgttgatggagacaccgttcttggcgaactcggcggcgatggcggccagcacgcccggcttgtcgtggatcaggaagcgcacggcgaatgcagccttggaggcggtaatcggagccttcggcagattcttgtacagcgggatggacgggccggtgcagccagcagcaatgtggcgggcttcggtcaccacgtcgcccacgacggcggaggcggtcggagcgccgccggcgccacggccatagaacatgaggtcgtcggcggcctcggccttgacgaacacggcgttgaaggagccgtgcacggaggccagcgggtggttctcgtcgatcagggccgggtagacgcgggcggagacgccggcctcgccgttctcgaccacggcgagcagcttgatgaccttgtgctcggcggtggcggcggcgatgtcgtcggcggtgatcttggtgatgccttcgacggacacgtcgtcgatggtcacggaggtgtggaagccgagggtggccatgatggcggccttgttggcagcatcgtagccttcgatgtcgccggtcgggtcggcttcggcgtagcccttggcctgggcgtccttgagcacgtcgtcgaactggagacccttggtggtcatctcgtcgagaatgtagttggtggtgccgttgacgatgccgagcatgctggtcaccttgtcgccgaccagggactcgcgcagcgggcgcaggaacggaatcgcaccacctacagcggcctcgaagtagatgtcgacgcccttggcctcggcggcggagtagatctccgggccgtacttggccagcagcgccttgttggcggtgaccacggaagcaccggattcgatggcggcaagcacgaacttgcgggccacggtggtgccgccgatgagctcgatgacgatgtccgagttggtggccacgctcaaagtatcggtggtgacgatggactggtcgatccacgggaacttctcggtttccttcgggtcgaggcaggcgacgccggtcagttcgatcgggcggccgatacgagcggacagttcgtccttctgctcgacaatcaggcgggcggtctgggagccgacggtgccggcaccaagcaggcctacgcgaatcggggtttcgctgttgtgagccaattcagggtccttccaaaaagttttctatatcccacgcctattttacggattatttccgacagcagaccgaaagtactcatcaagctgacggcccttttcgtattatgacggttttggccgcacattacagactgtcaggcgctcgcctctgcacgtggatcactcgctgacgtcgaggttgagtaggtcgtctacggtctggcggcggagcatgacgtgcgcaccggactcgctgacagcaaccaccgccggaatcagcgcttggttgtagttgctggccatggtgcggccgtatgcgccggtaaccggcacggcgagaatgtcaccgcgcttcaaatcggcgggcaactgcacctcgtgaaccacgatgtcgccggattcgcagtgcataccgcacacacgggcaagcatcgtttcagcggaaccggtgcgattcgccagacgcgcggtgtagtcggcaccgtagagtgccgggcgaatgttgtcggacatgccgccatccacagacacatacacgcgctcggcaatcgggttgccgtcactgtctttggcatcggacaagtgcacgtgcttgatggtgcccacgcggtacagggttacgccggcgggcgccacgatgtagcggccgggctcgaagctgatggccggggcgggcatgccgagcgcacggttggtgctgttgaccgcatccgccaagcgagtgagttccacgtcaatgtccattgaatcttcgccatcggtgtaggccacggagtagccgccgccgaggtcgatttcgggcaggatgtaggcgtcggtggcccacagggtcttgcgcagcagcatcatgcgcttggccgcgtgaatgaaggcgtccgcatcgtggatgttggagccgatgtgcgagtgggctccgaccagttcgagtacgtcctggttggcgaggatggtcttgagcacggcgatggacggaccgtccgcaatggcttccatcgcggcggccagcgccttgtctgtgtcggagacttcctcgtggctcaggtcgtacgggtacttgacgtcgtagtgcagctcgcgctctgatttctcggtcttttccgcgccattttccggggaatgcgtcgcagagatacgcgcgttggtagcggcaggcgtcacgtctttgaggtcgttcagcacgtcgagcacggcggcgtcggccccggcggccagcagcggcacgccgaacttctggtcctcgtgagcagtggagatgtactcgtggccgccggcgtggacaccgacggtgacgcgcagcatcacacgggcgcgtttgccgagcttgcgggcgatggcagcaacgcgctccggctcgtcgggctcgtcgatcacgattttggcgaagccctgttcgatggccagcgcgatttcctcatcggacttgttgttgccgtgcagcaccagacgacgtccgggaacgccagcggcgagggcgattttcatctcgcccatcgtgcaagtgtccacaaacatgccggcctcggtgaccaatcgcacgacttctttggacaagaacgccttgccggcaaagctcacgtgcgtagtggaggtgttgaatgcttcggcggcagcgcgcacgaagtgcctagcacatgcgactacttcatcagtgtcgatgagatagagcggcgagccgaactcgtcaagcagcgattcggcggtacgaccatgaaattcgatggagccttcggcattcacagccgtagcggccggccaaattggagaaataggcataatcacatcttttcgggggcggtgacgccgaggaggtcgaggccgttggcgatgacctgctggacggcgtcattgagcttcaggcgggcggcggcacgggccggctccgggttcttggcaatctccaaggccttgcgagcctcgtcgtcgccacgggtttccggatcggtcagggccatcggcaccacgcgctctacgttgtaccacttgtgataggtggcggccagttcttcgaggtaacgggccaccttgtgcggctggcggtcgtcggccgcagtggcgagcacgctcgggaattgggcgagggcggcgagcacttcgccgtcggcctcggtgtcgagcagggccaggtcggcaccctcgtagctgatgccggcagcggctgcgttgcggtccacgttcttggagcgggcgtgcgcgtactgcacgtagtacaccgggttgtcgttggtgtgcgaggcgagcagggccaagtcgatgtcgaagttctggttgtaatcggagcgggccagcgagtagcgggcggcgtccacgccgaccacggagaccaggtcgtcgatggtcacgacgttgccggcgcgcttggacatgcgcacgggcttgccgtccttcatcacgttgaccagctggccgatgagaatctgcatgttcttgccgggctcatcgccgaaggccgcgcacatggccatcatgcggccgatgtagccgtggtggtccgcgccaagcatgtagatggccacgtcggccgagttttcggcgcgatggcgcttgtcccagtagtaggcgatgtcggcggcgaagtaggcgaactcaccattggacttgatgatcacacggtccttgtcgtcgccgtgcttggtggattcaaaccaagtggcgccgtccttgtcgaagatgtcgccgcgggacttgagctcttcgatggcggcgtcgaccttgccgtcggcgtacaggctgttttcatggaaccagacgtcgaagttcacgcggaagtccttcatggacttctgaatctcgtcgaacatcatcggtacggcgcgcttgcggaattcctcgcgcacttcggtatcggcctcgccgagcggttcaccgtcatcgttcaggccctgatcctggtgggccagtgcggtcaggtccacgccgtcggactcggcttcggcctgaacacgggcggcgatctcgttgatgtaggcacccttgtagccgtcgcacggggtttcggtctggtagccggcctcacccaagttattggcctcggcccaagcggcgaccagcgacttggcgaagcggttgatctgctcgccgtggtcgttgaagtagtattcgcgcaccaccttggcgccgttggcctcgagcacgcgggccatggcatcgccgacggcagcccaacgggtgccgccgatgtgaatcggaccggtggggttggcggagacgaactcgagattcagggtctggccgcccagatggtcgttgcggccgtattcgttgaccttgttgagatgcttgtcggcgtcggtcacggcaccggcggcgagtacggtgtccaccacggcggcggccgaggcggagtcaagcgtgatgttgatgaagccggggcctgccacctcgaccttggcaatgccgtcggcttcagcgagcgcggcggcgaacggctcggccagatcgcgcggcttcatgccggccttcttggccagctgcatggcgatgttggaggcccagtcgccatgcgcacggtccttcgggcgcatcacggcgagcttgtcgacgggcggaatcagctcgtcggtcaacgcgccggcctggccggcggcgacgaggttgtgggcaatgctggaaatcagttcacttaaggcttcaggactcattcttctaaggatactgagaacggcgacacttgcgccctggtatgcctatatgctgcccctgctggcgggggcaagcacacagccgaaagataccaagcgaaaaagggtaggcgacaatcgccggaatcgttggaggctcgccgaaaccgctatacataccgtcggtcggtatctatagtgatctgcaacatcaagcacagtagggaggccaccatggcacgtaacgctcaccccgaggtgacgcgcacccgcatcctcgacgccgcacaacggctgttcatggcccagggctatgagcacacctccatccagaacatcgtggacgagctcggcgacctctccaaaggcgcgatctaccatcacttcaaatccaaggaagccatcctcgaagagctcaccaaccgagacaacaatatgcaggacgacttcaacgaatccgtcatgaatcgcactgaccttaccgccctcgaaaagttccgcgtgctatggcggcattcgatgaccaagcaagaccacgtgcagatcatgcgagccgccatgccgatgctgagcgatccggtttcgttcgccgcgaatatgcaggtatggagcaagcatctgcccgaacgcttcctgccgctgatcgaggcgggcgtcaaggatggctccatccccaccgagtatccgcgcgaggccgcagagctgctttcgttgctgccgaattattggctgatgccgtatttctacccggtgaccctgcccgaaatggagcatcgcatccgctgcttggccaccatgctcgacgcgatcggcgtgccgattttcgatgacgagctcatcacggtcgccgcgaagggcatgatgacgttcgcaggggagccggagaaaggctcagaatgaatagcacagtgaaacccgagaatgacatcgccggcaccgccacccaacgcccgctgctgtcccgcgacttcgtgctgctggtcgccggacaaggcatctcgctgttcggcaatgtgatgctgcgattcgcgatgtcgatgtgggtgctggacgaaaccggctcagccaccatcttcgcctcggtgctggccatctccatcgtgccgaccatcctgctctccccgttcggaggcgtgctggccgatcgcgtcaaccgccgcaccatcatggtggcgctcgacgccatctccgccgtgctcgtgctggcgagcgccatcgtcttcgccaccacgggcttccatatcgtagccatcgccaccatgcaggtgctgctcgccgtgctcggcgccttcgaaaccccgaccgtgcaggccgcactcccccagatgttccggcagtacggcccggccaccatgcgccaaggcatggccgtgatcaatcaggtccaacaactaagcagtctgctgccgagcttcctcggcggcgtgctgtatgcgatgttcggcatccgtctcatgatgatcatcgccatcgcaagcttcgccggcgcagccgcgctcgaatgcttcatccgcctcagtgccccggatcgcggcgacgaggagctgcccaccccacttgaagacctcaaggcaggcgtgcgattcctcatcaaggaccggccgaacgtgttcagactgctgttgttcgcggcggcgctcaactttgtgcttatcggctattccggcgtcggcttcccgtacacgattcgtacagtgctcggcttcgacgccactgtctacggcatcgccgacggcctgatcggtgtttccggcgtggcgggcgcattcatcgccggcctgttcgccgccaagctcacgatgcgctggctgccggggctgatggcgacgcttacgctggccatggtcccacagggtattgtgttcctgctgccggtcgacgcatggaccaaactcgtggtgctgatcgtattcacctgcggcacgatggtcgccagttgcttcacgaatctcatcgccgtgcccgccatccagctcagtacgcccgaggcaatggccggcaaagtgatgtccatggccgcggccgtgagcatgtgtgcccagccgctcggccagatggtgtacggctgggcctacgaccaaatgccggtcgccatcgtgctgttcatcaccaccgccctgttcgccgtgctcaccgtgctgatggttccgctcgccaagcagttcgaggactgacgatcggcgcgcacgccacatcctgccgcccggccataattgaatcaccgcacgaaaaggcacgaaaaggcacgaaagaggtacctatggccacgctcaacccccaatcattggtcacgttgtggcaaatcgaacagtatggttcgttctccgccacggccaaggccacgggttggtcgcagccggccatcagccagcagatcaaaaagctggaggcacagtgcggttcgactctggtgcaacgcacctcgcatggcgtggaactcaccgccaccggttcgatgctcgcccgccacggcgaggccatcgccgatcggctggagcgggcggcccgtgaagtcgaggattatcggcatcatcggtttgatcacctgcatttggtggccccaccgtcaatctgctctactatcgcggcccgtaccgtggtcaagctcagtatgttcacggacatcgagctgagcctgattcagatggagccgccggaggcgatcggtctgatttcccaaggcaaggccgataccgccgccgtgttccgctacagcagcatcccgaacttcctgcacatcggcgacgacctgaccttccattcgctgggttacgatccgatgcgactgctggtgcgccgctccagcggcatcgccaaacgattcgaggagaccggcgaacctgtgccgctgtccgccgccaaagacgagcattggatcgccggctgccccacctgccgcgcaaatttggtgaaactggccgcccgtgccggattcaagccggatatccgccactgcacggatgattactgggccacgcagaacctggtcgaggttggtatgggcgtctcgctggtgccggcgctcgatacgcatatcaacttgcagggcgatctggtggcctgtcccattgccgacgattttgcggcgcgcgaggtcggcatcgtgactcgtgccggcgaccatcgccccgcgcttggttcattgctcgaggagctcgagcgcacgtcactcaaatatttgagtgccaagtagtcgcacagcgataagcaagcttgcgagcgccatcacgatttcggggagccagaccgttgagcggcccttctgcaccgggaacaatggcatgttatgagcatgaacaacattccccagtcaacgactttgagcaacgcaaccgccggcacctcttgctttgatgccaatcacatcgacgtgacgaccatcgaggatctggagcaggtcggttcggataaatggacccgctaccccggctgcatcggcgcattcatcgccgagatggattacggtctggcaccatgcgtggccgaagccatcgaagaggccaccgaacgtggcgcgctcggctacattcccgacccgtggaagaaggaggtcgcccgctcgtgcgccgcatggcagcgccgctacggctgggaggtggatccgacgtgcatccgcccggtgccggacgtgctggaggcgttcgaagtgttcctgcgcgagatcgtgcgcgccggcaactccatcgtggtaccgactccggcctatatgccgttcctgagcgtgccgcgtctgtatggcgtggaggtccttgagattccgatgctgtgcgcgggcgccggcgagagcagcgggcgcaatgatgaatggctgttcgatttcgacgccattgagcaggcgttcgcgaacggctgccatgccttcgtgctgtgcaacccgcacaacccgatcggcaaggtattgacgcgcgaagaaatgctgcgattgtccgatctggccgccaagtacaacgtgcgtatattctccgatgagattcacgcgccgttcgtctaccaaggccacacgcatgtgccattcgcctcaatcaaccggcagacggccatgcaggctttcacctccacttcagcctcgaagtcgttcaacattcccggcaccaagtgcgcgcaggtgattctcaccaatccggacgatctggaactatggatgaggaacgcggaatggtccgagcaccagacggccaccatcggtgccatagccaccacagcggcctatgacggcggcgcggcatggttcgagggcgtgatggcatatatcgagcgcaatatcgcgctggtcaacgagcagatgcgcacgagattcgccaaggtgcgctatgtggagccgcagggcacgtatatcgcgtggctggatttctcgccactgggcatcgatgacccggccaactatttcttcaagaaggccaacgtggcgttgacggacggccgtgaatgcggcgaggtcgggcgcggatgcgtacgcatgaacttcgccatgccctacccgctactggaggaatgcttcgaccgcatggccgccgcgctcgaggcggacgggctgttgtagaaaattgtggctcccctcagagaggggagccgaggaacggccgaattaatcgaagtcggcacccaacgcttcgagtttgccgcggaagtcggcgtagcctcggtcgatcaggctgatgccgtgcacgtccgaggggcctgacgcggccaaggccgcgatcagatggctgaacccaccacgcaggtccggcacgtcgatgtcgcgtccggtcagcggggtcggtccgaagatcacggcggaatgcttgtagttgcgctgccggaaacggcacggcagcgagcccaggcactcgcggtacaactggatggtggcacccatctcgaccagcggcttggtgaagccgaaacggttctcgtacacggtctcgtgcacgatcgacaggccgttggcctgggtcagggccaccacgagcggctgctgccagtcggtcatgaacccgggatgcacgtcggtctcgatagccacgggctttaggtcgccgcccggatgccagaaacgaatgcccttatcggtcacttcgaacttgccgcccaccttgcggaacacgttgaggaacgtaatcatctccggctgggtggcacccttgacgaaaatgtcaccgtgcgtggcgagcgcggcggacgcccaggacgcggcctcgatacggtcggtcagcgacgtatgcgtgtagccttgcagctccttgacgccttcaatgcggaaggtgcggtccacgtccacggaaataatcgcgcccatcttctgcagcacgcacaccagatccatgatctcgggctcggtggccgcgcccgacagttcggtcttgccttcggccagcacggcagccagcaaagtctgctcggtggcgcccaccgacgggtagggcaggtggatcttcgcgccgtgcaggccgttgggcgcggtgatgtggatgccgtccttgtgttccttgtccaccgtggcgcccagcttgcgcagcgtctccagatggaagtcaatcggacgtccgccaatcgcgcagccgcccaacgcgggaatgaacgcttcacccaaacggtgcacgagcgggccggaaaacaggatcgggatgcgcgacgaaccggacagtgtatccacgtcggccacatcggccagctgcacacgcgaggcgtcgatggtcacaatgccgttcgcaccgtccacatccacgtccacgccgtgcagacgtagcaaatcggacaccacatgcacgtcacgaatctccggcacgttcttcagcaccgacttgcccggtgccagcaacgcggcgaccatcgccttgctcacgaagttcttcgcgccacgcaccttgatcgtgccattcaaaggcttgccgccctcgacatgcaacacgtcatccggattctcagccacgccactctcctcaatcaatcaagattcaaaaaatgctaccgtccagtttgccataagccatgtgccgactccgtgaaatgcaccccagccgaactttgatcaccgtgcacaacggatcccatacccccgtcgaatcaaaccgataacgtgatcttcctcacatttgccgccacggcgttctccatacttttacgctacgattcagggcaatggcatcagacgccatggccacaagcaaaggagcattcatgaccacagtcgccgtcatcggctgcacgcacgccggcacgttcgccaccacctcgattctcgccgagcaccccgattggaccgtccatgttttcgagcgcaacggtacgctgtccttcctctcctgcggcatcgccctgtgggtgggcgaccacgtatccgacccgaagaaaatgttctactcctcccctgccgctctggccgaagccggcgcgaccatgcatatgcgcaccgacgtgacgtccgtggacctcgacgccagaaccctcacctaccgcgcgctggacgaggccggagaccccgccgaacagaccctcgctttcgacaaactggtcgtgaccaccggctcgcgcccggtcatcccgccgatccccggcatcgacagcccgcatgtgctgctgtgcaagaactgggatcacgccatcgccatcaaggaaaaggcgaaaaccgccaagtcggcagtggtgatcgggtcgggctatatcggcgcggaaatcgccgagcagttcagcgtcaccggcgtcaagaccacgctggtcgacggccttgatcgcccgctggccaataatttcgataagaccatcaccgatcaggtggcggccgcgttcgaggagcacggcgtcacgctcgcgctcggccagaaggtggtcgagttccgcgacaatgacgacgacaccgtcaccgtggtcaccgaaaagggcgagtacacggccgaaatggcgattctggccgtcggcttcctgccgaacaccgacctgctcaagggcaaggtggacatgctgccgaacggcgcgatcgtggtcgacgactacatgcaggcgtccgcgccgggcgtgtacgccgccggcgactccgccaccgtgttctacaaccccaccggccagcacgattacattccgctggccaccaatgcggtgcgccagggcctgctggtgggccgcaacatcgagacgccgaccgtgaagtacatgggcacgcaggccacgtccgccgtgcagctgtacgatctctcgctcgccgcctccggcctgacccgcgccggtgccgaacgccgcgggctcacggtccgcgagacctcgctcaccgaggattatcgcccggacttcatgctcaccaccaccccagtcacgtcgattctgacctgggacccggaaacccgcaaggtcaagggcggccagttctgttccaaggccgatatctccggcgcggcaaacgtgatttccatggcgattcaggccggcttcaccatcgaccagctcgccaacgtggacttcctgttccagccgaacttcgacaagccggtctactacgtcggcgccgtggccatgaaggcggcggccgagtaagacggctgtacccaccgcaaaaaagaaaccccggcgtgatgggcgccggggagagaaaggagagaagaagaaagaggttaagttatgcagcttgttcggccgtgattacatataacagcaacagtttcaatgcaacatgggcactgtctgggaatcgtctgggaatcacggcccgtacaggctgttgcttgtttttggagccgatttaccggctggccttgatcttgtgggccagttcggcgtcccacatcgcgccggtggcggacatcaccgagtccgcgccggcgtcacggtacgcctggtagtcggcgggcgagaccacgccgccgacgccgttgatcgcgaaatcgagcccgagcttttcacgaatcgcggccagacgggcgaccatgtcgaggccggcgccacgaatcgcattgccgcacacgcctgagcgatcgcggcccgcgccgggcagggcctgattgccattggcatcgaccagtttggcggaaatcgtattgatggtgctgaagccctgcacggtgccgtggcccacggtggaacgcaccataagctccagagcgtcgtcgctggggatgtaggcgagcttgaccatcagcgggatgtcgccgatctcctgcttcacggcctcggtgatgcggcccacgagcagcggattgtggcatagcaggcggttgtggccctcgttggggcagctggtgttcatcaccatgagcttggcaccggtctccttgaccaggcgggcggtagtggcatggtcggcgatgtattcctcctcgctcatgccctccacacgcgagccttggaagctcgggaccagcacttgaccgggaccggcggcctcgatggcggcgcgcatgtccggctgccagacgtcagggctctgcgagggcacaccgaagctgttggagatggaaatcggctgttcatagttggtgtcggccagcacgccttcgtccagttcggcgctgcccggcgtcagtgaaccgtccgccgacttggggtgtacggcgagcacgttcgggaacgggttgcagccccaggcgcgcgaacgcacggttttgtaggtcgccagatcgaaacccatgtggaaagcggccgtggtgaaacggctgttgagcagcgggcctgcgggaatgccgaaaggcaggttgaccggctggcccaaaaaggtggccaaggcaccctcggaggcaccctcgctggtggttccggcggcatcggcaccgttgccatccttcagcgcctcggcgaacgcgccgaacggcccttgctcatagttgtcttcgtaactgcggctgacatcgtaaaacggctcaaaatcactcatgcttcaacgataagccaacctgcatgcgcacacgcacactcaacccatcatcgcgccgacaaacgaaataatggcgaaagcggcattggctaccacaaagatgatgaacgtcggagctgcccagccaaagtacgtgtctggaatactacgattcgtacggtgatattggcgcatctctttgccgtatatcacgaatatgataatcgatccgatcacgccgatcacagatagcgacaatgagaatatcaaatatgcgttgtcatcaagatagttgccggcaagggtatcgatggcgccggaaagaatcgcattgttgaagatgtgcagtgcaatcgaccaaaccaacgagtattccatggccacgaatcccagaatcaggccaaagaggaacgcgaatgtgccttgcactacgtcgtcatggaacaggccgaacaccattgccgaggtgacgatggcgaagttcttgcccaacggcttgagctccttcatcagtacgccgcggaacagtacttcctcgcaaatcggagcgaccagcccaacgtacagccacatgcttacggtgacgctggattcggcgatgctgtctgacgtgggagaggcaagatcggtgcccagcctggaaaaagcgacctgcaccaacataacgatgccttgcacgcccatgcccagcacgatgaacatcaacgcccagagaggctgcatgcgcccgccgccatattggctgatgtggccaagctgattgggctccccgtacgagtcgcgatgctggccaccaagccagaattcgcaggtgaagatgtcacggtggcgcatgagcagcagaaatccgaacgcgacgaacaccgatatcaggctgatgatgccatcccactgcacgccggacaaatcgctcgcggttattacgccgacgataatggtggcgaccattgcgcccaagagcatcatgccttcataggcgagagtcagtcccattacacgattgaccaccttgcgacgccacgtgcgccatacacggcgaggatcgatcggcatgaccacgggcattgctgcgggcatcgtggcaggcattgcgttgggcattgtgactggcattgccggagccgtttgcacgaatggttgcggcgcagcggaatagggttgtggcgcgtagcccactggttgagcgtagtacggatgagcgaggggctgtggagccgactgttgcgccgggtatggggaataggcggattgcgccggatacgtcggctgcgtgggatacatcggctgggcaggatacgtaggttggacgggatatgtcgggtatacgagctgcgcggcgtattgtgcaggctgcacagcaggtattgcggcttgcggcacaggttgtgaaacaccttgtgaaacaatccgtggaacaccccgtgaaacatcttgtggaggtagcggttgtgcccatgcctccggctgacccgcatattgcggctgcatgctcggcccaggctgaacatactgtggcgtctgtggcatcggcgtctgtgactgtgccgcagactgcggtgccggtcgaggtggcaacggttgcgctgacagcgattgcgccggagccgtatcggaatcgttcgacggattcatgtcattcatggtcatgatgctcaacctaaccgtcattactggatgaatcgtgattatgtccacaaatgtgtacgaattcaggcacagtatttcgaacgctaggacggagttcatgagtgttgaggaaagcgccgccacgccggtgttggtggctgcggtggataacgaccgtatggcgttgttggcactgaagggaatattgccgcaactcctgcccgccgcgcaatggatgtggggcgcgggcaccagtgagacctttgtttgatgcgatgcgagcgacccaataatctcaatcagacacagagccaacggccctgggcctgcaattatggactcgcctttcggcgaggctcaatgctggcctcgctgctgtcgcagctcggcacagggcctgctgaaagcccaccgggctttcagcaggccgatcgcggctaaataatgccgcgatcggccaacggccctgtccagtctgcgtcctcaggctcgcgggcggactcgattctttcttcggcccagtgtttggcggggatggtcttgggcttgaaggggaacttttcggcgcgcatcttttcgtaggcggcgatgtcgtcctcgtgctgcagcgtcagatcgatatcgtcgtagccgttcatcagacgccaacgcacgtaatcgttgacctcgaacggcagggtcacgtcgccgcaagtgacagtgcgggtctccagcgagacagtcatctcacgaccaggctcttcctccagtagcttccacaggagttcgacggactcctgcggcataatcgcggccagcacgccgttcttggcggtgttgccgtagaagatgtcggcgaagctcggcgcgatgaccacgcggaaaccgtaatcgtgcagcgcccacacggcgtgctcgcgggaggagccgatgccgaattcggggccggcgaccagaatctggcccttaccggcgtattccggcttgttgagcacgaagttcgggtctcggcgccatgcgtagaacagggcgtcatcgaagccggacttggtcacgcgcttcaagaacacagcgggaatgatctggtcggtatcgacgttggagcggcgcagcggcacgcccacgccggtcagtgtggtgagtttttccataacaattttcctttcggggatctctcccccagtcagtcttcgactgacagcccctcgtcagagggggctcacgtgtattgactcagagatcggcgggagacgagattgtgccgcggatggcggtggcggcggctacggccggcgacgccagatgcgtgcgcgagcccttgccttggcggccctcgaagttacggttcgaagtggaaatcgagcgctcgttcggcaccagcttgtccgggttcatgcccaggcacatcgagcagccggcgttacgccattcggcgccaaagtccttgaacaccttatcgaggccttccttctccgcctgcaaacgcacgcgggaggaggccggcaccaccagcacgcggtggatgttctcggccttgcggtggcccttcataatcgcggcggcctggcgcaaatcgtcgatacgaccgttggtgcacgaaccaatgaacacggtgtccacggcgatgtccttgatcggcatgcctggcttcaaacccatgtatgtaatcgcacgttcggcggcggcgcgcttggtggcgtcggcgatcttgcccggctccggcacggaggcggtgatcggcagaccttggccggggttggtgccccacgtcacatatggaccgagcttggtggcgtcaatatccaccaccttgtcgaatacggcatcgtcatcggtcttcagcgtcttccagtacgccacggcctgatcccacagctcgccttccggcgcgtgcggacggcccttcaggtactcgaacgtggtctcgtccggcgcgatcatgccggcacgcgcaccggcctcgatggacatgttgcacacggtcatgcgctcgtccatggtgaggttgcgaatcgcctcaccacggtattcgatcacgtaaccctggccgccgccggtgccgatcttggcgatgatcgccagaatgatgtccttggccgtcgcgtccgcgggcagcttgccgttgacgttgacagccatggtcttgaacggcttcagagacagcgtctgtgtggccatcacgtgttcgacttcggaagtgccgatgccgaacgccagcgcgccgaacgcgccgtgcgtcgacgtatgcgaatcaccgcacacgatggtcatgcccggctgggtcaggcccagaatcggggcgaacgcgtggacgatgccctgatcagcgtcgcccagcgggtgcaggcgcacgccgaactccttgcagttcttctccaaagtcgtcaactgcaacgcgctcgtctcgtccgggttcgggcgatcgatatcaacggtcggcgtgttgtgatcctcggtggcgatgagctgatccacgtgacgcggcttgcggccggccaagcgcaggccctcaaacgcctgcgggctggtgacctcatgcatgagcatcagatcgatgtacagcaaatcaggggctccgtcgctgcccttgcgcaccagatgatcggcccagaccttctcggccagtgtcgttcccatagtgattcctccaaaaaattccgcgcgaggtattgtgttcgcgccttgttcgtggtattagcctatgtgcttgcgatgggcccggccatgagcatgccggatattgagatacggtcaaatgatggcctcaatatgactcggacccgactcgaacatgacctagtcatgactcggttccgctccagacatgtctcttcggcatccacgaacgccctttcaacttcatggccaccctgtgagacacttccccgatttgccatttcactatgtgagatggcataatcgcccttattatgactgattcccgggaagaaccattgaacaacagcttgaccaagtccgagccggttgaagacaccaccgccaaggacgatggggaaatccattccggcgttggcgtccttgataaaactgtaaagattcttgacgcactggaatccggcccgtctacgctgggccagcttgtggccgccaccggtctcgctcgaccgaccgcacatcgtttggctattgcactggaacgccaccgtttcgtactgcgcgaccagcatggccgattcgtactcggctcccgtttcgccgaacttgccgccgcagcaggcgaggatcgtctgctgaccgccgccggcccgatcctgcagaccctgctcgatcgcactggcgagtctgcgcagatttaccgccgccaaggcgatcagcgcgtgtgcatcgccgctgtggaacgcacctccggcctacgtgattccattccggtgggtgccatgctgtcgatggaagccggttccgccgcccagattcttctggcttgggaggattccgaccgtctgcaccagggattgcgccacgccaagttcaccgccaccaagctggccgccgtacgcaagcgcggctggtccgagtccgtgaacgagcgcgaagagggcgtgtgctcgatttccgccccgatccgcaacgcctccggccaggtcatcgccgccatctcgatttccggcccgaccggccgcatgggtgccgcccccggacgccgctatgcgccgctggtgatggccgccggcaagtacctcaccgaggcactggtcaaagccgttcgctgaaacataccagtcaatccaaccgatagcccaaccggcagaaatcccgcgtcacaacgaaagagacgcgggatttctgccactaatcgtccaacacagcggaaggccaccgaaacctcgaatacttcgcgccgctttccgcctctatcaggaacagttacctgaataaaccggacagttgactccatagcgacggcttgcgcagcaaatcatcgccctcaccctcgccaggcgtggtctggttcaccgcataggtgtaggcgcgtttggaactgggcttgcccaccagttcgccaaactccagcaattgcgtacgcggctcgtaagggtgacggatatcaaattcgatcaatcgcgtggcacgtttggccggagccggtccgtacgtattgaatccgcaggttggcgtagcgataagcaacagaccctcatgttcgccgacgaaaccgttgcgatgatcatgaccagctacgacgccgaaatacccctcgcgcagcaattcgaattcgcctgacgtatcagggcaggatatgccttctcccaaatatccgccgggctgggtttgcaattcgtccagcacgtagtaggtatcggcgtgcgaacgatagccctgcatggcaaacgccgcgttggccgccaccggcttcagcacgttgtaatactcgggcatcggcatgtgctggaacaccattgatttcgcaccgatacggtcgggcacggcgttcaggaaggcgagcgctgcgggcgatggtgcgccgaagccgccgccatgcacgtaatcgccggagtcaagaatgaccagacccagcacattgcgcgtatggtcaacgtccataaccggcagcgcgaaggtgcctggttcaccggaacccactgcggatgtgggggaagacacagcagaaggcacaacagcatcggcaccagcatcgtcaacgacgcccaacgtatcagccttcgcggtaatccccgcaccggagccagtggcaccagacggcgtctgcacagcgccacccgctccacaggtatatgcaatctggttcggcaaggtctcactcggcggattgacacaaccggggaactcacgatagataccgtccagttccgcattgcttagcccgcattggaaatcatggttgccatacgtcacagcccacggaatgccgcgcgccgccaacggctcagtgaactggccaatggccttgcgcaccagcgctcgggtatggttcagcgcggattcggcaataggttcgtcacaccagcgacgtttacggaatgaatcggcgaacgccggatcgtagccggcgatctggttgccggagaaaatcaccagatcaggccgtgtggcatcaaggctggcctcaatcagggtgatggtgtctttggagactttcggcccatcctgaatgtcggcaatctgcagcacgcggaacttgccggaatagtggaattgcagtcgtccgagacgcgcagagatagagaccggacggccgtcttcggcatcggccggcttgatacgaggtttcgacgacatcccctctggcgtacgctgtgtttccgtcatgccctccactgtacacacaaacgaaaaggcccgccggagcgggccttttctacaagttcaactactggagcagaatctctgcacaacatcatcgttgtaacggtaagtctttccaatgcccgtccaacgtaacagtcctcgtgaccatacactatttgtgggctctgctctgttcagttgttcttgtacctcataatctattcatcactcccgtttctcgcaacctgcagagagtcgttgtgcgttttttatcacaactgttcaatcgcactttctggctatcggaaaacgagctgaaccgttcacatcgaacccgtccgatgttcgatttcgttcgtttcaccgccgctcacggcgtgtcgcgagcgacgctagcacactcaaaaccaaccaacaccgaactaacatgaacacccgttgaattctggcgcgttcagtcgttttccggccacgccaaagcttacgatataagctatggcacagatatttgacgcaccctcgaaggcaattctgcgcagccaaatcgcagagcatattgccgaaaacgacaacaacgaccgccgcgtcgatcaggaaggcgaggcaccgctgcccaaggaccgtttcttcgaccgcgagctcagctggctcaagttcaaccagcgcgtgctcgaatgtgcggagaacgaagacatgcccctgctcgagcgcgccaacttcgccgcgatcttcgcctcgaaccttgacgagttcttcatggtccgcgtcgccggcctgaagcgccgtatcgactcgggcatcgccgtgccgtctgccgccggcctgagcccgcgtcagcagctgcgcgcgatcagcgagaccgcacaccgtctgcaagacgagcacgcacattacacgatcgacaccattctgccggaattggagaaggagcgcatcgtcctgctgacgtgggacaagctcacatcctccgagcaggagcgcctctcgcgctactaccgccagcaggtgttcccggtcctgacgccgctcgccgtggatccggcccacccgttcccctacatttccggcggttccatcaacctggccgtgattgtggagaacccggcctccggcaagtcgcacttcgcccgcgtcaagatcccgggcaacctgccgcgcctggtgccggtggacgacatgaccgatgaggagtccaaggacgagcgttacggcttcatcgccatggaaaagctcatcgccgcgcatctggaatccctgttcccgggcatgatcatcaaggaggcccgctccttccgcgtgactcgtaacgaggacatcgacgtggaagaggatgacgccgagaacctgctcaacgccatggagaaggagctgctgcgccgccgcttcggaccgccgatccgcctggagatcacggacaccacgagccccttcctctcccagctgctcgccgaccagctcggcgtgagccaggacgaggtataccgtctgcccagcccgctggacctgaccgtgctctttgagctcggcagcgtggaccgcccggacctgaagaaccgtccgttcgtgccgaccacgaaccgtcagatcgccgaggtcgagtcctcccgcgcacaggatattttcgctgccatccgcgagcgcgacatcctgctgcatcacccctatgactccttctccacttccgtgcaggccttccttgcgcaggccgccgcggacccgaaggtgctggccatcaagcagaccctgtaccgcaccagctccaactcgccgatcatcgacgccctgatcgacgccgctcatgccggcaagcaggtgctggctttggtggaaatcaaggctcgtttcgacgaggacgccaacatcgcgtgggcccgcaagctcgaacgcgccggcgtgcacgtggtgtacggcatcgtgggcttgaagacccactgcaagctcatcgaggtcgtgcgtcaggaagcggacggtctgcgccgctactgccacgtaggcaccggcaactacaacccgaagaccgcgcgactgtacaccgatctgggtctgctgacctgcgacccggtggtcggccaggatctgactcgtctgttcaaccagctctctggttacgcgccgaagtccagcttccaccgtctgctggtggccccgcgtaccgtgcgcaccggcctgattcagcgcatccgccgcgaggaggacgccgcccgcgccggcaaggaggcctggatcaagatcaaggtcaactccatcgtggacgagaagaccatcgacgccctgtaccgtgcctctcaggccggcgtgaagatcgacatcgtcgaacgcggcatctgcgctctgaagcccggcgttcccggcctgtccgagaacatccgcgtacgttcgattctcggccgcttcctggagcactcccgcatctacgccttctgcaatgcggacggcccgcagatcggcgagggcccggcttccggcccggaggtctacatcggttcggctgacctcatgcaccgtaaccttgatcgccgcgtcgaggctctggtgcgcgtcaccgccccggagcagattgacgagctcatcaagtacgtggacctgcagatggccgactccaccatgagctggcacatgcagcccgacggcacgtatgtgctgcacaccaaggacgacgagggccgcccgctggtcgatagtcaggaatacctgattcgcaagcaccagcgtcgccccaattcacacaactgatttcactcgatgctccctgtcagcgcaagctaactgagggtggttacgatgcccggctcctctttcgagaggatgccgggcatcgttgttcagcgcgcaaaaactacgtagcagcggtccaacgtgacctacaatacaagagatgggtacgaacagtatgagacgaatcgtggaagccgccggcggtattctgtaccggtggaaggatgatgccgagccgacgcgggcatcatctccatcagtgaaatccaatattgccaccgatggcaccatcatcgcgaacaccacggattctgacggcgagaccacggcagcacccggcgcatcggacgcggcttccaccccggacccggcgcaggccgacagcccagccacagcggacaacgtactcaaccgcatcgaactgtgcatcgtgcatcgcccgaaatacgacgactggagctggccgaaaggcaaggtcgacccaaacgaatcacaccggcatgccgccgtgcgcgagatcggcgaggaatcgggcctgcccgtggaacttggcccctatctgggcgacatcgagtacccgctgtccgaagaaggcagcaaacagcgccataccaaggatcggtcggcggacaccaagcacatccagttctggatggccacgccaatcagcgccatcgacaatctgcggcgcacccatgcgtttggcccggtgcatcgggcggacatcggcgaaatcgacgaagtcctgtggttgacgccggccgaggcccgcaagaaactcagccattccaccgataaggacatccttgcgctattcgttgaccgggtgcaggagggcgcgcttgacgccgtgccggtgattatcgtgcgccacggcaaggcagaagcgcgcaaactgtggaagggctcggacgagaaccgtccgatcacgccgcgcggcgcggctgcggcatacgcgctgaaccgcgagctggcgtgtttcaatccgacccgactggccacgtcgccttgggtgcgctgccaggagacgttggagatgttcgcgtggcagaccggacgagacatggttcatctcgatccgctcaccgaagatgcatacgccgctgcgccggacaccgcatgggagtgtctactcagcgaaatcgagttcgcacttgagcgccgtcagcccatagcgatatgcatgcaccggccggtgattggtggtatgttcggacacctgcgcagcatgtgcgttgcgccgtctctgagcaaacgcctgatcgccaagacaccgttcatgccgaccggcacggcggtggcgctgttcgtcactccgacgcctcatggtcccaaaatcatcgatattcagaaggttcaaccgcttgtctactagacccgcatttcctgattcatccaactcctcggccgctgccgctgcagctcatgccgcgcacaatggtgccgccggcagtctgggcccgggcttcggctcgttgcgtgcggccggagcggcattcggacctgctcgcatgggttcttcacgcccctcgcgcccggctcagctcgacccggctgtggccgatggattggccggtggcatggacccgcaggcgttgagcgagatgagtcatctgtctgctgccgcattgctggatcgtgtgcgccatagcgaagacccggcggttgttgagcgggtgctcacgttggtggagacggtcggcgtggatgaaatcgccgaactatggagcgataccgagccggattcgctgcctggtgtgctgtggcgactgtatatgttgcgtacgtggatgcgatcgaatcgcgactcgatcgcgcatctgtggcgcttgggtgagccggtggccactaccgcctccgccatcgccggcgtggatcaggctcccagtgaagatgacatcgtgcgattggccgattcgattctctccggtgcttttgtgggcgattttgccgtggcgcttgagcgtgcggcggcgtttaccgatgtggtggcgttgggcttgcgcgtggaggcgcggcgcatggtgacccgggccgaggccaacggcggcttctcctcggatgccgatgagaaggccgtgcgcaccaaagccgcccgccttatgcacaccgccggcagcctcatggccaccgccaaggatttccaacacggtgccaacctctggcgtcgcggacggttggagtaaccccgctccaggctccctctgatgagggagctgtcacgggcgatgcccatgactgagggagaaacccaccaaccgcaccccaacaatcagctaccagccaacaccacacctcccccggcgcggcgagccccatcgcaagctatactgagtatccgcgtcggaccgtgcttaagccccgggctccattttttgccgccgcgagcggcccttgcgccgacaggcgctttcgcggttcggcgcttcttttcttttaccagattcacgccccgagcgttgcgatgggcacgaccagtatgccgtcattgcggcgataggccttcccacctcggccggtaaggaacatcatgaattcggggtctcggacctgagccatgggattgccgcagattttgttgcggaaggatttgagcttatccgcattgtcatcgttcaccttaaggtcactgagttttatttcgatggcaccccacctgccgtcagacaactcgataatgacatcaacttcaagccccttgtcatcgcggtaatacgcaatgcgattcccggcacccggcatagccgacagatatacattcaaatcacgaatgcacagcgtttcaaacagatcgccgagcgtctgtgtatcgcgcatcagagtattcggcgcggcacctaaaaccgcagcaggcaacgaaggatccacgaaatatcgcttgggcttggttcgcacacgactctttgcgcggagtggcggttcccaaccctccaaatccgtcagaaggtacaagtccttgaacatttccaaatagctcttcaccgtctgcgtatccggctcacgccgctcatcgccatatgccatatccgcagccagcgtcgcatattttggtgcctgcgagatgttcacggcaagagctcgcatcaaagctcgtgcagtttcaggattcttcttcatcttcggcacgctgatatccagcacacttgcgatatattcgcccgggatttccaaggcgaattcatcgtctagctcaagattcgcgggccatccgccacggcaacaccatctggcgatgtcttcgatactcgtattgcattcggcaggctcgaatttcccctcgaacaaatcggataggctgaccgcgcccgtggattctccggattcagccaagctcatgggccacatgcgcagacgagcaatgcgaccagtgccgctgtgatgaatggcgtcacgatcctttggaatagccgaacctgtaagaatcagctgccccttgcggttcgcattgtcatctatatggcgacgagcggcatcccaaatttgcggtacatcttgccattcgtccaccagatggggctcctcccccatcagcaccaatgcaggatcggtttgggcggccgcgaaaactgccacatcatccagacgatcaacgcttcgagaccgggagagcgcggtccatgtcttgccgcaccatttcggcccaacgatttccactgcaccgaacgccttgagcagtttacttaatctgctatctaccacgcgtgaacgataatcaggcctggtcaaggtaccatcgcgaccactcaaatcgttcatattgcagcctttcccagttctatcgttctaacaatatagattttacaccagtttcattcccgattttacacctatctcattcccggttttacaccagtttcattccctgttttacaccgtgttgttttttacgctttaccctctcagaggtatcagaggcagatctcggcacggacagggcattgtcctgctgcaactggcctatcgcagcaaaaagtcgaatcacccacaaatccaatccgataagcaagccgcgccattaccaattcggcaggtcggcaaacttggactaggctgggaatcatggaactccatgttttgaatcatccgctggtcgagcacaagctcaccgtgctgcgcgacaagaacaccccctcctccaccttccgcgagctcgtctccgaactcgtgatgcttgaggcctacgaggccacccgcaacctgtccgtggtggccgcgccgatcgagacgccggtcgccccgatgaccggcaagaagctcgcctccccgcgcccgatcatcgtgccggtgctgcgcgctggcttgggcatgctcgacggcatgacccgcctgattccgactgctgaagtcggcttcctgggcatgaagcgcgacgaggagcaccccacccagcaggtgacgtacgcgaaccgtctgcccgaggacctgtccggccgccagtgcttcctcatcgacccgatgctcgccaccggcggaacgctggtcgccgccacgcactacctggccgagcgcggcgccaaggacgtgaccgcgatcaacatcatcgcggcccccgaaggcatcaagtacgtcgaggagcacatcgacccgtccatcgacttcaaggtcgtggtgtgcgcggtcgacgaacgtcttaacgacaagtgctacatcgtgccgggactcggcgacgccggtgaccgtctctatggcgtaattgactgatttccctggctcccctccccgaggggagccaacataacggaacatctatgcaaatcgacattattgcgccggggcgcgtgaaggagcgttaccttcgcgacgccattgacgagtattccaagcgactttcgcgctactgcaagctcaacatcattgaagtggcagatgagaaaacgcctgaccatgcctccgaaggcgttgaccgacagatcaaggccagagaaggcgaacgcatcgccaagcatctgaaggacggcgcgtttgttattgcccttgccatcaatggcaagcagctgtccagtgaagaattggccgccaaaatcaacgaccttggattgcgtggcaccagccatattcagctggtcatcggcggttcaatcggccttgacgacgcgattctgcgtcgtgctgattttctgctgagtttctcgaagatgacgttcccgcatcagcttatgcgcgtgattctgctggagcagatctatcgcgcttataaaatcaacgctggcgagccgtatcacaagtaaaacgccatacctcatggggcgggaaatcccccatggggcggtaattgccccatgaggcggcaaaatcctcatggggcggtatgccaaaatggcttaattccgcggtttcacatattcttcaaaccgccccatgggcaagttaccgcccgatgagcctgtaaccaccccatgggcgcatcaataacgccctcaacctcacactgcgtcggggacgaacgcttcgaagatgtggcggtcgaagtagggggcgcactgggcgagttcatcgctgctgcgcacggtccatgaaaccggcatcgcacccatcgaacgagcgagcttgacttgcggcgaagcgccaccggtccagtcataagccacgaaatcaggacgagacagccagtcgaacgccagtaagccggcggcccattcagccgcaccattcttgctcagcttcgccggccagctcagctgaccgcggcacacctcagggtgatgctccttgtaccaattcaccgcgcccgggtggaaggattcgatcacgtacgggccgtcatacgcctcaagcaaggcgtggcccttttccatgagctcttcgctacgctcatcccaagccctgttgttgctgaacttgtattccacaatcagcggagcctggccggccaccacgtccagcacatcggagaacagcggcacatgctggtagtaccccttcggcgcggcggacggcgtgaccaccagcggcgggttcgcgtcggcacccggcaacggttcggccttcaaatcgcctgactcgccgttcgggaagagcggaatacgggcgagttcgtcgtaagtcaggtcttcgatgcggcgcggatcgccggccacgcgcaacaaatcggcgtcatggaccacgaccacttggccgtcgagcgtaagctgcacgtcgagttcgatgccatagccagcctcgcaggcggcggcgaacgcggccagcgagttttcgggagcaatcggaccggtcatatccgcactgccgtagccggccttgacagccatgcgacgggcaagcgacacataatcatcgttttcggcgatggatcgctcagtggtatcggcttgggcgctaaccggattatccccaccataatcagcgatatcggtatagccgaccaaaccagaacccgcatcatgcaagccacgatgggcataccatacctccggaatggagggcacgaaattacgacgcttgtcattgaacgtgcgcggggccacggcccacacggcagcaccggcggcggccacgcctgccagcgccacgtttctccagagcttcgacgacattggaatccttcctgttgggctgcctctagcctaacgcttctgccagccattgtggagtggttggatcatccggtttcagcgcgcggtccaggtggttggcgcgcagtggctcccagctgaaatctgccagcagatcggcgggtttgcaaggaattggagtgggttgcagacgcagcagccaggcgcagtatccgatgatttgctcgggggttacgttgcgggcgcgcaaggctcccatatccagcgaacgttcgcgcttggctaaacgccggccggccgcattgtcgataagcggcaggtgcgcatactcggggtgctcggcgagaggcttttccgtgttgccgcattccggctcaaagccgccagccaacagacactggcgaatccacatttgcagcgcggtggagcgcagcagatcacggccgcgcacgatatcatcaacacccatatcgaggtcatccacgaccacgaccagttgatagccgaacagtccatcggctcggcgaatcacggaatcgcctacctcgcgggccaaatcgtagtgctgtggactatagacacggtcgttaaagcatgcgacaccatcaacgattccggcatcgccctgctgttccggcggcacggctcccgacagcgcagcggaatcgtcaggcactgtacgttgcttttctcccgctgccgattccggcatggcgatacggatggaatgctggtcgccgcgaaccaaacgggcacggacctcgtcgggatggtcgtgcagcaggcggcggcacgtgccggggtacaccatgaagccgtcgccctcgttgggggccgaggcggcgcgaatgtcggcacgcgagcagaaacaggggtacagcacaccttgcgagcgcaggcattcgagagcgtattcgtatcgttcagtgcgctgggattggaacatcggttcgccatcccagtcgaggccgagccaatgcaggtcatccatcatgagctggtccgcaccggcgaccacacgcggcttgtccacgtcctcgatacgcatcagcatgcggtcgccacgcgagcgggccgaaagccatgcacccaacatggcgtacacgttgccgatatgcatgcgccccgacggcgtcggcgcgaatcgtccagtcactggccctcctcgtatgaagttcagcaccatggtagcgaaaaggctctcctcctcagaggagagccaatatagtgaagctcgccagcccgaactcccctcagtcagcttcgctgacagctttgctcagagaggggagccagtgattgtcacttgtcttcggtgacgttgtccacgctcacgtccggattgtcggagacaatctggtcgctcgcccaagcggagagctccagatgttcgccgccggtctggtcgacgagcacggtgtcaccgtcgtggaccttgccggccagcagcatacgggccagctggtcgcccacttcggtctgtaccaggcggcgcagcggacgagcgccataagccgggtcgtaaccggtgttggccagccattcgcgagccgagtcggtgacgtccagcgtgatgcggcgatcggtcagacgctgggacacgccagccacctggatatccacgatgccgccaagctcctcacgcgtgagcgggtggaacatgacgatgtcgtccagacggttcaggaactccggcttgaagttcatgtggacggcgtccatcacggcctttttcttggcgtcggcgtccatgtcctcgttcacgaggaactgcgagccgaggttagaggtcatgatcaggatcgtgttcttgaagtccacggtcctgccctggccatcggtcaggcggccatcgtcgagcacctgcagcagcacgtcgaagatctccgggttggccttctcgacctcgtcgaacagcaccacggaatacgggcggcggcgcacggcctcggtcagctggccgccctgctcgtagcccacgtagcccggagccgcaccgatcaggcgcgagactgaagccttctccatgtattcggacatgtcgatgcggaccatggccttctcgtcgtcgaacaggaagtcggcgagcgccttggccagttcggtcttgcccacaccggtgggaccgaggaacaggaacgatccggtcggacggttcgggtcggagatgccggcacgcgaacggcgcaccgcgtcggacacggcggcgatggcttccttctggccgatcacacgcttgcccaggtagtcctccatatgcagcagcttctcgttctcgccctgcatcaggcggccgacgggaatgccggtccagtcggagacgatctcggccaccgagtcggcgtccacacggtccgggaccatcggctcatcggccgggttggccgcgccggcatcggcagattcggcatccgcgctttccgcggcggcgagttccttctgaatagccggaatctctccgtacagaatcttcgaggcctcagccagatttccctcacgggtgaacttgtccgcctgcacacgcaggtcatcgagcttggcacgcaggtcaccgaccttgttgtggccggcctgctccgcatcccaacgcgccttgaggccgctgagcttctcacgggtgtccgcgagttcggcttgcagcttgcccagacgctccttggatgcaggatcctcagccttcttgagctgcatttcctccatttcaagacgggtcaccttgcgctgcagttcatcgatctcctcaggcgaggagtcgagctccatacgcaggtgggcagccgcctcatcgaccaggtcgatggccttgtccggcagctgacggcctgagatgtaccggttcgagagggtcgcggcggcgaccagcgcgtcatcgccgatcgtcaccttgtggtgcgcctcgtaacgctgcttcaggccacgcaggatggcgatggtgtcttccacgctcggctcgcccacgaacacctgttggaaacggcgttccaatgccggatccttttcgatgttctcgcggtactcgtccagcgtggtcgcgccgatcaggcgcagctcgccacgggccagcataggcttcagcatattgccggcgtccatcgagccttcggccgcacccgcgccgacgatggtgtgaatctcgtcgatgaaggtgatgatctggccgtccgcgttcttgatttcgttgaggacgctcttcaggcgctcctcgaactcgccacggtacttcgagccggccaccatggagcctaggtcaagggagatgagcttcttgccttgcagggtggtgggcacgtcgcccgccacgatacgctgggccaggccttccacgacggcggtcttgccgacgccgggctcgccgatcagcaccgggttgttcttggtacgacgggagaggatctgaatcacgcggcggatttcctgatcacggccgatcaccggatcgagcttgccttccttggcggcggccgtcaggtcggtggagtacttctccagggccttgtacgagccttccgcgtccgggctggtgaccttcgcgccgccacgcacgccgggtacggccttgcgcagggaggctgcggtgacgccgttcttctccaggatttcggccgactggttcggcttgctggccgcgatgccgataagcaggtgctcggtggagacgtattcgtcgcccatctgctgcatttccttctcagcctgggcgatggcggcggtcagctggcggctggcttgcggctgcgaagtgctggagccggatgcgctcggcagtgcgaccaaagcgttacgcacggcggcgccgatggcctgtgggtctccgcccgcggcctcgatgagggagcgcaccacgccgttttcctgacgcagcaacgcatccatgacgtgcagggtctcaacctgcgcgtttcctgcggcggacgcactctgaatcgcgtcgccgacggcctcctgggccatagtggtgaacttctgttccatatcgtattcctccatatcatgcggcccgcgcggagcggctcgcgggcttcgaaagccctgcgagcgttgcgacagaccgcagcttgtcgttgtctgatatggtcaaccgacctggaacccattctattcccaaaacttgagtgcatatgactcaagttttggattttggtggggagggtgactagtagccccctctgatgaggaagcttgggcagccgctacttcagtgcgccgacggcggattcggcggcggcgaggacttcgccggagagaatcgcctcggccacgccctcaatctgcggggtggtccaggtatcgcgtacgtcggggccgatttcgttggcgtactggcgcaccacgcggtatacggcggcgcccgccgcacccggacggtacggcttgcggaagtcgaaggagcggcaggagcacagcagttccacggccagcacgcgcgcaaaggccggaatcgaccggcgcagcttgcgggcggcggcccaacccatcgacacgtgatcttcctgcatggcggagcttggaatcgaatcgaccgaggcaggcacggcgttacgcttcatttcggagacgatgccggcagcggtgtattgggcgatcatgaaaccggagtccacgcccgggtcaccagccaggaacgccggcaggccgcggttgcgcgccacgtcaaggaagcggtcggtacgacgctcggagatagaggctacgtcggcggtcggaatcgccaggaaatcgagcacataggccagcggcgcgccatggaagttgccgttggactccacacggccgtccagcgtgacgcacgggttatcgatggcggaggcgagttccacgcccgccacggaggccgcgtattccacggtgtcgcgggcggcgccgtgcacctgcggggtgcagcgcagcgagtaggcgtcctgcacacgcacggtggagcccgggcggccggcctcaatcagaccagagtccttgagcatgcgggcgatgttcgcagcggaatcgccttggccgcgatgcgggcgcagcgcctgcaagtcggcggcgaatacgcggtcgttgccgagcatgccttccacgctcatcgcggcggcgacatccgcggtcttgagcagcaggcgcagatcggtgatggccatacacaacatgccgagcatgccgtcggtgccgttgaccagcgccagtccttccttctctttcaaatcgacgggcgtgatgccggccgcacgcagcgcttcgccgccgccgatcttgaggccgtcagcgttgcgggcctcgccttcacccatcgccaccaaagcacaggctgcgagcggcgccaaatcaccggagcatccgagtgaaccgtattcgtagaccaccggggtgatgccggcgttcagcatatcggcgtagacctgcgcggtttccgggcgcacaccggtgcgtccggtgcacagggtgctcaggcgcagcaccagcaggccgcgcaccacctcacgctccacttccggtccggcaccggcggcatgcgagcgaatcagacttttctgcagctgcgcacgctgttccttggggatggaggtggaggcgagcgcgccgaatccggtggagataccgtaatgcggcacggtgtcgtcggccaaatgatcgataaccgcgcgactcagcgccatctcatgcttcgattcgtccgaaatcgccactttggcaccgccgcgcgctacggcgataacgtcctcgatgctcagcgctccaacacctacggtgaccgtctgctctgccatgctcatacctttctatatatgtgccgcattccgcatatacgacatatgcggcacatgcttcgccggggatccgcgactgcccgcattcgctcaccgcacctgcccatcaacagcaggcgacgcaaacgcgaccaatcgctccccgagtaatcaaaccttggccatttcacctcagtcggatgcccgccataagccacttcgtccatcttgtgtctgaaatctcagacatgtaaggtgatggaaatatgagccatgcctcgcagcaatacgccttcaccgagccacgtaccgtcaagcgggcgcaggtgaagccatcagaacgggaacatcagacatcatcatccgcgccacgtgtctcgctggctccggcggccgaccgtacgctcgacatcctcgagttcatcgcgagcaatggtcagacgcaagccgccacgctcgctcgcgaactcggcattccgcgctccacggtgtaccaattgttggagattttggagcgtcacggactggtcacccgccttgccgagcagcgcgcgtacggcatcggactcaagactttcgagctgggatcggcctattctcgccaacatcgtgtatcgcaggtcgcgcatccggtgttggcgcgtcttgttgacgagaccggcgaaaacggacatctggccgtgctgcacggcaacgaaatcatttatgtgattgaggagcgcgccgcgcatcgcccgccgctagtgtcaggcgtgggcgtgcgcctacccagtcacctgaccgccaccgggcgggccattctgtccgcactcccccgcaatcaggtccgcgcgctatatcccaatcgtcaggcgttcaccgaccgcaccggcatcggccccaaatcgcccaaggagctggaggcaacgctcgccgaaacccaacgcaccggttttgccgaggaacacggagacgtgacgcccggctttgattcatacgccgtcgctgtgcgcgactacaacgactttcccatcgccgggctggctctcactttcgtgagcggatcgctgcgccccgaacaggagcggtcgcttaagaccaagctgcggcttgccggcacggaactgtcccggcgtctcggcgcggtcggcagtttgacatgaggattcgcgagatcatcgtgctgggctccttcgccccgatcacgattttctcaactaagttcaccgattcgctgaccggcaacgccaaactcgccggcttctcgctgacagtgacggccatcatcagcctggtggtgatgaccgccctgcacgcacttctgccgggagcgtaaggcgcgttcttggttccctcagtcagcttctccgcctggacggttcccctcagagaggggagccagaacgagtcacgcccgaacgattacgttgcgcagatcaccgatgccttcgacgtgcacgatggtctcgtcgcctgggtcgaggtggccggaggcgttcggggtgccggtcatgatgacgtcgccaggcagcagcgtggagaacgacgaaatggcggcaatctgctcggggatgccgtgaatcaggttcgcggtggtgccagacgccatcggcacatcctcgccgttcagcgtgaaggaaatcttggcgtccttccagtcgaggtcgtcacgcatcacgatccacgggccaagcggacaggaggtatcgaagcccttggcgcgcgtccacgtggggtcgatgccctgcagatcgcgcaacgtcacatcattgacgcaggtgaagccgagcacgtaatccatcgcgttctcgacggtcacgttcttggcgatacggcccatcaccacggccacttccggctcgaagttcatgtccttggagcaggccgggtacacaatcgggtcgtcggggccgattaccgaggtggacggcttggtgaagatcaccatgtcttccggcgcgtgggcgatttcggagtggccggcctcgtgcatgaactgggcgtgggcctcatagttcttggccagaccgtaaaccttggaggggatgaccggggagagcagacggatgccatcgccgtcgaccgggtaacgagtgccggtgggcttgacctggtcgccggccagcggatggccgtccagttcgatgaggtagtccttgccgtccgtttcgtccttctgcacgaaggcgtagcgcggcgaatcattcaaagaaaaacgtgcgagtctcatgcctgtaagcctactccttggcggttccttccgcagaagcatccgtccaaggagcaagcagaccggccttcaatcgaccaaaacgcacgttcgctgggattgctacttttcggtccaggttttgtcatacagcgactggccgctttgcgtgtgcatgatgacgcgcaatgatgccttgccgctggaggtcttgcacatcgagcccagcagattcgcggtggattgataggtgctgtccatagcatccagtgaggaagcggcggtatcgcctagcgaggcatagctgtcgtcgagcacgtactcgtacaccaaggtgtcaccgtcgacacggtagttgaaggtgatgccggtgtctgcaaacgtatccgcttcggattcaatggagtccttgaattccaaagagtcgacgaaatcctgaatcgaatcgtacagcccataatcgccgtcggttagatcgtcatgggtttcgcccaacgtgtcgtccagcgcatcgtcaagattatcttgagctttgctcttatcgctgctatcaccgttgcccgaagaggactgactatagaaggaatcggttttcgcctcatctatagccttgctggcatacgaggcaccgccgacgatcagcgcgatgaccagtattacctgtatcaccatgcccgccgcactgatgatgatgccggcgatggccaagcccttgcccttgccgccctgtttcttaatctggttgaggcccacgatgctcaggatcagaccgaggagtgagacaaggaacgagcagataaaaccggcaatagccaggccgttgtacttctggttcgcttcaggcggcacactgccgtaagaaccagaccatcccggctggccgttcggttggccgccttgcatatacgggttatagggcgtttgcggaggcacggccccgccgcccggatataccggagcactgacgctgccgtagaccggaggaaccgatccgcctgccggagccgcccccggatagggcgaattgggtgctgccggtgcgggcgcgggcgcagcggcaggagtcactggtggcaaagcctgcgtaggcggtaccggctgattggccggcgcaaaaggctgggtgggctgctcggcaggtgtaaacgcctgcgtaggctgttcaacaggagtgaacgcttgagtgggctgctcgcccgctgcgattgcttgggttggagcattgttggcggcggttcccgtttccgccgtcatcgcatttaacggctcagtcggattggcgtcagcctgctgccacggcacctggccgttcggattgacattcggatcagtcatgacatgcactccttcaactgcatcgcaccccacttgcgagatgcgcccctcgtcttacgcgccacattgtgcgttacagacaactgtactcctcgtggcgagccttaagtaccccaggaaatttggcttccaaaaacacaaaagcctgaaaccggctattgcctcagcaatattcagtcggtttcaggctaaatcgttaatcctctgacgaaacgacgatctacttcttcagcagcggtgcgacttgctcctcgtaagcggtcagggcggtgtcgatcacgttgtgcatgtcatagtacttgtacgtgcccaggcgaccgccgaacacggtgttcggctcggccttggccttggcctcgtactgggcgtacagtgccttgtccgcatccgtgttgaccgggtagtacggctcgtcgccgcgttcggcgaaacggctgtattcctcccacaccacggtcttgttcgggttctgggcatcgtggcgttccgggttgaagttcttgaattcgatggcacgggtgtagggtacgtccgcgtcggagaagttcatcaccgggcagccgaagtggtcgccctcgtcgtagcggacctccttgaagtcgaccgtgcgccacttgaggtcgcccagctcgtagtcgaagtaacggtccaccgggcccgtgtacacgacgggcacgcccgcggccttgagcgcggtcttgttgtacggctgggactcgtcgaagaagtccacgccgagctccacggtgatgcgcgggtcgtcgatcatgcgctccatccactcggtgtagccgtcggcgggcaggccctcccatgtgtccttgaagtagcggttgtcgtagttgaagcgcacgggcaggcgcttgatgatgtcggccggcagctcggacgggtcggtctgccactgcttgccggtgtagttcttgatgaacgcctcatacagggggcggccgatgagctggatgcccttgtcgttcaggttggccggatcggtgccggccagctcgcccgcctgcccggcgataagcttctgcgcctcggccggcgtgtaatgcgcatggaagaactggttgatggtgcccaggttgatcggcagcggatagacctcgccgtcatgcgtggcatacacgcggtgcacatagttcgtgaagctcgtgaaacgattgacgtagtcccacacacgcttattggacgtgtggaacaggtgcgcgccatacttgtggatctccgcgccggtctcctcatcaaagtacgagtacgcgttgccgccgatgtggtcacggatatcgatgatgcgcacgcgcgcgccggtgtgctccaccgcctgctgcgccaccgtcaggccaaacaggcccgcgccgacaatgactaggtctgggtattgagtagtttccggcatgcgcgcattccctttcataaagtcaatatatcaattattatgttcgatttccgagaaaatatcttactcacccaattgcaaatcggcaatcttcctagactgaccagaaaactggacacaatccaagaccagacgacagactcaaggcaatgaatggcatgttcttacatttctgcgtctttgcccggacccgttcgccgccacaaagacagagcgcagaacaacgcaaccaccaatataagcccccgcactcaggcaaacctcaggttacgattggtagatatgagcaattccgaacaggccctcgactcaaccaacgaagcagtcaacaaagcatccaacgaagcaaccaacccatcattcgcgccgcaacacattctggtcaccggtggcgcagggttcatcggcgcaaacttcgtgcactgggtggcgcgcaaccatccgcaggcccacatgactgttctggatgcgctcacgtatgccggcaaacgcgagaatctcgatggcgtgccggccgcgaacctgacctttgtgcatggcaatatttgcgatgccgagcttgtggaatccctgttttctgggctgaaccaacgctctgcagccgcagtacccccgattgacgccattgtgcacttcgccgccgaatcgcataacgataattcgattctcgacgcctccccattcctcaatacgaacgtgaccggcacgtacgtgttgctcgaggccgcccgccgccacgatattcgattccaccacatcagcaccgacgaagtgtatggcgatctggctctggacgaacagcgcaaattcaccgagctcagcccttacaaaccgtccagcccatattcggcgtccaaagccgccagcgaccacttggtgcgcgcctggcaccgcacgcacggactcaaaaccaccatcagcaattgcagcaataactacggcccctatcagcacgtggagaagttcattccccgccagatcacgaacattcttgccggcattcgcccgaaactctacgggcaaggtctggctgtgcgcgactggatcagcgtggaagatcactgcagtgccatctggactattctcacccgaggccgcatcggggaaacctacctcgtgggagccaatggcgaatacaacaacattgatgtgctgcacatgattctgaagctcatgggtcgtgacgccaatgacttcgaccatgtgaacgaccgccccggtggcgataagcgctatgccatcgacgccaccaaacttcagaccgagctcggctgggtgccaaagtacaccgatttcaaggaaggtctggccgcgaccatcgactggtaccgtgcgcacgaaagctggtggatgccggataaggccgggactgaggaaaagtaccggaagcagggtcattgataggccgttgacaggccgccgataggtcactgacagcgcaatcaatgaataccgattgcgagatttggtggcgaaaatatatcttatgttgtacaataatcatatatttcaattataaattgattattatgacttttaaagaacggtaatgcgatgattcgtttacaaagacttgttctagacaacatgaggaacatatcgcacggcgtcttggattttgacgatctgcccgctggcggcagcgtaacgggtatctatggacagaatggatcaggcaagaccaccgttatcgatgccatcgggatactgcgcgcgctgctatccgggaatatgctgccggacaccgccggcgatgccattagcgtcagcaccggtcttgcaaccttgacggcgacgctcctcatcggaggaaaacagaagcccagctaccttgaatacaaggtgtccctgcgtagagcgaacccggattcgacgcgagcgcgcgtcgtttccgagtcggttcgcatcggcgacgatctctcacgcctaggcagggaggcgttggggcatcggatggaggattctgagaccgatggtttcgtgtcaactccggtatatgtgtggcgctccatcgaggcggtcacctcggtgaaaaccgtggtctcacgcaccgctgatcgtgcgtacatggaggggcgctcattcctgttctcgcggtgtgccgcgcttgaagaccgacccgatgccgagttcctcatcgactgggtggtctcccgcgtgcgggaagcgaatggtgtgtccgccagatcactgacatacatcaacgaacgtttcgatgagttcgtacgcctacgcaagaccttatgcgattacgcgaccaatgatgtcttcgtatccactacccgtcgtggctcctatgccgcatatgcgttcatccccatcatggaggaggattccgcaggtcgcaacacagagtttctgttcgacctgttgcaaccgaacccgctgaccccgggccaggcgaaacgacttggacagaccgtggagtccttcgaccgcatcctgcccaccctcgtgcctggtctgcatgtcctgctgaagatcggaaccgcgccttccggcaaagatggcgaggaccgggtcaccgcggagctgttctcgcgtcgtggcgatatcacggtcccattccgctgtgagagcgaaggcatcatacgcatcaccgcgctgcttggctatctcaagcacgcgtataacgacgagaacgcgctggttgccgtggatgagttcgactccggcgtgttcgagttgctgctcggtgacatgctgtaccagttggcggacgggtgcgcagggcagctggtgttcaccgcccataacctgcgtgcgttggaagtgctgccgaacggctgcattcgcactacagtgaccgatcccaataaccggttcgcgatcatcccccgcaagtcctccacgaacaaccagcgccgacggtacctgacggccagcgagctcggctggagcggccccgacatctatgattcgcccataccacgcatgttcggcaacagtctctatgccgccggccatcccgatgaggacgatgacatcgacgacgatctggcagcactcaacacctccggaacgaaggtgaaccgtggctaaacgcaagatcgtcctgctggtcgtagaaggagcaagcgacgccagcctgctcgtgccggcattctcgtcgttaatcgagaaccgcctattccaagggcaggaattccactgcgacgtgttgactgcgccaaaccaccgtgaggagttccggcgtcgtaacgggttctatccagcggacaatcctgtccagacggtgcgcgaactcgtggagtactacctcagagaccacgaccgcacctggggccagctcggccatgtcatccagatctgcgacctagacggggcgttcacatctgacgatcgagtgcgggaagacccattggtggatggaacgcaatattcaacgaccgacatcatcacgccaaaccgcactatcctgattgcggatcgcacgaccaagcgaaacggcgtggatgccttgctgaaactcgatgggttcaggaagaagaacggccgcgccacgctcatggtcccgtaccgcctgttctacgtcagccgcaacctcgaacacgcatttcgcggtaggattgacaatctagacgcacagcacaagcagagcagcgccatcaaactagcagaccgctttacccgcaacccgaacctgttctctacaacccttcaatctcttcggcgaatacacggcaatccgacaacgtgggaggaatcttggcaatatgccatgcaagacctccactcactcgaacgcggtagcaacctcgcattcgtggagccatacttggcaggcgaactgcggtaaatccatcagaatagtttcagaaccatagctggtccgagcccagctagacaccaaagttggaaaacgtagcccagtgcaccttattctggttataaaacgtaagaacagggctcaaatttggttggaaaacgtaaattatggcgctattgctgttttcgtgggtggggtttctccgttgagttgttgagggagtaagagaagagcgctttccgggtaggatgttttcgaccaagataaacaaacaaccgcaaagcgcctgatgaacagcatattcaaccaacttctcaacgtccccgggttctaggtaaaagtgcaacgcctgtctatggttggaagtgttcaagtccacaaccgaagagaaagcgttgcactcgatatgaaagcctattcccacctgtcggcacaggaacgcatccggatcgacgagctgaggaaccgcgaggggctcggcgtgtgccagatcgcgttgaggatcggccgcgacaagtccaccgtcagccgcgagccgggacgcggcccgtggttcgcgtccgacgagaacgagtcctaccggccctacaggccgaaacggctgaaggctgtatttcgtcaaattgaggtggacgtgttcggcacttaatccgaacaccgtcggcgttcaacttgaacaccgacggcggttggttccttgttttgttgtttgtctggtttatttcatgagggagtgtctgttccggtaggattcgccgtggaagcggaggatactgccgtggtggacgatgcggtcgatgaccgcggcggccatgtccccgtcgccgaacacgtcgccccatctgccggactcgaggttcgaggtgaagatgacgctgcgggtctcgtagctgtccgcgatgacctggaacagaagcctggccccgtcgatgtcgatgggcaggtagccgagctcgtcgatgatgaccagcccggccctgcctatcgacttgagctcggcgtccaatctgttgtcgtccttggccttcctcaagcgcatgaccaggctggaggcggtgaagaacctcacgggtatcatgcgttggcatgcgagcatgccgatcgcgatggccaggtgggtcttgccgcagccgacgtcgccgtagaacacgaggtcctcggcccggtcgacgaattccaggctttccagctgttcgcggccccggtcggcggggaacgaggccatgccccggtcgtatccctccagggtcttgctctgggggaacccggcctgtttgagcagccgccgccgtttggattcggcccggctcgcgttctccttctcgaacaggttggccaggaagccgagctggccgggcgtggcgtccgccagggccttctcgagcacgctgtgtgtcaacggcaggttgcgggcgaggcccatgacctgttccggcgtggccttgtcaagaacgcggccgccgcgctgccgcggtttttgctggctcattcggcctccttcatgtatttgtcgtaacgcttcaaatcctgcccgccttcggttcccgcaccctcgaggatgcgtttggcacatgtgccgatcgccgcgcggtcgacggtccgtcccgcgttgatgacggtttccaccgctttgaccgtggcggcgaacccgcagtcggcggcaacggctcggatgtcgtcgagcagattggagcgcgtgcgtgcgtccatgcggtcgagcagggctcgcacggtttcggggaaatcgttcctgatcgggctttcgccccatatgcggggctttcgcgcgatgatcgcgagcaggctcgccggatccacctgggttttcgccgaatggccccaaatcctctccggcgtggtgatcgtttcgccgccggggccccgcggttcgatctcgaagacgcgcaccccggcctgcaggcgcatggaacgccatttcggtccggccggataccggttcgcgtcgatcgcggcggcgccggtcttgtcggttttcacgctcctccagtcgcacgggtcgaaccgcacgccaggcaatggaagcatgtggtccttctccgcctcgaacagttcgatcaccggaacatcatgccggcagtggtccgatccggcgacgcgtccgcactcgtcaagccacacgcgcgtcagcgtttggaagctctcggccgacggcatcggcaccatcaggttgcgcctgacgaagccgacggcgttctccacactgcccttcccgtggccggaatacgggtcgcggaaccgcggcccgaacccgtaatgcgcgcggaacagggagaacaagcgggtccgggcggccgtgccgtccggcctgcgatggcccacaccggtggcgttgtcgaacaccaccaccctaggcgccatgcccatgcgctcgaagatccacagcaaaccctggcacacgcactccgaggtctcgccgggaagggcgaccacccagcgcatgttcgaatacgggaacgacaccaccaggaaatgcaccacgcgttcgactccggcgaccacggccctggcctggccgaaatcgacctgcgcgcttcccggcgcccactccaactcggcgaagccgtccgactccacgcgatgctcccgcctccaacgcttgacccagcgccgcaccgacgaatacgagcccgtgaacccgcactccgccacgagccgctcgtacacgcgcgtcgcggtgtggcgctgcttgacgggcatgcgcagatccgcggccggccacccgtccacgacggccgaataccccgcgtcgaccagcgacctgcccgcatgccccgagccaaggggcttgggagagcaatccccgtggttggcgtacttgaccacggtcgtgcgcgatacgccgagtttccgcgatatctccctgtggctcaagccctggcggtcgagctgcctgatacgccgtcggacacacaccggtgtcgtcatttcctttcctcccgagaaccatcagtttggttgacaggcactcgggaatccatcaaggaaccggacgatgccggtgttctcattccaccggcgccatcaccgccgataccgtccaaattgaacgctcagagtgttcaggaacaagtgccgacagtgaacacctttattcgatcacacacacgtgtcgccctcccccacccaagaagcatccctcatcggcgcggcatcggtgtcgggacaacaaaaaaactccttccttgtgcaaggaaggagccaatgggggaaacggctatctgcgtctcaacatggcgaaactgttggactcgacgatgaacgccttgcggtcgttcttggccatgacgtcaaggacgacacccgtcacgaacagcagcagcccggcgatgacaagcatgaccgctccgatcagcgtggggaatcgggccaccatgccggtgttccagaagtccaccgtcaccgtgccgcacagcacgacgccaaggacgccgaggacacagccgatgccgccgaagaacgggagcggcttgtattcgcggatcatgcggaaaatggtgcccatcaccttgatgccgtcgcccacggtgtcaagcttgctgacggatccggcaggacggtcgcggtactgaattggcatctcgaacagacgcaggttgttgttcaacgagtggatggtcatttcggtttcgacctcgaagccgcgcgacaacacggggtaggttttgacgaaggtgaatgagaaggcacggtagccggtcatgatgtcggtgacgttcgcatggaacaggccgttgatcgaaccgcgcaccagacggttaccgaagttgtggaacgggcgcttgttctcttggaagtaggtggagctcaagcggtcgccgattaccatgtcgtatccttcggcgatcttctcgaccatggcgggtgccgcgtcggctgggtaggtgtcatcgccgtcggccatgacgtacacatcggcgtcgatgtcttcgaacatggctcggatcacgttgcctttgccttggcgtggctccttgcggacgatggccccttccgccgccgcgatctcggcggtgcggtcggaggagttgttgtcgtacacgtagatgtccgcctgcggcagcgcgattttaaaatcacgcacgaccttgccgatggtgacttcttcgttgtagcaaggaagaagtaccgcaacggaaacgttcgaattctcaggcatgcactccactatatctcttgtactggtctgcatggggaatggattataggtgatgctgcatacttgaagcaaatggatttatcgattcacattaattatcacgagtgtagcgtgacgaagtgttcgtcttgaatgccgaatcgcttttgaaataatcgttatagttgatctccatgttcgattggccagcggctataaaaagttcgcccacgcatgcatcatgtactgttttcatcacagtggtagctatggcaaattccatggtgtattgggcaagtgaccctttgattctaggcaacttgattgaattttttcctgctttatcgattgttgaagaactggcgtacttatgttttccttctcgtaaagtaacggaaatcgttttccccgatgaggatttctgagctgagccgcttaaggtggtggttttgttctgttgcagaaccatgctgtccattacatagctcggtaaaggaagggtggcgtttccgttttcttgtggtgttttcttgtggtgttttcttgctttcctgagcgtacgcaggaaaacagaatgaatgacagtgtcaatgagaaagttcttctaaacatctgaacaaatcatgaaggtggaacagcgctatggcgcgagtatagcggtttccaaacttgtttttcatgtctcggacttccgattcgtagataaagatgctgtgttctccagattagatatgagagcggacgcctgcggatgagtttccgcttctgtcggagatactttagcgttgatatgctaagggcgtgcaagttggagaaggaaaggacgatcagtgacggcaagacaaacagatatgtggcaaggctctgtcgacaggcgggaaagcagatgtcacggtactcactatgtatttgtggacgtgctgaacattgtttcctgctttgccgtggtatgtctgcatacgtctttaggtgtgttctctctgcaacatacttttctatgggcattccaagagctcatgcaggcgatgtttattttcgccgtgcctattttcttcatggtcagcggaatgaatcttttggactaccggaagaaatattctacgaaagtgtttttcaaaaaacgattcgtacgagtgggacgtgcgttgattctgggcagcatcgcttgctatttattgttcggtttgctccccggcctgttttatggagcgcaatcaatcgccgatggtttcggtcctgtcgatttttgcaagagattcctcaccaactccatcatcgatatttattggttcctgtattccatcatttatttgtacttattgactccattgctttcaaaaatcgtccatgaccgtcgtttgttggaatatgccattgcgctgacgttgttctgttcaatcctgattcctgcagcaaaagccattggaattaacgagaaatatttcagcccattgttgagctggccgctatttgcttccagtgccctgctgtatttcctgctgggatattatttagaaaactacggcttgccgttgcattggaatgcgcctgcatgggccgcaactttcctcggatctgtgacgttgatgttcctcggcggtttatgttggaacggtttcttccagaattcgatgggagtggaataccagaattatcttgtcggcatttcctctccgttatgtgtgatatccgcggtatcactgttcatgctctgcaaagcgctggagccatcccttcagcgtggatctgacagaatgaagtcgataattcgcaaagtgtccagcgtctcgctcggtgtatatatgttccacctactgctggtgaaccttacgcttggtgggcctttcgagcgcatcctgacgtttgggcaataccacccattcattaaggccattgcggtctatctgcttactggcattgccgtatatgccggcaagtggtgcatctcaaaggtgaaacgagccctactatcgaagtgagtcagcgtaggactcgcgtccggagagacgatttaggattcttcaggcttaaatgcttcagcgtaagtgatagaaacagtggaatgatatacagcataggcaacacatagcgtgttgcctccgtgtgcgtggaaatcggtccagcaaatagaacaagcattgtgatgaacattggcagattaagcatcaacagattaagtttgttcttcttggatctcagtatgagaaacatgatggcacaaggaagtattgtagcccaaaaggctttttgccatatgatattgaatataggcgtcgctgataatgtgtctgcgtagaatcgtccaatcgcattaccagctttggtgttatctgtccaaggaatatattgttcgatgttttgataatgatgtttggaattgttgattggaagcatcatgctgagatctcgttcttctcctgatgcgacattgaatgagaaccatgcgacggagagtccaccccatcctgctatcatgtcgccgggatgtttaaccagctgtttcatccatgtcgtgattaaggcatggacatctttagaagataattcctgtccttttatcggatcagctttataccaacagtaagcaccttggagttgatcaatatccatatggtaagtttgttggattttgtcgatttcggctgcgctcaaatcatccttatggtcatgcaccacattggcgacttgttgcatgggcacagcaagaatctcgttactttcccctggggcaatgtgcaatgctggcaaaataaaagtcggcacgattataccaacaaccaaataaggaacgctacctaaaacaatagtagctattttacaggaccaatgtttgacaacgaagcatgccaaaagaagcagagccagaacaatgatatacatgcctgttttttttgttaaggatacggccaatacatctaagataaagaaaacattaaatgaaacggattttaaaatttccccctgtgttctccaaagttcacagaatgcgatagagaagaatacgaaaaatggcgtattgaaagtatctttcgcaagagacatcgacatcatggggatgatggggaaaagggtaagaaatgcagcgataaagaaacggcatttccaaggtgtattgtatttgcctgtatagcagactgtacaagcgatggccaatgtggacagtagcgactgcacgagcactagcaggtacaatccatagatagcgttattgaacaatgctttgccaatatgtgcgaatccgacatacaaatacgtcatcatgaagggatgatgatcggtgaacggcactgaagggtcataatattccatcagctgccaggaagtatcgtaccagtagacgcccgggaaataagctacaaaatacggaatccagaatgccgttacgagacaccataacgtgataatggatcgaggagaccagtccattgtgagtttgcggaacgcttcaaacggtttactcagtgattcgttatggtgatttatgcgcggaactatttttgtcgcagcgaaaaacagtaatgtgaacagggcaatataaaagagagtgttcacataaagcagcgcatttcgagtgtcgattttgccctcatgctggccaataaaagaacacatgccgaacaacgtacccagaagaatggggacgagataagcaaagttatgttcggtaattctaaaactttttgtggcctgtttcaatgcgattattcccttcctcgaaccgcgcgaccgatggccttcgccatggcacgacggcgggaacctattggcatgagtggatcgacaatcttgcgaattgggttatcctctccaacggcgcgttcgtgctttggacgaagcgcttcttcagggattttcggttcgttcgccttgaccacgcgcttgagcagacgctcatagaacggggtttcacgtgcgtatttccaatagatggaggcgaaatcgcaatctggatcggtccatggcttttgaaaaccagcgtaatggatgatcttcggattgttacgcgacttcatgtatgcatcgtagatgtcgtttggcgcctgtacgaagaggttgccgacacgtccgccacaatcgtgcaccacgttccattcccatggcagatacagcacgttaccttcgcagtgcgcgttgagcacatcctggtcgttgtagatgaactcgtcattcgatgcgtaagcgagccattgctcgatggtgtaatgctcacgcatcgccttggtattgagcaccagcacgccagcctggaagtaatcgtaggggttctgcatcttcagcacggtcttcgcgtaattcatacgcttaccatgctttacgttcaaattgccaaggaaatcgatatcgcgcactgcgccaagtagcttgccctgcaaatcgatgttgtagagctttgcgatatcaccattgatgatgatatcggaatcaaggtacagcaccttgtcatagaacggcaggagcttttgaatcaggaaacgatagtatgtttccacgctgatatgggcgttgttggtggaaagctcatatccggcaagttcgcggtccacgttggtgaatcgcagattcatgttcgggaactgtttgaagaacccgcgcatacgttcctgcttgtcccaagagatgttgcgctgcagtacggtgacatcgtagaaatagctcggatcagcgttcttcatggctgagtacacggtagtggttagctgcggcacgtaattgtcgtccgctgcgaacaccactggaatgatcggcttatcagtgacgtcaagtggtttgagctgctcggctggttccggattggtgaagtgcacgcactgcagctccttgaatttccaattggatccgatgcgcttgtggtgcatgagatagatattcagcaggcgttcggaaagatgtcccggcgtacgcagtgcttccttgctgtacgtgctataactggtttccttgtcgaattcctcaaggattgggaacatccattcacaataatcgaagaagatttccttcttcatgatgaacatattgcagaagcacgccttgttgccattgaagaaatcctgcgcatcctccttataatcaggatacatggcgcacagaatctgataacagctcttcaaatcgtcatcgtgcagcaggggagaggcctcccacagagcgcgtgggcttccatacttgttgatgatttcgtccagattgccgaacggtgtggtgatgacgtcatactgtttaaccacgcgggcgatgttctcatcgtccagaccgtactccttctcagccttggtgtcgatataatcatccatgatttcgccgaacgcgttttcttcatgcacggtttcggaaaaatcgaaatagcggcgataatggcagaatccgtagtagtcggcatcaacgttcttccaagcccagtattgcgtggtcagttcgcaatagcgtggattgcgatcggagatgttctctccgtcggcatcgctccaataataggggaaacgggtggggttttttgccgatccaacatgaacgggctggaaaatgtcactggaaaaggtcgaaaccagcttatgcgcggaaacgaagattttaacggtctgcttcttttgacgcttatgcaaatcttgggtttccttgaattcctggatatgacgcgatgcggcatctttcatctgagtataggaaaccggtagcacatgaacatcctgggttaattcttctgccagagcggcccaatccagaaaagccgacgttgatggattgagatattcgattgaagcgtatgcgccatctcgcgcaaatctcattaacgcagttgcggtttccacctctccgataatcggggcgacggattttgccgcttcgattttgtcattatcagatactcggtctttccattcattcatcaatgtgaaggtaagtcgttccttcagtcgagtagctgattccttcaccaataccgactctgtggagtcagcaaaatgcttggcttcttcccagcaagacttgatctggctcgccgacatgaggaatttatcaggggagagcatgttgtccgtggtcacgcctcggccgatgttgtacacatatcctcgaatgtcggtattggtcacttccaagttggacatgctggcaagcacaagaaactcatagctgtcttccgctcgttcaagacgtgaacccgtcattgcatcgaaggccttacgacatatgctgcctcggaaggccttatgggtcacatgccagtctcttccatattcatttgttgaaatgaaaacttcggaaagcaattgtttctgattggaggcagacgaatttgcatttgcccaagtctcaaaatcacgagcggcatggctgctcatgccattctgttctttgcaaagcagaccgaagcgcaaaatatcaggcgtatatttttggatttccgactgaattttatcgagtgtcccctccgcgaaagcatcatcggaatccaggaagaggatgtattctcctgtgctcagagcggttccacttttcctggcgagatggagtccctcgttgttctctttatcgagaagacggattctactatcctgtgaagcgaagcgagaggccacgtcgtgagaattgtctgtacttgcatcattgaccacaatggcttcccattgagtgtaatcttgggcgagcaggctgctcagacactctggcaggtattccgcgcagttatagcaaggaatgatgatgctgaaaaaaggattatgaccggacatctattatttctttcttcggatagtggggaaaagagatttgatttgcgataggatacggatgattttcgtagaatgcggcgtctccttcggtacgggaagacgtgtctgcaaatctgcaaagtgtctgagcgcttgttcccggtacttgttgtactgcggagatgaatcgttgccggcgattgtttctgcagtctccttccactgcacgtatcgggattttttatcaaaggcgtctcccgcatcccaatgggaataagcgtcatctcgtgtgagacgcatcaattccgttgcgatctccatgtgagtgaagtttgcctgcatcgcgggaagaacagacaatttatcttcgtcggatagccgtacataccagtcgccaaacagcatctccaacaatcgtcggcggagttccacggcacaaggaagaagatcgaaatcggtgaagccgtttgcgtattcagaagctgtgcttatcagagttccataattcgaagagagcgaaatgaatttctgcttggacattggtttgaaagtggtgatacctcggcctaggtaatagcgatatccgattagctcattatggaaggtttccgtattcgcgaggctggcaataacgagccattcgtagctatcctgtcctctgccgagacgagagctggacatacggctgaaagcttctttgagaagttcggtccgatacagacgttgcaggatacgccagtcttgacggtgatcttcggaatcggtgaaagaagagaaggcgatttccggaccatgcagtgtgggtaaatctcgattgctgagccgaagaatatcggagcatgctgattcaggcatatcctctccgaaaagttcggtaccgaaatggagaacatcgaatgattgttgcgaagcgaacgtccttaaagagggcaatgcgttatttgcgagctcatcatccgcatccaggaaaagggcgtatttcccccgcgcacattccacgccgctttttctcgcgagatgggttccctcattttggcttttgttgatgattatgattcggtcgtcttcttcggacagctgactggcaatatgaaatgcgtcatctggactcgcgtcgatgacgatgattgcttcccaatcctcaaaagattgtttttgcaaagactgaatgcactttcgaagataaccaccattgttgtaggaagggatgatgattgagaaaaaaggactcgaagaattttctgccgattgtttattcgtcattttcttctccatgctgtgctggtatgggcgtggaaggcaacaattacattccacgccccatagattaagaatgcaatggataatttcagccgactacgccttcgcatttgatcgaaagaacatcgttgttgagcagtgcgtaatctccattcctggaatcgcgaatcgcgaagatgcaggcgtcatctccattcgcgaaggcgatggctttaggcttcttcggattgtcgggatcatcgacacgcaatgacgccacaatctggaaatcaccattgttgaagatgttgacaggcagcgcgaatcgtaccttgtggtggcctggattatggaacttatacagattggggccagggtcgaaggtcatacctcctcgtttcttatcaatcaaggtcatggtgaaatagaaatcgacatcctgatcaaagaagtactcgatgtcgaattcgaaaacatcatctttgccgcaaaccggcttggaggccgcaagaaccttaagccatgcttcattatcttgcttttcggccttatcggtatccggggaatcagtctgcttgagattttcaagcgtgtaacggtctgcgacatcgttcttgtcgccgctggcgatgatctcgccgtccttgatgaggatggccttattacagtacttcttcacagcatccatggaatgagtgacaagaatgaccgttttagttgggtctttcttgatttcagcaaagaagttgtcgcatttacgctggaacgcctcatctccaacagcgagcacttcgtcaagcaccaaaatgtcgccttgggctttaatcgctacagagaaagcaagacgaacctgcataccggaggaatagttcttgagcttctggtccatgaagtcctcaagctcagcgaactccacgatgtcatcatacatcgcgtcaatctgcgtacgagtgaatccaagcagagcgccgttcaagtacacattctcacggccggtcagttccgggttgaagccgacgccaagttcgatgaatggcaccagtttgcccttgacagtgaccgagccttgctccggggtatagatctgggagatgatcttcagtaatgtggacttgccggaaccgttacggccaacaataccgaaaaagtcgccttggcgtacttcgaaattgatgtcgcggagcacatgctgctcggtgtagcctttgatgcccttcgtccagtttaagaacgccatcttcaggccggtcgcctgctcagtgggcagacggaacattttggccacatggtcgaccttgagcactaccgggcgctcgtccttggcttcttcctgtgtcttttcagtcaatgcaatttcagccatgatcagagcacctccgcgaacttggagctgtatttacggaacacatgaatgcccagccacagaatgaacgcggacagcacgtacggcagaaggcatagcagtttgttatcgaccatgctccacacggtcggcacatattctggggaaagcaggttatggcgaatatccatgattacctgagtggaaggattcagcataagcaatttagccgcccaagagaaatctgggttgttagccaccatcgaaatcggatagatgataggtgtggcatagaacatggcttgcagcacgacttcccaaatatgcgccacatcacggaagtatacgaacagcgaggcgagcagcaatgccacgcccagccctagacagtacaactggattatgctgaacggtacgagcagcacgcgccaagtgtagtgtgcatgggcgaagaaaccgaacaaaatcaccacgcacaagttaatacctaatgaaatcatggaacccatcgtggtggaggccacgatgatgtaattcgggaaatgcactttgcgtagcaaatcaccgcgtcccacgatggattgcatgcccatgctggtggactcggagaagaagctccacaaacaggtaccgcacagcagcgaaatcgggaaggtcggggtgccgtcggagaacttcaggaatttcacgaacaccacgtacatcaccgcgaacagcatcaacggcttcaatacggaccacaccatacctaggaacgaaccttggtagcgcagctggaaatcggtcttcaccagttccttgaacaccaccatcgcgtagtggtacctcttcttgaggctctcaaaaaagtctttcacaagcattccatcctactagtgcgaagcgtttggacgcaaaatcatgtggcagtgcggttgatgcgctctccttcgacagtactctcatatattctagtgaggaaaggacgtttgtcttagtaaggcggaatatctcacatggttctcacagcggaacagcaccattcgaacatccgaatcttcgtgtcggcacataagcaggccacgtttcccaagggggagagcattcttccgatgcaggtaggcgccgctcacgccacaacccgtttcccgaacaccttgcatgacgatgaaggcgagaacatctctgccgaaaatccgcggtattgcgagctgaccgcgcaatactgggcttggaagaacgaagatgccgattattacggtttctgccactatcgtagatatttcgatttcacggataccccacataaggaaaacgattacggcgaaatcattgactcatatattgacagtcgcacgattgccgaatatggcatcaacgacaaggcgatcgcacatgcagtggacggatgggacatcatcaccacaccattgaacgatgttcgtcgtatcggcggattttcaaaccttaaacagcattgggacgccgacgaacatctgcggctgaatgacttacgccatatgtacgacattctgtgcgagcggcatcccgattacaagatggatgccgatgccgtactcaacggccgcaccgcagcattctgcaatatgttcatcatgaggaaagaaatcttcttcgaatacaacgagtggctattcccattgctggacgaattcgcaatgaccaccgacttcagcaagatggacatgcaggccacgcgcaccgtcggccatctctccgaacggcttttgaacatctttatcgcacacaagcagcgcaccggcgcagactggaaaatcaaacgactgcaatgcgtgcattttctgcatccagagccgaacgcgatactggaaccggtagggcaggagcgtggacgtgtggtgccggtggtgttcgccgcggacaacaattacgtcccgatgctcaccaccaccatctattcaatgctgaagaacgcttccacgaatcgtatgtatgacgtgatcgtactagaacgaaacataaccgacgagaacaagcgctacatgcggcagttctttgcaaggttctcaaatgccctgattcgtttcttcgacgtgaaccgctatctcgccggattcaatctcactaccagcaatgcgcacatcagcattgaaacatattatcgtttcatcattcaagaagcattgccattctactcgaagctgctgtatctggattgtgacctggtggtcaatggcgatatcaccgaactattcgataccaaactcggaagcaacgctatcgctgcagtaccagatattgatttcattggaaatctcaacatgaagaacggtgagcgtgctgaatacgttcataagcagttgcacatgcgtgacgcatatggctacttccaagccggtgtattggtaatgaatctcgaccgcatgcgcaagattcacacagtgcacgaatggttagaaatcgcttccagaccgggatacatatacaatgatcaagacattcttaacgtagagtgtgaaggtcttgtcacatatttggattattcgtggaacgtgatgcacaattgtgcaggccgcattgctggagtgttcgatttcgcacctgcctccatgtacaaggcgtatatgcaatcacgtaatatgccaaaaattgtacactacgcgggctttgataaaccatgggaaaatccatggtgcgatttcgcaccgctgtactggagctatgcgtgtgaaacgccattcgcggcacaaatggttgccacaatgagcggcgtggaacgccctgccccaccagaacaccacgaacgcgcaattgccgaagacagccctatgcgcaagtatgcggacgtgctggctccggtcggctccaaacaacgagaactgctgaaagtgatagcgcgcaaggcgcagggcaaacggtgagacagacagacagataagtcaccggttgttgacggaggcttcgtgtcctcgtcaacaaccgaccatggtttcacagggaagaattagtccctgcgaaacagatcgcgggtgtagaccttgtcgctcacgtccagcaaatcgtcattccaacggttggctacgatggcagacgagcgggtcttgaaatcagcgagatcatgggtaacctcactgccatggaaattagattcgcgcaatgtgggctcgtagatgagtacagggatgccgttcgctttgaactgcttcataacgtcttggatggcggactgacggaaattatcggaaccggacttcatggtcaatcggtagataccgatgatagggttctgaacattcctgacaagttccatcacctcagaggctacgaattccttgcgggtacgatttgcgtctacaatggcctcgatgaggttctgcggaacctgactgtaattggctaacagctgtttggtatccttcggtaggcagtatccgccatagccgaagctggggttattatagccgtcaccgatgcggggatcgaggcaaacaccatcgatgattgcacgcgtgttgagtccacggctttccgcataagtatccagttcattgaaatacgccacacgtaacgctagatatgtgttggcaaatagtttgatggcctcagcctcggtgacgcccaccaccaatgtgggaattccggtgctgccatcatgattaacgcgagacgtctcagcggaatcagcgccttcaacgagcagggacgcgaatcgacgtgccgcttcgacagactcagtatcattctgcggggcgccgacgacgatgcggcttggatgcagattgtcgtataacgcgtgtccttcacgtaaaaattcgggggaaaagagaatacgatcatccggaaggttcttacgtaactgttgcgtatatccaaccggtatggtggatttgatgacaatccaagcattcggcgcatatcgtctgaccgatgtaatcgccgcttcgacactggacgtatcgaagtaatttttcttttcgtcatagtttgtcggcgtggcgatcaccgcgaaatcagcatctctatatgcctcctgcggatctagcgtggcatgaaagtcaagtattctttcgccaagagtgcttttttccaagaaatcagtaattacagaatcgacaataggacttttcccattgtttaactgctcgactttctcgggaatgatgtcgagtgcatgaacttcattgtgctgagcgagcagcaaagcgacagacaatccaacgtagccagtccctgcaaccgcaatcttcatagtgtcagcctttccttacgcaatcctaagatattgtagacgcaggtcactgcaacgaatcaacgtagccagcatcttccaaatcgcacatgccgacgttcatcctgtacgggcgaaccggtaaccaatgcacatttcttgatgggtcttgcagaacgacgagcgaatacggctaaggagcatcccgaaaacgtaattatcgcgtcattcgtgaaaatcaaaacacgtcagcttccaaggacagaagaggcacgaaaagctcgcacggacgcaagatggcgtccgcacccggacccgaacccccagccgttggcatgcgacggtatgctggaatggtgaacagcatggcgtgcggcggcgtattcgagccgcgtaatatcctggtgaccggcggatgcggcttcactggcgcgaacttcgtgcgatacgtggcgcggaaccatccgcacgtgcacatcaccgtgctcgacaagctgacgtacgccggcaatccggagaacatcgccggcctgccaccgtcgcaggtcgatcttgtcgtaggggacatctgcgacgtcgcgctgttggagcgtatcgtgcccggtcacgacgccatcatccacttcgccgaggaatcgcacaaagataattccatcgccaattcggaaccgttcatccgcacgaacgtggaaggcacgatgcggctgttggaggccgcccggaaacacgacgtgcgcttccaccacatcagcaccggcgagaacgtgcgggacaggcccgggcacgacaggcgatacgcgatcgacgcatccaaactgcgcgccgaactgggctggtcgccgatgcacaccgacttcgccggcggactgcgcaacgtcatcgattggtatgcggaacaccgcgattggtgggtgccggccaaggaggccaccgaggcccgctaccgcgcgcaagggcagtgaaacgacggctgctacaggcggcccttccgcggcagagcgacgttgcgcagcagacgctgcacgggcttaagcaccacggtatcggcaatcaccgcaaatagcagcgccgccagcaacgtagcgccaaacatcagcacgctgatacccgcatacgaccatccgtccgtaggcacgggaatcctcgggccaatcagcaccttggacagtggcgagtgcaccaaataaatcgtgtaggaatatccagccagccagataatcgccttacgcacccgcgccgacgtaatgtgcacgtcgtaccggaagaacaggaacgtcgccattaccaccatcgcgaacgcaaccgtgaccgtgcgaccaacctgcatctgctggccggcgaacagatatggcgtggcgactgtccaggccagggcgaatggtgccaacgcatacacgccgcgccgtatacgcgcggacggcggatagtattccaacacgaatcccaacaggtagtagatcagcagtccacgccaagggaatgactgcaggaacgtcaacggatatccgacaagatcgcatatatgctcggcagcggctacggctgcggccagcccgaccagcaaccaggctcccgatcggcctatcgtacgcatcatcgcggccaggaacggcgttgccagcacaaacccggcaagcatgaacacgaaccaatagacggaatcgtcatacccggagaacagatcgaacaacgttccagacacagcgccgccaaccgaacgatgatcaatcaccaggtaggcaacgaatcccatgccacccgcatacagcagatacggcacaatcagcgagacaaagcgtttgtagtagtagcgcgcgtacggcgcgaggctaccgggatcggcttggcccgcaccgccgcctgcccgggcatcagagccagagcccggcagacggcccgctgagtgggtgctcaccggccggtcggcatcgaatgtcaggttgaaccggcccgataccataatgaacagcggattgcagaccatgaacagcgcgaacagcacggatcgcgtcacttccgcgctgccggcgagggtcatcttgacgggcatgtagttgttgatcacgtggacgccgatgaccagacacatcgccaccacgcgcagcagatcgtagttcacgtcgcgcggcttgccggcgacgccggaaacggaatcgggcatggtcatcacatggatcccgccagggacttcagatcgaccgggcagctgatctggctcttcaacttgtccaaggcgtccaggccggccgagggatcggaggacgcgtccttatgcgcgtcgttcttgccgccgtccgcgccgccgttcgcaccatcggcaccgttcgcaccatcggcgccgttcgtatccgccgtgcactcatcggtcacattaccgttggagcccgtctcgacgccatccgcattcaccaccggcgtggttaccacgttcagtggatgtgtggcatcgctgctgacccgaacggtataagcaatcgtcaattcttttccgggctcgatccactgctggttgaacataatgtactgacggtcatacaggctcgcggtgttggtaccccatgaatctatatcagcctgcacagcggtgatctcgccaccgtacggagcggtaagcaccacgcggtacaacatgccgccgagcactggattctccgagccgccattaacgaaatcaggcaacgattcggccttagccttagtcagcgtgttcttcatggtgaaggtgaccgtgtattcgtcaccgagctgatcttccgtaaactgacccagatgcgtgttacgcacggctgtcgtgatgcgcttatccagcacgccagaatacagggcgttctggctggctgaggcgtcgccgcaggtttttgtgaccgtggtggaggtcttcagataccaatcctgcttgccttgctgcagctccgaaagatagatgccggcttcgggcacctgactgtcagcagacaactcgccactggccttatcgtcgataagtccggtggcaatcagcgcctcctgctcatccggatcagccatccatagcttgaaatgaccgctagcgctggtatctctaattgccttcaacagcggggatgcggtagaggcattcgcgttgccaagcacatggttcataattgcttgagccgcttcggaaacgaagttgttctgctgctcgaagtccgggtaatccgtgtacaggtctgaagcgaagaacggcaccgtggtggtgctatccagcactcggccgtccgaaagcttgacctcgcctgtggctcccagcaatgcctggagaaatacgggatcgagtgacaatacacccgctacgttctcgtcttcgttgcctttctgatacagccacatgtatttgttcatctgtgccacacgctggaattcggggtcgatggtcgtggtggccgggtactggtcaaaagtgccaccaaatacctggcgctccttcagcaccgtatcatccattggctcctcaggaatgtcccaaccagaagtggtggcgaaatcaccgatggtaatcgtgcccttatctgccgtgattgcggcgatggtgcctaccatgccgcccgccgaacgtagctcggccgggttctgcaccatcaccaaatacgtgcgcttgccgtcctcgccaagcagttgcggtagcaagttaatgaggccatcgtattcgccgagcatcgaatccacggtcttgagcgcagccttttcggtttcgagcacggtggccaccttggcgacgctcggagtcggcaccttgttgagcttggtgagctgctgcgagatatccttatgcgcctgcttgacgatatccggcatatccatcagggcgctgacgtccaccgagccattcttcagggagaagccctgcaatcgtttggacaggttcagcagatcagtgaacggaccgttgaccagcgtatccacggaagccagcatttcgcgggcggcggtgatgtcgcttccgaatcgcgaatggtcgcggaagaagtcccactgtgggccgttcagctccgcattgagatcattggtggcattgaccagctcttgggagatgtccgacagactcttatcgctgccacagccaagtgccgaattggccagactttcggcggatgtcagcacacgctgcgcatccgcggccattctcgagacggatgccgcgtagagcgtgcccacacaggtgacgctggccagcaacgtcagcagcagtacaaccaccactcgcgcccatatcggtgtacggctgaccagcgaacggccgttgccacccacgtgctggggagtcttcaggtttacgggacccgtctgctgatttgcagcgctattcgtagatgcggagcgattggatttcccgttaccggcatggcggcttctcctacgccccacagccttatggctcgaatgccctgaagtgaatcgcatacttatcctacccgaaaatctgctcagctcatactcttatccaacggcgcaaggccacgcttccggatgccggactccgggcgaatccggaatcgcagacatgccggagcacacgtgacgccacgcatatctcatgccagtgtaccgatgccaccgaaatagaccgagggtttatcccataccgggtgcaaatcccctcatgaccaccacatcgctgtcagaatgttctcagacttcattgaggggtataacagtattgcgcaagaaaacggtcactaaacgcaacaatagttaaagccgtattgatctgttcggcttaggagaacgggagaggtaattacatgttcgtcctcagcaacgcctggcgggccctgacacgttctaaaggacgtacggccctgaccgcgttcatcaccttggcggtcaccttcggcacagtcgccggactggccatcattcaagaagataccaacgcacacaccaccacgtacgatcagcagaaggccacgttggccattcgcccgactgcggctacgtggaagaaggtctccgctacggactcggcttccaccaagcattacatgacgtggacctcatacaccgaatacgccacgctcgtccagtcggccaccaactcgttgaacttcacggttaccgaaaccgtgccggcccgcgtgagcggtgatttgaaggccctggacggcggatcgctgggctcggcctccgatgatgagaccggcggccagctcatttggcgagccttctggaccgaggatgccgccaaggccagcgacctcggtaccttcgaaatcgtggacggcaaggacctgagctacaacaaccagtcctccaacccgaacaccaccggcgcactggtctctgaagcgtttgcctccgccaacaacctgaaggtgggcgatacgctcaaggtggcggccgcctcggacgcccagaccacggccgagctcaaggtgcgcggcatctacaagtacacatccgaatccgccgtcgccaatccggtgacggccgcccgcaaccgcgagaacgcgatcttcaccaactatcagaccttcgccaaggccggactcgacccacagtccaacgacaagaccgcctccggctgggcgatgccggatctggacgtggtgttcgacaccggtgatcccgctacatacaagtccttggtatccaccctcaagaagtccaagctgcccgccaagggatacgaggtgtcttccccttcgctggaatcctacaacgcttctctggagccgctggatacgctatcctcgcgcgcgaagaccggcaccattgcgttggttgccgtgggcggcgtgctgttgctcatcctcgtgctgtcaggcgtgtggacgcccaagcgtgacgacgagatcggcatggcactggtgtccggcgtcactcgcgggcgtttgggatggcagttcatgctggaagtgttcatcgtcaccctgcccttctacgtaattggtctggtcggaggcgcgttcgccgccaagccgatcggacctgctctggcatccggccatgccatcccggtgacatcggacctgatttggaccatggtctggtatggactgggttcaatcctgatcctggcgattcttgccgccctgcgccttgcgttcttcagcgcgaacaagctgttcgccgccgatggcgactggggcaccgtgagcgagaccaacaagacgaccaccacaaccgacgatgcggaggcacaggcatgagcgacaagaacaacgatcaggaactcgagaagaccactgacgcaacggctgacgaagtgacttctgagactgagacgaacgacgccattgaatccgttccggctgactccgtgcagttcagcgtgaccttcgatgacgttgatgacgaaagcactgttgacgatggtatttacagcgcactggcatctgccgaaaccggagaaaccgacgagaccagtgaggccgaagcagacgccatcgcttcggtcaacgcatccgccgaagtgaccgagcgcaatgccgcccgcgtcaacgaaacactccgactggccaaaaccgatcacaaagacgcattggccgagcatgcggagcctcagggcaaagcggccgaacccaccatgacgctggcctcgcgtatcgatcgcgtgttggtgggcggcggttccgacgacattctgctcaagacctacccgaccttcgccctgaacaaggtgacggtcgccggacccaagggcaaggtcaacatcctcgatggcgcgaatttcttctgctattccggacacgcatacgcgctgctgatcagcgacgaccccgattcgggcatcaccgccgacgccaagcgtcgcgcgctgatgggcgtgatgagcggtttgaccacgccggcgtctggcacggtgatgaacaagagcgccaacattgttgagctcgagcccgtggaactgcgcggccaccgtctgggcatcgtaccgcagctgcacgccgtgcagccgaagatcgacgccgaacaaaacgtgctgtacgccatgaatgcgtccaaccgcaacttcctgaagcccaagccggtaatcgcccgcgaactgctggccaaggtcggcttctctgaggccaccagcggcgtggccgtcggcacattgcctttggtacagcagcgtttggtggccatcgcccgtgcaatcagcaccgaagccgaagtgctgatcctcgacgagccgacacgagggctgaacgcggatgacgaggtgaccgtgttcgccgcgctggccaagctggcgcacaccggtgacccgaagcactgcgttatcgtgctcactgcgtcgcgcgaaatcgccgaagcagccgacacactcttcgaaatctgatgttcagaccatagagccccctgtgattcgtattgccgaatcacaggggtttttcaatgctgcggctcattgccgcgctaatctgaggataaatctgaccgtacgaggcgaaacctgataattatgaccggatatattcccacactggagcagatcgacgaattgcaccgcaaaatcgcgccgtccaaggcggcgtacgagctggtgcacacgcattgcgtgattgtagcgaccatcggctgccagatcgtgcgccggcagaacgcgctgttcacgcgccgctgcacattaccgaaggacgcggaggtaccgcccaccgcaggcgtcaccggcggccatgtgccgccgcgtctgctcgacgagcatttggtactcatcggcggactgctgcatgacatcggcacctaccgcgtgttcaagcatgacggctctgacggcgaaccgctcaaattcagcaagaaacgctacattctgcacggtcttaagggctacgagtatctgctcgacgagggcgtggacgagtccatcgcccagttctgccgcaaccataccggcgtgggacttacgcgcgaggatgtggtgcgccaggagctgccgttgccaccagccgactatgtgccgatgaatctcgagcaggaagtggtgatgtacgccgacaagttccatagcaagtcagtgccgccgaagttcctgcaggtcgaggcgtatacggcccgagccgagcgatttggcggagagaacaaacagcgatggctggatctggtagccaagtatggcgtgccggatattccggcgttggcggagaagtatgggatgcggatgatttgaggctctaggggtctccccccaagtcagcctgtcggctgacagccccctcgtcagagggggcttatgaaggtatttcagatggaacggagacggtaggtgccgttgcggttggagacgatgatcatctggtcgttctccagcacgttccagccttcctgcttgtagccggaagaggagaccacgacaccggcggagtcgccgttgtcgtcgcgcagctcacggtagcgcatcacacggtagtcggcggcctgctcgccacggccgtactcatcgtagatttccacgatgcgcgggctggtcttctcacgaccggcggcacacagggcgatgagctggtcctcggactgaatcatgcagttgtagctggacttcgggtaggcttggcgcagttcgcgcacggcctgggccacggcctcgtcgagcgagaagccgaagccgatgtattccagaatcaccgcgaagaagatggcggagtcggaacggccgccggtggagaggaacacgctgtggttcaccgggtatgagcggttggtgacgatgttgcggccattggcgtccgagatatcgccgttgtggatgaagctcaggccgttcgcatagaacgggtgctggttctccatgatgagcggcagattggaacttgccaagcgcaggtgccagatggcaccgcgagacggttcgtcggccagcgcctcaaacgtgctgtcatgacgggccgcgatggtcgacttgtagattcgggtgccggtttccggggtgggtgcgccaccgtcgcgcacgtgcggtgcttcggcaggatcggaaagctgggctacaccccagccatcattgtggatttcagacagttcacggaaatcctcgacattgtcttgccccaacacagcgttgagactcaggttgaagcctgccgtcgcgtatcccagtaatctgcacatggtatttcaacttaccgaaaccgtgtggcgacgtgcggcgaccgttataggcattctttatagagcgcatcagcgccgctgcaaactggtatgttatcgcttctgtttggcggagcgctgaggcttggcggcgggtttgccgttctcggccttgcccttatcgcccttatcgccctgctcagcgggcgcatcggcggcagcggcctcagcggtcttccgcgcctcggccgatacggcggcatcgagctcctgtaccaatcgcccaagcccggacgtggtgtccatcgggtcagggacggcggccgggtcggccactgcacgagtcggcgtgggcgtcgggatggtcttggccgtatcggtgcgcttcagacgcggtgggcggcgggtggagacgaacagcggctgcacctcgaccaacgggttgtaaggtgccagaccgaaccacttaaccggcgagccggccatgtggcggattgcgtacttggcttgcaacgacagggcaccgcgtgcggaaaccttggattccggcatcagggccttgtgaatcagcacgtaacggatggtgccgatgtccggatcggcgtcgaccttggggtaaatcgacttctgcttaggcagttcgccggttttggacaggtcgtgcatgatctggtggatgtacgccgggatggactgcgaaaccttgaatcccagacggaagcgcacgcggtagatgtagttcgtgccgaagtcctccaccgagtattcacgggtgaacggctcgtcggtggtttccacgctgactgcccaccaagcacgggcgcgcttggggtggtcggcgaagatggagaagaagatgtccgtgtcgagtcgcttggtctccgagtcggaggtcaggtacacgatgttgtccgcaaaatacgggatgcggaaatcactgtgcagcttgtcgagcgcgggtaggaagtcgttgggccgcatgtgacggcgttgcgcacgttcgagcttggtgccctcattccacgtgtacatgacgaacagaatcgcggcggtcagcagcatggtgaaccaaccaccatgcaggaatttggccatagacgcgatgaagaacatggcctgaatcgccaagaacagcacggtgaacacgatggcaccgacccgcttgccggaatgccataggtagacgccgagcaacacggtggtggtgatcatcgtaatggtcaacgccagtccatatgcggcagagatgtgttccgaatccttgaagatggcgagtacggccagtgtggagacgcacagcacgccgttgaccaccggaatgtacagctggccacgcgtgcgggccgggtaccgcacctgcagatgaggcatccaattgaggcgggtggcttcggagaccatggtgaacgcgccggtaatcagggcctgggaagcgatcacgccggccgaaacagacagaatcacggccagataacgtacgttcggagacatcatctggaagaacgggttgagtgactccatcgcagtgtattgcgggttatcgctattggccagcatccacgcaccttggccgaagtagttgagcaccagcgcaaccttgatgaatggccaagtgaagtagatgttgccgcgccccacgtggcccatgtcggagtacagcgcctcggcaccggtggtcgagaggaacacggtgcccataagggcgatgccggcagcattgttcgggctgaacaggaatttgatgccgtacaccgggttcagggcctcgaacacagaccagtcgttagagagattcgtgacgcccacgatggcgaggaagccgaaccagaccagcaccatcgagccgaatactttgccgatgctttcggtgccgcgcgactgcacggagaagagaatcacgatgatcacgacggtgatcatcagggtcaggcttgggttttcgtcgaacaacccttccaatggcggcagggtctgcaagccttcgactgcggaactgatggaaaccgccggggtaagtaccgaatccgcgaggaatgccgcaccgccgagcatggcgggaatcgcgagccatgcgccgtacttgcgaatcaacgagtacagtgcgaagatgccgccttcgccattgttgtcgatgcgcatggcgatgagcacatatttgacggtagtgatcagcgtaatcgaccagaagaccagcgacagcatgccgagcacggcctctcggtctacgctgccaagccctccctgaccggcaaggaaggtctgcgcggtgtacaagggcgaggtgccgatgtcgccgtacaccacgccgagcgccacgattgccatgccccaggtgaccttgtctgggctggattgcaggcgggcccaccatcgaccgaggccgcctttcgaccatgcgctggcgattttctcggcttctttggtttcagcttccctctgcttggcgagtgcctcgcgctcctccttggtgagagtgcggcgggacaccttgggagcattggtaaaggtgtcggccctcagcagtgcttcttcttcctgtcgggccttggctttggcggcaccagactgggctttctgggcctttgaggctttttgggcacgtgcggtcctttggttcgactcagccatacgttcagtcctccattgaggtggagatcatccccctcgcttatgtcaaacacatcatgatagacctcgttcacaattctgacaaattttacaagtcaacacatcgtctctacacgcgccgcgacggccgcacacccggccctcacagtccgtatacggcgcgggcggtatcgcgggtgccgcgcgccacatccgcgatgggcaagtcgagcgtgtcggccatggcgcgcagagtgtagggaatcatgtacggcgcgttggtgcggccacggtacggcatgggcgtcagatacggcgcgtcggtttcgaccatcgcatggtccagccccacaatccgtagcgattcgcggataccgtcattgcctttgtagctcacggtgccggagaagctcagataccagccatgttcgcgcgcgatctcggccatctcacggtcgccggaatacgagtggaatacggtgcgttcgggcgcgccgtcggccagcagggtttcgatgacctcgcgatgggagtcgcggtcgtgaatctgcatgggcaggcccagttccttggccagggcaatatgcgcgcggaaagcctcgcgctgcagttccttggcaccttcgccggtgcggaagaggtccatgccggtctcgccgatagccaccacttgctcggggtatgtggtggcgaggcgatgtacttcggcgagcgcgtcctcgaaagacgtgtcatggtaaggcttgtatttgaggggcagaccatccggccccggcacaccgcgatgcccgtggagcacggactcattggggtgtattgcgagcgccgcgtgcacattacccggatgatcgagggccatctggacggcggtcatcaggtgcggcagctcgcaaccgcagtcgataatacccccaatgccgacagattgcgcctgcgccagcaattggtcgacgtcgtacaccgggacttcgggctgtcccttctcctgcgcctcatggctcatagcgcgcgcgaaagggattacggaggccacgtgagtgtggttgtcgatggtctgggcatcgtccggcaatgcttcaggtgccggagcccagctacggtcgcgatggtggtgcttgctcatggtttctcagtgtaggctgtttctcagtgtaggctaccgccagcaacgctcgtaaggcagtccggtaagacgttcgactacacgacgggtatcgtcggtcacgcccgcctgaacttgccgtttcttgccacgagcgcaacattcccgggagagtagcgcaaccggcaagcgagacggccgccatcctgccgcctttttctgcatcatcagcccattttctgcctcattttgataaaatatgatgcagaaaagttcgtatgatgcagaaaatgaggcagtatgagatcatttgactacatcgaatcaggtaagacgttgctcaccccgcacaccacgagtttgcttgccgctattcacgaggcaaaagggcgtcaaagcatacagacaacgatcagaccggatatattggggacgctggttgccgtcgcgcgcatccaaagcacagatgcctcaaaccgcatcgaaggtatttctaccagcgatagcaggctcaacgatctcgtctcggagaaagtcacaccgcgcaatcgcaatgaagaagaaattgccggttaccgtgacgcgctatcggttattcacgaaagccacgactatattccgattaccccgaacgtcattcttcaactgcaccgcgacctcttccgacacacaccactgacctttgcggggcatttcaaggacagtgacaacgtcatcatcgaacgagatgcacacgggaccagcaccgtgcgattcgccccaccgtccgcacttgtcacaccggaactgatcgaacgcgcgtgttccgcctacacgcaagcaatccgagatggacataccgatccattgcttgccatcgccatgttcattctcgatttcacctgcatacatccgttcaatgacggcaatggccgcatgagtcggctactcacgctcctgatgctgtgccgcaatggctatatggtcggcaaatacatcagtatcgaacaccttatcgagcaaagtaaaagcacttattatgaggcgctggccgcaagcacccaaggctgggacgacaacgccaatgattatgcgccattcacgaactacctgcttggcatcatactgtccgcgtgcaaggaattcgacgaacgcatcaatctcacggcaggcggcagagcgcagggagcaccgcgagtagccaccaagggaacgcggattgaagcactgcttgatcaatccctagttccactctccaaggccgatattctcgctcgcatgcccgataccagcaccaccaccattgagcgcacgctgaaatcactgttggactccggtacgatcatcaaaatcggtgccggtcgcagcacccgctatgtgaaacgccgctaaacgcatccttgtgcgcaacatctcgtcactcttccggcgctccactggccacgcgaatcatcgcgtactgggactcgtagaggcggtagtacgcgcccttggcggcgagcagctgcgcgtgcgagccgtgctcgacgatctggccgtgatcgatgtagaagatctcgtccgcgttctcgatcgtcgacaggcggtgcgcgatgatgaagctcgtgcgccccttgagcagatgctgcaggccggcctgcagcgcctcctcggtgcgcgtgtcgatgttgctcgtcgcctcgtccaggatcaggatacgcgggtcggcgagcagcacgcgcgcgaaggcgatgagctggcgctggccggccgacagggtcgatccgcgctcctccaccaccgtgtcgtacccgtcgggcagttccatgatgaactcgtgcgcgtgcacggccttcgccgccgcctcgatttcctcgtcggtggcgtcgagcttgccgtagcggatgttctcgcgcacgttgccggagaagatgaaggtgtcctgcagcatcacgcccatctgccggcgcagcgatgcgagcgtcacgtcgcgcacgtcgtagccgtcgatcgtcaccgagccctcggacacgtcgtagaagcgcgacagcaggttgatgatcgtcgtcttgccggcgcccgtcgggccgaccagcgcgattgtgcgccccggttcgacgtggaagtccacgaggttgaggatgttgcggccgtccttctcgtagcggaacaccacgtcgttgaagtcgacgcgcccgcggatctgcggcaggtccgccgcgtcgggcttgttgcggatctccggcgtgacgtcgagcgtctcgaagatgcgctcgaggtacgccgagcaggtgatgagctggttgtagaagttgccgatgttgatcaccggattccagaagttgttcgcgtagccgacgaacgcgatgagcacgccggtggtcacgttcacgcccccgaagcccatcacgccgacgaagtagatgaacgagatggtcatcacggagatggtctgcacgcccggccacatgaggaactggatgtgcacggcgtgcatccacgcggaacgcacctcgccctgctgttcctggaaggtcctgaactgggcctgctcctgtgcgaaggtctgcgtggtcttcacgccggcgatcgactcgtggatgtaggcgttcaggttgctctgcttgttggagagcttctggaaggcgcgccgctggaagatctgcagcacgcgcacccagatgatgagcaccgggaacaggatcaggctccacagggccagctgccagtcgatcacgaacatcacgatcagcgtgatcacgaaggtgaacacgtcggagatcacgttgatcagaccggagctcagcgtgtccgaaagcgtgttcacatagttgaccacgcggatcaggatcttgccgtgcgggcgcgaatcgaagtagctgaagggcagcgtctggatatgcgtgaagatatcgcggcgcatgtccttgagcatgagctggccgacgcgcgtgatcgccaccgtgcggtagcgcagcccgaactcgtacagcacgatcagcgcggcgaggatcacggcgaggatgccgagcttgccgaggtccttgttcgggatcgcctcgtcgatcatgatcttggtcaggtacggcacggcgacgacgatgcagctcatcgagatgacgacgacgagaatgcgcgccacctgtgccatatacggtttgagatatttgccgacgcgcaggatgtcccggaagttgatctgctcctcgagttcctcatcctcgcggtatgtattgcgttgtgccataagtcctcttctaaaaaccttgtgcgacgccggactggagtccgagctgcttgtggtagatgtcccagtagcggccgtgtgcggccacgagttcggcgtgggtgccgcgttcgacgatacgtccgtgctcgagcaccagaatcaggtcggaatccttgaccgacgagatgcggtgggcgatggcgacgatggtcttgccgccgtccatctccttgaggtgcttctggatctccgcctcggtctccatatcgacggccgaggtcgtatcgtccataatcaggatcgacggattgtccgcgagcgcgcgggccagcgacaggcgctgcttctgcccgccggacaggcccacgccgcgttcgcccacgacggtgtcataaccctgtggcatcgacctgatgaaattgtccgcgccggcgatctgggccattttctggatatatcggtcgtcgctatcaccgctggcaccaaaaccgatgttgccgccgatggtgtcggagaacaggaaggtatcctgcgccacgatgcacacctgcgagcgcaaggtggccagcggccagtcgcgtgcgtcgatgccgtcgatgagcacatggccaacggtcgggtcgtagaagcgggagatgaggctgacgagcgtggacttgcccgcgccggtttcgccgaggatgccgagcttggagccggcgggcacggtgaagtcgaggtccttgaggatcggggtctccgggtcgtccgggaaggcgaagctgacgtggtcgaagcggatgtcgcccttgatgtgcagcgggcaggacttgcgttcggtggactgctgggcaccggatgttccggaagccacgggcgctccggtagccccggtagcctcatcatcgtgcttgacttgctcgacgatcgtgaccgcctgcttgacggcttcgaccgcgtcgggcttctccacgatgcgcggctgttcggtgagcagcttgcggattttgatgcagctggcgttgaatcgctgccagtcgttgatcagccagccggactggcgcaccgggccgtcgatcatccacaggaaggagttgaaactcaccagattgccgagggtcatgtagcccttgatgaccagaaagccgccgaggccgagggtgatgagctgcagcgagaagccgaggccgtccagccacggcatgtacttgcgcgagttgtaggccaaggccatgttgcactgcatgtaatcgtcgttgtgctcgtcgaacttttcggtctcgtacggttcgcgcacgaatgccttgaccacacggttgccctcgatgttctcttcgaccatggagttgagggaggccagcgagttgcggatggcgaagaacagcgggtgggcgtgcgtggacaggccgcgcgtgagcacaaaaatgaacggcgtgacgcaggccaggacgagcgcgagtcgccaatcgatggcgaacatcacgcacagggcgcccacgaacatgaccacgcagtcggcaatctgatagctcacccaactcaggcagtggcggatcgcgtcggtgtcggaggtcaggcggctcatgatgtcgccggtgcgtgtgtggttgaaatacgtgaagtcgagctcgtgcagcttctcgtattcgtcggagacgaggcggtagaccgagttctggccgaaacgctccatccacatctggtagccgtatcgcgcgcccacgcggatgatggtcatgaggatcatcagtccacacagacgtggcagttcgtcggcatgtccgccgacgatgacgcggtccacgatgataccggacagaatcggaatggtcagggccatcgtgttatttgcgatgaacagtagaagcgcgcctaccacgcggggcaggtctggtttgcagtatggcagcacccatttgagattgcttgcgctggtattgattcccggatcgacgtacatgtgaggagatcaccgtttcttggggattgtttgcttgtggtatggtgcggcatgctcctgcgccgcacgcggcaatcgctgccgccgcgattcacgatcagccgtgcttcgcactgcgcctgtcattggccgcatgaccgaagctctccttcatcggtcgaagcacgttcgactttcgcaaacgcgtactagtctaggcgacctgcgtctaatcgcaacggcccgcaactctgcgtgttccccgcattagcaacgatacgcggctctctaagcgcaacattccccggaatgcgtcgctgcacacctccgaacaggtccaattcgcaacgcattcccgggaaagtggcgcatgtcatatcacgctcaaacaacccagcatagtgagtggttcattcacgttttacgtattgtgcgacggaatcggcatctcccgcaacacgtgagatatgcaaaagtgccgcacgctgaatggtgatcagcgtgcggcactgcgcgaaacgcgtgaaatccgcagaacgcacgaaactcacgaaacagataaaacgtacaaaacgcaagcaaggcgaagcaacgaacagacagagacagacagactacaggtcagaacgccagcgaacgcacgtaggaaccaacttgcgggcggaacagctaccggggattgttcgtttgcgatgttcgcattcatggcaggtttctccatacgattcgggcggtcggttcaggaggttggttggcggaggcaggttcggtttcagcgtcggtccagggccacccagagcacgccgtgcggcggaatcgtgccggtgatgacgcggtcggcacccacgccttcaagacgcacgtcggcgggctcgcccggcgcgtcggcatacagatcggcgagtgtccaatcgtcattgcgggcgtcaagccccacgatggattggagctggatgttgcggccgatctcgtatgtgtcgctgccggtccagaacagcgcggcgtaatggccgccgtgatgcgcggaacgtgtgccatcggcccaatcggctgcgtcggcggaccagacgatgaactcgccacggtaggtgctctcatcccaccatttgccaaaaatccgttcgcgcacggtctcgcggttattggtggagccggcaagcacctcacgcaacgcgggattctgcagcagcgcgatggcgtcgctgttgctggtgggcagatcgccgccgaccataagcgggctacgccccatgcaccatagggccagcagtgtcttctgctcgtccagcgtaaggcgggattggcggtcgtcgccgcgttcggcgcgcaggcctatgtgcccgaacggcaccatgtcggcgtcggcccagtggccggtggtctggaacggcgcccagcgggccaggcgggcgaactgctggtagatgtcttcccaacggtcccacagatcgtcggaaatacgccacatttgggcgttctcgcgcaggaagtcgacgtagctcgtcgccacccagccgccgggcgagagagacaggtcaatcgaacggccgtatttggcttcggctttggcgatggcgcgatgataggcggcgatttcgtcggagtggaacggggtctgcatgtcgtcgaccttgaggaagtcgaggccccaggaggcgaacaggtcgagctgcgcgtcataccaggcctgcgcgcccgggtgggattggttcaggccgtagttgtccggattccacttgcacacgtggtcgaggtcggccacgtccttggcggtgtagttggtgccgtatacgggcaggttcttgtccacagcgatacgcgggatgccgcgcatcatgtgcatgccaagcttcaagcccagttcgtggacggcggcggcgagcgggccgaatcccttgccgccggcagcactcgggaaacgcaccgggtcaggcagctgacggccgtattcgtcgagaatcagcggcgcgttgtcgttgtaaccatgtgcgcgggcggtcgggtcgtaccagtcgatgtcgatgaccaacgtatcccagccggcgtttttcaggtgttcagccatgaaccgcgcgttggccagcagctcgtcttcggtgagagtcgtgccataggaatcccagctgttccagcccatcggcggacgccatgcctgaggaaggctctgcggaagatccgtcatcgtatcctgctttcgttgatattcgcataagttgccctacggcggtatgccagccgcaaaccaatcggcatcgcgcacgtacggataggtgaagagtgacgccactcccccggagagtcccatcccaacgtacgacgaacttcatggcctcttggcacaccgacgtatgtaccgttacatattcttccaccggaacgatatcaagcaagcgcatgttacgctcggcgcgtcatcgcctaagcgcagcattttcagcgattccggcacacagccaccatttgccaaaacacgatgttgtgaataccgttacaaccattggaagcattacgggcatgatccaatgcccatcacaggcgaaacatgaggtgacgttatgccgagcggcaaaccaacattgcgcgacgtagcgaaagccgccggggtctcccccatgaccgcctcgaatgcgctgcacggcaagccgggtgttaaggattccacgcgcgccaaagtgctggcagtggccgaaaagctcgattaccgcatcaatctgacggccagcatgctgaagtccggccgcagcaacatcatccacatcatcgtcaacgaattcgattcgccgttctactccaaactcgtcgaatcgctcgtcaccgaaaccaccgcgcgcgggctgacgccgttcgtggagcaaacccggtactctccggatgccgccaaacacgcgctggccaacaacccgttctccgggcagttgttcgacggcgagattatccacgcttcgggcctgaatgccggtgtgccgctttccgcgatcaaccacggccgaccgctggttctgattgacgcctgcgaggaaacgcccacgttcgatacagtgaatttcccgaacgaagacggcgcgcgggcggcagtgcagcatctcatcgaatgcggatgccaccgcatcgccattgtcggcgacgggtattcgccacgaaccgaactggcgcacgtggaaagttccagcggtttgcgtctacgcggggccagcggcgcactgcttgacgccgggctgccgtatgacgaatcgacgaacttcattggttacggtagcgacagcggcatcgaagccggtcatgccatcgccgaggcgatgctcgaggctcgtgcgcaatcggctgatgacactgctgagtcccgttccccgggcaccacgcgggcaacgggaagcaccccggccatcgatggcatcttctgcattaacgactatgccgcattcggagtaatccgaggccttgccgactacggcatccgcgtgcccgacgatgtgagagtcatcggcttcgacggcgccacggccggctcgtacaccacaccgacgctgagcaccgtccaagtggatctcgatcagctcgcccaattcgcgcttgatatgatcacccgccgcgtggagcagcgcgaccagggcgacggcaggtccgacgaatccgctggcatgccggccacgcgcgccaccattggatacacactggttccgcgcgagtccactgtcggttcggcaaacaggtaacgctgaaacgccgaaatagggcggcgattcccgactgccgcgcccactgcccaagtgccgtgcagcgtgacgtgcgaggtttcggcatgcgtcaaaccgttcccagcgctcccacgtggtagtggcgcccatgcgcacttttcctagggttaggaccatgaccttccctaatcacacggtgttgtagaggcgggcggggaaagcgtcgcggtattggccgggggtcaggccagtgcggcgcttgaagacgcgcatgaagtacttgggatcggcgtagcccacttctcgcgcaatatccgccacgctggaagcggtagaactcagcagttcgcgcgcacggtcgatgcgatattcgatgatctgctcggccacacccacgccgaacacgcgccggtacatcgcggtcagatagctgggtgaatagtggaagcgcgcggccactttggccacggtgatgtcgtcgaaggcattggccataatccacgagcggatggccagcatcggcgccaggccggacgaatcgccagcggcaccggccgaatcgacatgcatggcccattcctgttgctgccggacgcggtcggcactggtgatgggcttgccgtcgccccggtagccggcaagcgtacgatgggcggcaaagtccgccttcagccgctcctgcgcgctgacctccagcagcaggccggtggcgaagtaatcgcagtaagcgttggaatacgggccgaatcgcgcatagatgtcgatgagctgcccacacatcaccgccagccggtcggggtcgggcagggtgcgttcatcgggcagcaacaggcaatggtcgtcctgcggcagacccgcgtcatcggggagcatgcgcgcatccggcaatttgaaatgcatccagtagaagtccacgtcagacgtgatgatgtcggcgcccgcatgctccacattcggcggcaagagtgcgatttggccggcctcgatatgcagggtctgctccccacccgcatcggcaggacgccccgacgcacgaacatcagctcgaaggtgtcgatggtgcgccgcagatggcgccagcccggtccggacacaaactgcccgaccgagtaaaagtccaccggcccttcgagccgacatgtcgtgatgcccatggctaccagagtagccgagagcaaatatcagccgcgcagccagacggtcatttcgttttcgccgcggttggcccaggcgaagtacgggatgagcgtggcggtggcgggctcgcgcttgaccggcgcgtacacggcgtagagcggcgcgaacgccggaacctcggccgcgccctcacccgcggcggccacagcagccggcaacggctcgcgccaagccggcacctcaagcttcaccatgcggcgggtcacgtcttccacctcgccctggcccttgtcgtcgatgcccttggcgccggcgtggaagtcgaactcctcgaccttggccgcgctcgggtcggccagcagtgcctccacatccgcgtgcagcaggtgcaggttggcgccgttgtctttttcctcggcgcagaaggtgatcgggccgcgcacgaacgccaccttgccggcgtcctcgcgcaccagcgggttggcggccagcatacgcaccggcatcgggaagtcgaacgtcacggtgtcgccgtcgcgccactcaccggtcagatacaggtagccgtcgcgaatttcgcgggtcacgcgggaactatcggccccagactcagactcgcccgtggccgtaatcgcggcggcagcagcggactcatcgcccacccaaccgggcagacggaaggccagcgtaaagcgagcaggagcctgagccgaggtgccagcagcgtcaccgcccaagcgcacgaccgccttgccatcgccttgccacggcaggttcgccgtaacatccagctccacagccgtaccattcaactcagctttggccacgccgcccatatacaagtgcgtgaacagcgtaccgccatcctcggcaaccgtgtaggcatattcctgcaccgactcaacgatgcgggcgatgttcggcgggcagcatgcgcagccgaaccacttctgacgcaccggcttgacgtggcgcaggcggctgtctttatggcaggcatacggattgacttccagcgggttcacgtagaagaagctcttgccgtccagcgccatgccggccagcgtggtgttgtacagcgccgactccataacgtccgcgtactcggcctttggcgcgagctcgagcatgcgacgggcgaagaacgccagcgaaatcgcggcgcaggtctcggagtaggcggagtcgttgggcaggtcgtagttgtaggagaatgcctcgccgtccaccgtgccgccgatgccgccggtaacgtacagtttcttatcgacgatattgcgccagagccgctcggccgcatcggcgaggtcctgatcgtcggtcagtcgggccacgtccgccagaccggagtagaagtagccggcgcgcacggcatggcctacggcttcgtcttgttcggtggccggcttgttcgcctggtggtaggcgtaccggttggggtccgtgttgggtttgtagttggcgtcggcgtcgcgctttgcgttctcgtctgcctgaatatcgaagatgtacggctgccggcctcgctcggtcacgaaatattcggccagatcaaggtaccgctgttcgccggtgacctcgtacagcctcaccaaagccatctcggcaatctcgtgaccggggtaaccacgcagctggcccggcttgcgaccgaagcgctcgtctacgtaatcggcgaaacggcaggcggccttgagcaacttgtctttgccggtgccctggtagtaggccaccgcaccttcaacgaggtggccgaggcagtacagttcgtgatggtcacgcagattggtgaacgcgcgatccatgtcgttcagaatgtagcaggtgtccagatagccgttgtcgagttgggcggcacacacgacgtcgatggcttggtcggcggtctgttccagtgcggggtccgggtgatgggcgagggaatagccgactgcctccacccacttggagaagtcggtgtcttggaacacgaagccgtagaacttgtctgggtcgggattggccgggtcttcggggagcgcctcaaatccgcggaacgtgtacttcggcggcacgaacgccttgccctgggtatccttgcgcttgttttgcgcggcagcggccttgaagttgtgcatgcagtagctgggggccgcgccggggacgttatcgttcagggcgttccactgatagggaatcacagccgtgcgcacgagttcctgctcggtgcgccagaacgaatcggtgacggtgacgtttttcagggccagcggcttgctatgcagcgaagtcatgacgtactcctttggactatgcgacattcgtcaacaatatgtatcggtacatatgatacgtgcgcccgcgcgagcagcaaggtggacaaatcgttggcggggtggaatcgccggcgcatatccgcccgtacgatttcgcccggtgaatcgcccgacgaatacacggcgacttatactaccgacggaccacaaacgtcgcctacatgaatggaagatcaatcatcatgacagcaaacgccagcgcacgggccatcaaacccgaacttctgcgtacgtacaccgaagacttcaacaaagaccgcgccaacctgatcgcggcggacgcggcggtttcggccggcgtgctcaaggcggccaccgactatcgcggcgtacgtgcgctgccgcgcgacttctccatcgaactcaagcagggttcgatcaccaatcaggagcgttccggccgttgctggatgttcgcctccctgaacacgctgcgttacgaactcatgcatcgctggaatcttgaggatttcgagttctccgagacctacctgttcttctgggacgcgatggagaagtcgaacacttatctggagaacgtgctgcgcacgctcgacgaggcgaccgattcgcgtctgttcgaggccatcaatgagtcgcctgcagacgatggtggctggtggcagatgttcgccgcactggtgaacaagtacggcctagtgcccaagagcgcctatccggagtccgagaactcccgcaattccgacgatttcaagcagtacctcaactccaagctgcgcgagttcgcggccgagctgcgccgccgttcggctgccggggcgtctgaggacgagctgcgtgcgttgaaggacgagtacatgggcaccgtgtaccgcatctgcgccgtggcgctcggcgaaccgccggagaagttcgacttcttcgcgcgccccaaggatgatgatgaggataagaagggcgaggctcgcaagtgcaaggccgaggccgacgcagacggcaaggccgaatcctgcaagtgcggcgaatcctgcaagtgcgagggcaaatccgacgccaaggcctgcaagtgcgataaggacaagtccgacaagccgaaaaccggcaaggacgagcgcccgcagattcgcgagatcggcatcaccccgcttgagttctacaagaagtacgtgccggtggacgtcaacgatttcgtgacgctggccaacgccccgctcaagaaccgcccgttcaaccagcgctaccgcatccgcttcagcgcgaacgtggccgaggctggcgatatggaattcgtcaacgtgccgctggacgtgttcaagaaggccgcgcttgaccagctcaccgccggccacccgatctggttcgcctgcgactgcacgcagttcgccctgcgcaaggacggtttcttcgaccagtccgtggtgcgcgtcgaccagctgttcggcaccgaattcaccggcgacaaggcccacggcctcgaatacggcgacagcccgagcaaccacgctatgaccttcaccggcgtgaacctcggcgaggacggcaagccgaaccgctggaaggtggagaacagctggggcaaggacgccggcaaggacggctactacgtcatgtccgacgcctggttcgaccgctacgttaccgagctcatcatccgcaaggaatacctcgacgacgccacccgcgccctgctcaccaccgaaccagtcgagctcgatccctggcagcccctcacccgtcgctgccgctgacatattccgcccattggccgcggctgaagtgctcctatgttttgccgacttctcacagagtgagcaaaacataggagcactttagttatccacagagttatccacatcctcagcaagctagaaccacataccccgtttttcatggcgaacaagcgaccgctacgctacggtggcgttatgaacagcggatttcccaccccgccacccggcgtattcgacgatgaaccacccggctggaccaacaatgccgcggcaccgagtgctgcgtccacgcacgccgtcaagcccgagccatactcaccaccgcgtatggcaacccccactgcgcccgctatgagcgaaaccctcacccaacgtaagcgggaaattcttaaacgatgcacggacgccgcgcaacagctcggaaagcctgtgctcttcggcatgaccacatcgctgatactgcaatccgtgccacttcccaaggattgcgatctcaatgccaccgagctccataccgtctccgactcgcatcgcacccggatacgcgccgtcgttccgccaacaacaccgcacatctggaaaccgctaagcaccgcgcacaatgcacgtatcaacaagcatgtgcacgcgctggatctggtacatacttgggcgcagctcgccgctcacatgtcattggaatcattggtcatacttggcgacgcaacccttacggcaatagcgcgcaagccgagcctatcgggcggccgcaccgccgacgaaatttatcaggactttgtgcggcaggtcagcgaacttccgaaattcaacgcgaaagccacatgcatgatcgcacttgaatttattgcaccgcgcgtggattctccgatggaatcagagacccgtatcacaaccacgcaatacgggcttccacgagccgtgacaaattacacagtgcccggcgcgacgttcagcaatggtgcgccgataacactcgatctcgcttggcccgaattccgcgtcgccatcgaatatgacggcgatcatcatcgcacagacaaggcccagtggcggcgagacaacgacaagcgcgaactgttacggcatcatcattggatcgtcctcatcgccaccgccgcgaatatggctgatgaaccgtctcaagccgaactcgcctaccgagccgggcgacagctggcgttgcgaggctccatattcgatttcaccttgacagcgacgccgctcaatgaacttgcccggcggaaacgacggaaatccaccggggcgcactgagctgacatcgatacgattgcgcgcgcttgctgcaacgcatatgccattcatcgcaccccatttggtcgcgtggccccgaccgcatggcactgttgtgtgtcacacgccatgttacgtccggcgaatccgcacatcatctgcgttgcgtactgccatattatgcggttcgcgatatacgtcacggtgtccgatgtcctggtaacgacgtcaatcgatttatgtgtgtaccgggccagatttcgttgtcccggttctccatttcgcctctttttgagcaaccgggacagaaacaccctcgaaaaatcgccaattcggccctaccgcacaatatccgccatcacacatcggcggaattccgggcttctggatttgcatacattgagcgctcacgggatggtctgtcccggttccccaaaagaggccaaaatcacgaaccgggacaacgaaatctggcccggttcgcacgtcaatcggttgccgtcaccaccgggacaccgactgcgcatagataagatgcttcaatgcttaacaggcatgcgaccataccgcgatagcaacgtttcgctggaagtagaggaatcaagcagcaccccccaaaccggaagcatggagggaatcctgcaatgctccgaatcaccgcgccccgtgcttggtgtggcggatcacggcttcgagcggcgtggatgtagctggacagcagcgtaacttgcgttgcatgatgcggcccaaaacgaagaaacccggcggagggggccgccgggtgagagagaagagagaagaagggttcagttatggggttcggaagaacctcgccaccggtatgaacttcattccgttgacatcttctatataaccgtctctttcttggggattcgatgtgcttgtctgagaaaagtcttggcaaactgtgacgggtttgtaacgccgcccgacaaccggcctcgcattgtcggggctaggccgcacatacggcaacgggccaccccgcaacacttcatgtgcgaggtggcccgtcagctacgagctagcaatgccgaatcactcggcggcgagcttggccttctcggcggccagacgttcggcttcggcggcacggcgagcagccaacgcttcatcgaagcgagccagctcctcttccacggcctcggtcggaatcttggcgaagatcggtgcgggcttaggcaccatggcgccgacctcgattgcctcgctcttccacgggtgcacgttcacaccgagctcgtaatcgccggtgatgatcgggtacgtgaagccgggcttgtcgagatcctcgacttccttgagctcaggcagcggcgagaaggtgccggtgccgccgagcgcctcccacaccttctgtgcggagtgcggcaggaacggcgcgagcaggtggttcgcgtcagacacggcctgagcggccacgtgcagcacggtgccgagacgagcctggtcgtccttaatcttccacggttcggtggcggaaatgtacttgttgatgtcgccgaccacacgcatcgcctcggacagggcgtgcttctggtggtgggtttcgatggaggagccgaccacgtcgaacgcggcggaagcctcttccagaaggccacggtcttcgttggtcatcgaatcctcgtccagcggcggaatctcgccgaagttcttgttgatgaggttggccacgcggttcaccaggttgccccacgaggaggcgagctcctcgttgttgtggcgcacgaactcggcccacgtgaagtcggaatccgaggattcggggccggccacggaaatgtagtagcgcacggcgtccacggggtagcgggcgaggatgtccttgacgtagatcacgatgccgcgggaggagctgaacttcttgccttccatggtcatgaactcgctggccaccacctgctcaggcaggttgagcggacccatcgggccggtttcgccgcccttggagcccttgccgttgtacgccagcatttcggacggccagatctgggagtggaaggtgatgttgtcctttcccatgaagtagtaggccgggcagctcgggtcgttccaccattcgcgccacttctccgggtcgccctggcgtcgggcccattcgatggaggccgacaggtagccgatcacggcgtcgaaccacacgtacagcttcttgttcgggttgtcaatccagcccttcaccggcaccgggataccccagtcgatgtcacgggtgatggcgcgcggcttgacttccttgaacaggccgagcgagaagttgatgacgttggtacgccagcccttgcgggtctccagccacgccttgttggcttcggcgagcgccggcaggtcgaggaagtagtgctcggtctgctcgaagcgcggggtttcgccgttaatcttggagacggggttgatgagctcgtccgggtcgagctcgttgccgcaggcgtcgcactggtcgccacgcgcaccttcggcatggcaaatcgggcactcgccctcgatgtagcggtcgggcagggtacggccggtggacgggctaatcgccacctgctgggtgcccttgtagatgtagccgttctccaagcactgcttgaacatctcctgcaccacgtgctcgtggttaccggtggtggtgcgggtgaacaggtcgtagctcaggccgaggtcgcacagatccttggcgatcacgcggttgtaacggttggccagttcctgggcagtgagaccttccttctccgcctcgacgagaatcggggtgccgtgctcgtcggtgccggacaccatgagcacatcattgcccttcatgcgctcgtagcgcgcgtagacgtcggagggcacaccaaatcccgcgacgtggccgatatgacgggggccgtttgcatacggccaagcaacattcaccaaaacatgactcataaggcttgattatccggcgcggcggggacacgcccggatagccgccgcgccgccatcctcatcccactcacctatccacccgcaacttccccacatacttatctgtacacctcttgcgcgcttatccacatacgcattcgcacacgtatccgcgcacccatccgtacgcacgcccacgcacatccgcacacacttccgcctgccaatatccaccgagttatccacatcatttgcacacctagtaaagttatgcacttatccaccgttttcgcctatccggtggcgcgcaagccgcatttctgcatattgttcggtcatggatatcacagcaggtccgatgacggacatcacaacagtcgcctcgccggcaaccgcgcagcctgcggtgccgccgatactgtttaccaaggatctgccgggaccgctcagccttaaccgtctggccgccttcggcacgttacataagctcgacgattccgccggctactggatcgagcattcgggcacactgtatggtcgcgcgaaaatcgtcgcggaggtcgccccgtttggcactgtggtgtgttcgatgaccgccgcttgggtatggctgggaggccccgactttccgagtaccatagacgtgatttccacatcgcacttccgctcggcatccgtcagccgccgtatccgcgtattcaaaagattgacgttgccggagcaaatcatcaagctcggcgggctgcctgtcaccacgccagcccgtacggcttgcgacctggtgatgagtcctgaagacatccccgatccttccaccgtcaacgcactggtgtgtcagctgatgtccacgtaccagtttcggccaaacgactgtctgcaaatcgtcaaggagcatcggcatcacaagtacgccggacgcgcacgcatgttttttgaatcggtacagcaggagatggacgaaccggctttggagcaatgcgcatgacgagggggttcattgtcagaggccatcgcagaggccgccatgccgctcaccgtttacggcatttgcggcaggcgcaacggttgcctcgccacgcggcggcggcacactcatccgaatccgcatcgcgcgcaatctcggatatgaccgcgccgcctgaaccgcccatcagacttacgcccgcggtggcatgttcgcccgatacggatgttgccgtgctctggcacatcgcatatcacgtgcccgaactgcgtaaatggctggttgccaatcccaaagccgacgcacctttgctggaattggtctcgcagcgcggtgggcccggggtccggcaggcgttggaaatattgttcgagtcgatggaaacgtaacggggagataatcgccggctgctgcgctatcccttgattttcagcacagccgcatacacctgcttgcgattggccaacgatccgtcagccagtggatgctcctgcaccacttgcgcgatggcgtccttgatacgcaggccgtcctccaaagcacggtcgatggagagcacggccatgtcatccacgctcaacgtgctgggcgcggccgcttcggcctcctcgttggacgcgccgccgatgaccagcaccatctcgccacggggcggatcatcaatcacactttggcgaatctcgtcaatcgggccgcgacgaatctgctcataatccttggtgagttcgcggcacagggccatcgggcgattcgggccgaacgcgtccagcagatcgtccatcgaatcggcaatgcgatgaggcgtctcgtagaacacgatggtgcggcgttcgggcaacagcgtgcgcagatactgcacgcgctcggaatgctttcgcggtaggaagccttcgtagcagaagcggtcggtgggcaggccggagagggcgagcgcgtcgagcacagcggaggggccgggcgcgcaggtgacgggcagaccgcgttcaatggcacggcgcacgatggccaagccggggtcgttgatggtgggcatgccggcgtcggatacgacgagcacggtggcgccggtttcgacctggtcgagcaggccgtcggccttgtcgcgctcgttgtggtcgtgataggcgatgacgcgaccgttcacatagacgccgaggcgacgggcgagatcgtagaggcggcgcgtgtcttcggcggccacgatatcggcccgttccaagagggccaccagacgggctgaagcgtcgccgacattgccgatcggggtggcggcgagcaccacggtgccggcggggatggtcacggccgattcgcgggattgggcgacggcggattcgccggcatgaacttcatcattgcgttcaggcacttgcgtcacgctaccgtcagcgtcatactgctcattcaactcatctgcgcttgtcatactcccagtattgcccatgccacagagcaatccacgacaatccatggcgaaatcgaggcattctccctttgcaggggctgatttcacatgttccggaggtctacttccgtttcaaggggctcctcatccggtgaagcaccgatacaaacggctttgacgcaacgctattccgccattttggcggcgtatctacttgaccatcagcccctcgaaacgcaagtagacctccggcaaaccccaaatcagccccttgaaacgcgagatggcagaatttcaacgaaaacaaatgaaaagaccctctgcggtggaatgaatgcagagggtctcgtggagctgacggtagtcgaaaccgcgacctcttcgatgcgaacgaagcgctctaccaactgagctacagccccttggatgttactttgctccgcaaagcaactcgcaacaatatagtacggagtacggtcaaacgcaatttgacgccgaagtgtcgcacgcgtgtcgacacggtaacgtttcggtgtcgcagacggggcaagtcacccacaccgctccgcatggataccgcggcggcacccggcaacgtcatcacgtctccagcacgcccagcaccttcttttcgttgtagaacgcgaacacgatgccgcccagaccgcacagcacggccgcgcacacggcggcgatgcggtagcccgcgccggacgccatgccgatggtggagacgccggtgaacagcagcatggccacggactggcccatcttcatcgcaaaggtgcgggccgcgtagaacatgccctgacggtcctggccggtggtcttggaactggcgtcggcgatattcgccacgatggcctgcggcaggatgccgaacgcggccatcggaatcgcgccgaccaccgagagcaccaaaccctgggccatcgccggaatgaagccgagcacggccgaaccaagggcgccggcaaatgcgaacgcacaggtgaagatcacgaaggcaaccagcagcagcctcttcttgccgaccttattggccagaatattgaccggcagatagaacagcacagagacgccggtcatgagcacgaagtagatggtcgtggtggtttccggcagcttgagcaggctggtcacgaagaacggcagaccggtctggaaggtggtgatggccacccagtagaccacgtcggagcatacgaacttgcggaattcgccgtcgccgaacgtctgcttcagggattcgatggtcgattcggaggtgggatgggagttgacgtagtccttctcgcggatggccagcggcggcaccagcatgcacacgaacgccacggcggccatgatggtgaaggtcacgcggatggcggtgatgcggcccatcatcggcacgaacgcgccccaaatcaccggcgccacgtacgcgatggccgtgccggccacccaagtgaaggagatggcggtggagatggtgagttgctgcttggagtcgtggccgagttcggcgatgagcgcgttgtacggcgtgcagtagaacgtgagggcgatgtagtagccgatcacggtgacgaacaggaacgccgcgttcacccagctggtgccgttgatcgggctccagaacacgagcacggtgaccaccgcgagcggcagggcggcgaatttcaggaacggcatacggcggccggatttggcgtcgcaacggtcggagagagacgccacggccgggtccacgaacgcgtcgaagaatcgggcgaaggcggtgatgccgcccaccacggtcacgatgccgagaacgaccaggccctgcggcacgaatacggtctgaccttgggagatggtctcctggtcaggttggtagaaatacacgagccagttggagatgatgccggaaagcagcgcccacccgaactggccgaccgcaaacgcccacactttggcgatggggagatctctgatggctgacttcgccggtgcaacttgcacacccgttacacttgctgtagtcgcattgcccattctcacaacctccgaatcaacattgacacagtgtcaaaatccagtatacaccggcacaccatgcgttctacgatagtgggcatgacaagtctgaccgagcaactgccatacgtatacgcttttcctgatgcgttggggaccggattactggtgcacaccgagagcgtattggacgatgagatacgcgatcgtattggctcgttcatccatgaatatgaggttgtattatctcgattccgcgatgattccatcgtcggccggatgcgcacggccgcacatggcggcacgttcgattttcccgactgggcatcgggtctgtttggcctgtacgaccgcctgtttgcggcaaccgatggggcgaccgacccgtgcgtgggcgaggatttgattcggcttggctatgacgagtcgtattcgtttacgcctgcgccagatgccgctgaacatgcaggcgcgatccacggacgagccatttggtcagccgacgttgagcggcatggcacaacactggtgacgcgcggaccggtcgcgctcgatttcggcgcgtgcggtaaggggtatttggtggatttgcttgcggggatgttgggtgatggcgcgggtcaccctcaacccattcaatacgtcatcgacgccgggggtgatttgctagtgcacacggacgaaccaatcaccatcgcccttgaagatcctgccgatccggccaacgccgtaggtacggtcgaaatcagccacggcgcattctgcgcgagctcccccagccgccgccactggtctgacgccgcaggtcaccaacttcaccatctgctcaacgccatcgacggactaccggttgacgatgtagccgccacatgggtggccgtcacgccgccatcgagcgccataaccacgaagacatcgacgcatgccagcaatgcctcgacaacggcaaaccgcgataccgacgattcgtcgaacaccgttgcagcacacgtccctgtcacactggccgacggactcgccactgctctgttcaccacctcggccacccagctacgcgctcatttccccttcgaatgcgccatcctcaacgccaaccgcaccgccgcccaatcccccaattttccgggcggttttttcacacactaatgtacgaaatcatcagtatcacatccagtggagcattccctcgggtggaccgatgggttgctccccctcagtcagctacgctgacagctcccctcggagaggggagccgagtatagctaatccgctaatccgctaacgcaggaaacaatccgtcagtcagcgagcgcgaactggctgttgtagaggtcggcgtaaaaaccgcccgccgccagcagttcgtcgtgcgtgccgcgctcgatcacgtcgccgtggttcatgacgaggatcatgtcggcgtcgcgaatcgtggagaggcgatgcgcgatcacaaagctcgtacgccccacggtcagcgcatccatggccttctgaatcagctcttcggtgcgggtatcgaccgaggaggtggcctcgtcgagaatcagaatcggcgcgtcctgcaccatcgcgcgggcgatggtcagcagctgcttctggccctgggagagcgacgacttgtcatcgagcacggtgtcatagccgtccggcagtgagcggatgaagtggtcgaggcccacggccttgcacgcatcctcgatttgcttgttggtcacgccaggcttggagtaagcgacgttctcgcgcacagtgccgcggaacacccacgtatcctgcaacaccatggagaactggtcgtgcacgttccagcgcggcacggacttggtgtccacgccgtcaatcgaaatcgaaccgccggaaatctcatagaagcgcatcagcaggttgaccatggtggtcttgccggcaccggtcgggccgacgatggcgaccttctgaccggccgagactgaagcggagaagtcgttgataatcggcttgcccggctcgtagccgaactgcacgtggctgaattccacgtcgcccttcacttcgtggccgttggtcccaagcaaagcggacttgccggattcgtcctccatctccggctcctcaaggaagccgaacacgcgttcggcggccgccgcgcaacgctgcaggttctggaaggcctgggcgaactgcgccaacggctgggtgaacaggcggacatacatcatgaacgccacgatcacgccgaactcgatctgcccgtcgagcgcgagcgccgcgcccaccacgcacaccaccacgtagccgaagttgcccacgaaattcatgagcggcatcatcaggccggagaggaactgcgacttccagccggactcgtagaggtccgagttgtacttctcgaagcgacgaatcgaatcggcctcgccgttgtatgccttgacgatgaggtgaccggcgtacatctcctccacgtggccgttgacgtcacctagcgccatctgctgccgggcgaagtacttctgggaggacttcatgatggccatcatgatgatcaggccgatgaggctggcaccgatggcgcacagggtcatgatcacgttgttgtagaacatcatcaccagcgcgcccacgaacagcgtcaccgaggtaatcagcgagccgagcgactgccccagcgtctggccgatggcgtccacatcgttggtgatgcgggacagcacgtcgccgtagctgaccttgtcgaagtatttgagcggcagtttgttgattttgaccgagatcgattcgcgcagtcgctgggcggtgcgctgggtgacgttggccatcatccagctttgcacgtagccgagcacggcgtagcccacgtacagggccaccaaagtccaggcgatgtggcccaccgtgccgaaatctaccgagttcatcaccggtctgccgttaacgatggcgggcagacctttgacgatctcgttggtcatgtccttgagcttgtccgggccgacgatctggcagacggtgccggccgcgcccaggatgagcgcgatgatgatgacgggaagatagttgcggcaatagttcacgagcttgcccatgactttgccgaaatcatggggctcttcgacggcacgcctgccgcccattggtcctcttggcatttgttttactccttaaaagtccgtattgacctccctctgatgaaggaggtggcgcgaagcgccggagggagagaagccgtacgcgactacccctcagtcagctgtgctgttttattcgctcgcttatcagctcgtcttcgcctgggaacagcccactgggctgttccctttacggctcagcccctgacatggggagctaccgctgccgcccccccctacgccgtaagctccgactggctgagctgggattcggcgatctggcggtatacgtcgcagttgtcgagcagttccttgtgcgtgccctgacccacgaccttgccgtcgtcgagcacgacgatgcggtcggcgttcatgatggtgccgatgcgctgggccacgatgagcttggtggaatccttggcctcgcgggcgagcgcgtcgcgcacttcgcggtcggtcttgaagtcgagcgcggagaacgagtcgtcgaaaatcaggatttccgggtgacggtacaccgcgcgcgcaatcgacaggcgctgcttctggccgccggacacgttcgatccgccttgggcgatcgcggcggaatacccgccgtccatgcgcgccacgaactcgctggcctgcgccacgtcggcggcggccctgacgcgattcagctgctcggccggtatatcggcaccttccacggcctcgccagcggcgatcaacgcggcctcgcgcttgcgcccggccggggtggaggtatcggccatctcgacctccgccgggtcgcccggctgatcgccgtagctcacgttggaggccacggtgcccttgaacagcacggactgctgcggcacgtagccgatcttgtcgcgcagggccttcaggtcgtagtcgcgcacgtccacgccgtcgaccaacacctggccttggctggtgtcatagaagcgcggcacgagattgataagagacgacttgccggagccggtggagccgatgaacgccaccgtctggccctgctcggcggtgaagttgatgccttccagcatcgcctcgcgcgaatccgggtaggtgaagctgacgttgcggaattccacggtgcccctctggccggttttggccacgtcggcggcggttttggtgccgttctcgacgattggctcagtgtcgagcacctccatgatgcgctgcgcggacacgtcggcgcgcggccagagcacgaacaccatgctcatgagcaggaagctcatgatgacctgcacggagtagttggagaacacgaccatgttggagaacacggtgagcttgtccttgagcccggcggcgtcgatgaggtaagcgccgatccagtagacggcgagcatcaggccgttcaggacggtgttcatcaacggcatcatgaacgccatgacgcggttggtgaacagctgggtctcggtgaggtccttgttggccttggtgaatttggcttcctggtagtcctcggcattgtaggcgcgcaccacgcgcaggccggtgaggttctcgcgggccacgaggttgatgttgtcggtcagggcctgcatggccttgaatttcggcatgaccatggccatcatgatgacgatggccgccagcagaatcactacggcgatgccggtggcgagcgtccattcgaagccttcgccggcgatcttgcacacggcccatacggccatgatcggcgacttgacgatgagctgcaggcccatggtgatgaacatctgcacctgcgtgacgtcgttggtggagcgggtgatgaggctggcggtggagaacttgctcatttcggccgggccgaaggactcgaccttgcggaattcgagcgagcgcagacgctgggtgaacgaggccgccacgcgcgcagcgatgtagccggtgatgatggcacacgccgcggatccgagcgagatgagcagcatcttgccgccggcaatccaaatgtccttcatgtggctgcccggcgtttcgaccagcgtggtgatgtctgacatatagtcgggcagtttcaggtcgaagtagacctgcccgacgatggtcaccagagcgatgagcatctgaccgatctccgctttggagaggtatttcatgatgcgaagcattggtttccccttgtgttggttgggttggttattggttattgacgattggttcttaagttggctgggttatcggcgattatcggttcacgatgtcttaatagtttctattgtttgattacttacactgtgagatattacgcgcacttctgcatgttcgctgtgagcgtcctcaattagccttgccgattagttctccgcgcgcttagctgccatgtgttcagccacgcgcttgccccgctccacgaatgcctcacgcacctgttcagcagtcggccgaggctgtcccggatggcaaatcgacatatatgtggtgaactcagacaccaggtcaacgaattcgcgcgtgcgccgctcccccatttgcgagaaaatccagcaaattgcggaacgcatttcctctatcatccgatgagactgctcgcgcccggaatcagtgagattcacgcgaataatgcgccgatccttggaatcaatgtcacgcgtgacccagccttttttctccagagacgacagcacagtggagatgcggccggaactggcctgcagcgccgatgccaattgcgatggcgtttgcgtccccttcatggacagctcccggagcacgaactgctcaccatgggctccacgagtgaattccctctgcattgtcgaacgattgccccacacgctggcatacagttcactaactgcttcctgctcaaatcccataagagcaccatccattcccattcgccacacggcagagcgccgcaaacaccccaagaatatctcacaccgtaaacaattcattactagaaactatttttggaacgcataatgcacacactccacgctctttgatattctgaaagccgcatagatattcacttcggggcgtcgtctaagaatatttgctgggccaacggtagcgacgttggcattgtgctccatgaggtatctggtcgaaaaggcggacgaagacagaccagttgggcggagcgcgcccatacctcaaaaccattgcaattattcgctttgaccattttcgtggagtcacgaaaatggtcatgaaaaacataaggacacacccatgaaccgcgacgaaatcacacgcaaaaccagcgaactcagcactcccgatacgcctgctatctcattgctcaaaacggtgatccaaagaaagaagaagtggcacttctccagagctattttgccgttcagactcgcaaaacggaaatcattgagcaacgcatgggagaaatcagccggctcgccggccgagaggcccttgccactgcagagaagaaactctatccgtatacccaaatcacacacaacaaaaccgcacaagtgcacatgtacacgcccaaccacgccgcagaacgccggcaaggatgtgatacaggccacagaaagcgttgtaccgcctaggcaatgcaacaattgtccgctatgctctgaaggcagatggcggcacggatgccatcccaaagagggggtatgaccatgattcggggtatgaacctatgcagcatcgccggctgcacgcacgaagcagaagaagcgggcatgtgcaacatgcatttcacatcggcactggttcacggagcgctgcactacactgcgggcggacgtccgtcgcactgctgagcgcaacaacaaagcaaaacaaccagtaacgctcaacggcttccacatgttcatgctctaattgcatgtacttgcagacacaatggccggtctgagccagctgccctcgcatggagcagctggctcagaacggccattattgttgctttgtactgtttgcactgtattgcgcctgcattgcgcaagctcgggcgcactcgggtgcgctcgctgagtggcgtgaatcgcagattgctcaatagcaacgcaatccacgccactcagcagttgccatggttatgcgcggcgtttgcggatgacgagcaaggcaccagccgcagctgccagcaccacaaccacgaccgcaatggcagccacggcagcacccgtattcgaaaggggcgcagcgccattagcagccggcttattcgtggcagtgctaccgggcttagcagtgttgccaggattgttggtatcgccgggcttctgctctccagggccgggagtgacctccgtggccgtgaccgtgacttcgaacgtcgcgttcacgccacgataagagacggtgatggtcctcgtgcctgcggtggcagaatcaaagccagtgaacttcagatcaccatcagttggatcaatcagcttgcgcagcgtttcagtatcgccgactttgtaaatggcggataccttcacatcggcagcgttgaacttatcgcctacctgataggaatccttggtcacttccacagcaagctcagccaactgaggcagttcgccgaatgtcactgtgtaggttttcgccgtgccatcctcagcagttacagtcaccgtggccacgccgttgttctcggccgaagcctgctccacctgcaccgtagccttcgcgtcagcagcagtcgcctccaccgtcgggtaggaagcagcatctccagccagcgcaccggcatatttagtggtatccgcggagaatccgtcaaccgtcttgccatccacagtcagatcagcaagattggcgttactagacggctgcggctctggcgttgcttcaccttcggcgatgcgtacttcagcgatcttggcatagtcattgccatcggcgtaggtgaagttgaggcgaatgcccttggtggcgggcagagcgctcacatcggcttccgtcacggctccagcagcaccattcacagtgactgccggcagcgtggcatcagtccacgtggcgctgtcttcagctaggtacgatacagtgaagctcttcggagcggcctcgcccttggccttatccaccgcaacgctgagcttgcccagctgatatgccttatcgaaggtgtagctgagccacggcgaggtgtcgccggtgccccagttcgaccagttggtgctcaggttgttgtcgcaagtcaggtcggccgtagaagcggaggcccagctgctggccggctcatacttcgaggccgcagcggacgagcagaacaaccgggcaaggttgctttccacagtcacggtgaacgtggcggttactgaagaatcagcgacaagacgcaccgtcacggtttgctcgcccaatttggtggtgtcgaagccttccagcgtgtattcgcttggctccagcacacgcgttttgccattggtgagcgtagcggtaaccgtcacgtccttatgcgcgagcgtctgcctcttggcgatagtggcttcagggcccctggccgcgatggactccacagcagcagtctgcgaaccgaacgcagtgccgttgaaggccacggtgaatgcgccggcattgctgttcgacgtggcgaaagcaccggcatcgagcccggttacgtccgcaccggtcagcgttaccgtagcgacatcctgccattcatcgttcgcggaagcacgccagtagcctttcagagtatcggttgaggtgcgctccagcttgagctgcacttggtcgccgaagccggtaccaacatgcgatgtttccttatcgatgtagccatcggcattggaatcgtactgcatgtaaacgccgcttgggctggcaagtaacgtggcatatcccttgccgccgttagcgtcagcaagaccgttacgaaccaccaggccggcacgcggatcgccattaccgcccaagtcgagcggcttgaccgtggtttccaacgtttcgttcacgtccagagcatcaggctggtacaccgcgctgccctcgttgcgatccgtccagacaccacgattggcgttgtccgtaacggtgaagtcataggtaccgccggatgcggcgacctggcacgcgctgccgcccttccaatgggcttccttccaacttccggaaatcgggttggagcaggaaacgtcgatggttctgcggaatgtgcggcccgggttgaagttgctgctctcggcaagagtgcccgtaatggtgtaggttcccggcacattgaatgcgtaggtgctgccggcagccttggtcgacttgctgactgccgtaccgccttccacattccatgtcaccttggtagcaatggtatcgtcgccttccttgacgttgacggtgtccggcagagtaacggttccgcccgtgttcacggtcttcgggagatcatcgccggtttccacagtccagttgaccagcttgcccttggcgctaccatggttgtcccaatagttcagatcccagccgtcgggctcgccttcttgagcaggattatgcatttcgatggtgccgttctcaccgatggtcagcggcagccaaacataggtggaatcggctttaccggaatcccaacggtcaccaaggtagatgaagtgacctttctcctggtctactgcgagcacactagccgactgcgaaccgaatgtggtgccgcgggtatcgcccacagacaacagaccatccgcgccttccggcatgttgttgtaccacgtgttctcgttggcatcgtccttttccacgccacgggtccagcttcccagcatggagtcggcggtgtagtaggtctgcttgttcgggtcccagccggttgcaccagatgcgatgatgttgtaacgcccgtcatattggaatacggcaggagcttccagcgaaccattttgtttgacgatttggaaatcttcgccacgcaccggggcatccgtagtaccgtctgcaagaatgtatgggtactgcccgtcagcagagtactgcttttgtccctcggactggtccacattcgtggtcttgactacattggtgtaatcatcgttaagcttggcgatatacagcgtggcattggcttcggaagaatacagtacataggcactgtcgtccttcggatccacgaacacagtcatatcgcggctgtcaccgttctcaccccagctggggttacctgcggcttctttccaattgttctggttaggcaaacgataggcacccaccatagtgaacgggcccgccggattgtcggaaacagccacgcccgcaagtgcacgtgcatagttggaaccgcccggcgtggtgcttccatcggaatgccaccacagcacgtattgcttgttcttcttgttgtagatgatcttcggacgctcgaaaatgccctgtacggaatcaaccgcgccatcaccatcctgatcggggttggtgttgaggtacgggaagattgcgtcggccttggcagcgtccacactgccgtcggacttggtcaggttgtaggccttgtcgaagtaggcgtaatcggcattgctcttatccgtcaactgagatttgctggtcaccgcacgcagcgccacaccaagatcggtccagttgtatagatctgtcgacatataagcatgaacaccggggctgttgtcgtaaccgttagaacggtcttcgccataccagtagtaggcgtcgccaaccttgaccacttggccaccgtgcgcttggatgtgtgtgccgccattatcattggcgttcttggcataccaatatggctggaagtaatcgctagcgttcttgcccggatcggctgtgggctggaacttggtgtatgtcggcacttggccgatggcaggcaggtaatccacacctgccgcactggcacttgcagcggccagcccgcatgacaatagcgttgccgcggcggtaattgccgcgataagagcgcccttgcccttattgtttatcttcattgatttggttccttgattgatgataacggttttttgaacaaacagttatgtcgctatccgcgaagtcagaaaagggccgacaaatcaatataccgatactgaaaactcagtattcaacttgtcggaccaattatgctcaaagagcggaggaaccggccggcaatagtcaatattgccggcttgttccttcccccattactgcgcgagggtgctatgcacgcttgcgcagcatgaacaatgcacccgcggcagcggccagcagagcgacagcgccagcgatggcggcaacactggaaccggtgttggccaccgtgttcttgttgccgttgccggtggcaccgggcttgttggtgctgccgggcttctattcttcagggccaggggcgactgcgttggccttgaccgtgacgttgaaggtcgcggtcacaccacggtaggagaccgtaatcgccttcttgcctgcggcggtggagtcgaacgagccaatcgcaagctgcgggtcgtcaagagcgaccggcacttccttggtcttgtcgccactctgatagacggcagtaaccttcagaccggcggtatcgagcttgtcgccgatggcgtactcgatcttcgtgggtccggtcaccttgagcgaagccaaagtgaaggctttgaaggtcaccgtgtaggtcttcgtctcagactcgtcggctgaggtcaccgtaatggtggccttgccgccaagcttgccattctcaaccgcgtcgccagtcaccttgacggtggcggcattgtcggcggcgaaggcctgcagcaccgggtttgcctcagcaccgaacggaagatcaactgtgtagtcggtcttatcagcagcgaagcccttgatggtctcgccgtcaagacgcaggtcgcccagcgtggcatcggatgccggctgcggggtgagtaccgtgctgtcttgtgcgaacacctggatctcagccacgttgatgtacaccttggtgtcctgcaatgtgttagtcaggcggatggccttggcctttaccggggtgccgagcacgaagtcaacggtcggggtgtcggcggcggtgatgccgtcggagccagagccggcatcgccggcctgtatcttccagccatccttggtaccgactccatgccattcgccagcctcatcccggtattccagcgtctggctcttcggccaagacgcacgaccatcgtagtagaagaaggtcttcacttcggtgatggtctgagcttcgtcgaaggtgaacgtggcgaccgggtccaccgtcgaggcggtggaagcccaagtggaccaaccctttgacgtagtgtcaccatcgatggccttggaagcggaggcaccctcctggaagttcaccgagaagttcgtgccagaggccgcggcgatgttcttcgcagcaccctgaaccggcgtcacgaatgcctgaatttcggtggcgttcatgtagtcgttgttcacggtgttcacaatgcgcatcttcgtggcattcactgtgcccttatcggccttgaacgtcaccgtctggcctgcggcaggcttaacatcgctaccgaattgcatccacgtctcgccatcagtggtgtactcggccttggcggaagccggagccttgtcaccatacgtaatggtcacgctgctaagctcacactcagagccgaagtcaatcgtggcggtcgggctggcggaatagtcaccagcagagttccacgtcacccaggcttcagctgacgtgtcaccatcggtgagcttcttccactgatcgcccttgctgtattccgtctgctggttggtcacagtcaggttggaagcagtgtcggccacattctcaggcgtggcggcggtgacatagatcgcgcccttcagcgcaatcgtggtcgcgtcgtccagctggtaagtaccggccacggcaatgttgtcgccagccttggcatcggcgagcttggtatcaagcccatcgaagttccacgtaaccttagccgcatcgccctcgaatgcaggcgatgccttgacgtgcagatacaccggcgcagcctcaagcgcggccttcgcctcgctcgcactggtgccggccagcactgtagccgataccggatcggaaacggtgagcgcgccaacgtagaccgtagcggcgacattgaactcgttgccgtacacatcggtggcggtagcggtggcttcgtaggcgccttccttggccacatcgaccttggaagtatcccagttggcaaccgtggccttgccttcgccccaggtgtagtagagcgtgacttcggtcggcagcgcggccttctcgttaacggcggtctgcacgttcacggtcttctggctggtcggcgttacattgcgcagagtccatgtctggttggcggacggcgaagtgccgctcggtgactgccacaagccaaccttcgtgccgactgtggtaccagagttatccacatcaaggttcgtcttagtcgcggcattgagcagctggtaggtcgaaccatcggaagtgttgagaatccacttggcagccgggtcggacttagcggccccaaccgtttcgttggaaagcgcgttcgtgccatccttggacaccagcaccttgccttcggcgttagtaatcacataagccttgagatcagggcgctcggagtcggcgggctgctcgatctgggtaaaggtccaagtctgcttcttggcgttctcggcatcggaagcgacgttggccagggacagcgcggaatcaccagaagtggtatcagccacggccttgccggactgcttaccaacgagctggtaagtatcgccggtctcgacggcagcatccttagcgtagccggtcacgccagtgagctggatggaggcgatagaacgggcgggcacagtgaccgtagcggtcttggcagccttgtcaatcaccacagagccttcagcttgcttgacgttgctggtcttggcgaagacttccggagtggcggaatcgacacccacgttcttgtcttcggcagaggtttcggtggtcagatagagctcaccgtaagcgttgtcggcaatctcgccgtacttcgacaggtcgatgacgaaggtctggtcagaggtgccggagttgcggtggatgacggtctgcgtcttgccatcggcggaggtggcagtcatgttgttgtcttcatcgttgttggcgatgaccttgtcgcccgcgtggatgaagtgagtgatggccttgacgccgttgtacttggcgttggcaataaccgtgcacggttcaagtccatcggcggtaccgccgttgttgttcacgcgacgctcggagtagagcttgccgtccttaccggccacggtgcagtcgaagtcaatcagcacggtgccccagttggtgttttcaccggccgggttcacgttcgagcccatctgcatgttgtagaggtcctcgaccacctgccagaaggtgaagtccttggactgcaggcgggtgacgttggagctgatcttgctcatcatgcccagcgcgttgtcgaaaccgtacgggttgtaggagccggactgccaggagccgtccacctcgctcatcgacagcttcttgccgtctgcctgagcgatatcgcgcgattgcatctggctgccgtcggagtaggcgtgaacattgtactgatcgataaggtccttgatcgcctgcgggtactggttgtacgacttgacaaagtcagcggagtttgtagcatcagtggctgcgatgatggtgtcatcattgtccttgagcgcctcagcgagtgcggtaatcgtctgctgctgctgggcgttattgacatgcataccctcctgcggcttcttcagcgcgttggagtatggggtgacggacttatctttgtcggagtagtacttatcccagtagttgttaatgagcttggtgttgtcatcgctctcatcggtgtacttcgaagccatgtcgcccggagtgccccagtaactggtctcggactcgttgaacggctcgaccgtgtcaacgtttgcgccaaggctttcgaggtgctcgacgttcttggtcatgtactgagcgaatttctcagggtttgcaagattattgctaccggagttgtatccaccagtggcgtaaccgctgttggtcaggaaccacggagcggagttggcgaaggcctctacatcggtgatgtcggggttatcgccggtggcaccgcgctcaatccaccagtcttgggcggcggacttggagaagtcatactggttgtcgtcagtcgggtcgaatgccgcagccagcttgtctttgtcggcctgcttggtggttacgccattgccatacgtgccggagccggtggcgtcatctttccacgtgccaggcacggcagcgccttggcgcatgaatgggtagccgtaggcaacatcggaggcattgccgccgcccacgttgtagcgggccatgttcaggtccagtccttcatcaccgaagatggactggtagaactgttcgcgcagctgtttgccgtattccacagccttagccttggaagcgtcatcgccgagattggtggtgatggccgattcctcgccgaggctgccggtggcgttggcgaaccaagccagcgaggtgccccagccatcgaaactgttggcataccatgggttcggggtcacggtaatggcatcgttatcagccgcatacgcagtgccggcaaccgcaaacgcccctcctcccactagtgttgccgccgcaaccattgcagcaagcgatttgctcagtaccttcattggtctccttagtgttcctgctgtccgccttataccggaaaaatcggcctttgcttcactgagccagcctctttgcctgatacatgacctacgtcgactccttctttcggcgcagccaaaatgtttacgcaaacattttgatatgagcgattttatcacaaaaccgtcacccagcaaacaacttcagagaccacaaacgacgcacaaagtcatgagccattcgaattgcgctggcccaatcgctacgaatcatatttgccgtagcccttaagtgaatcccactgcatcgagatatcgcgcccgctatcccttccgataacgccgaccacgcgtgttgccttcagcaatcagctttccttgcgcaactaaaccgtttaggaatttgcggactgttctgttatcgagctctgttatcttggcgagttcaggtacagtcacatagtcaacctctgtcaagcgtcgattcatcgccgacagcatcgctgcccgcgaatcaatttcacccgatgcggttgcatctgctttcttaccatccacacgttccccgccaatgagcctcgcaccctcttcggcatctttctcaactacagatctcacgctagcaaaaccagaaccatccacggtcttcagcgcaggaacaataggaatcgtcgcctcgaatatgtcaccatcgcggaactcaggctctcgctcagtatattgccgggacgctcttatcagattccgcagtccgctacccagctgctcggctatgccggtctgcacaaacacattagcgataatcggattctttggcattggcgtgaactcgcccagcttcattcgaccttcaaagaatgagcgcgaagcattaaccgtccggatggattcattatcaatggtgacacgcgccaccaccggactggaatactcccgatgcatgaggctgtttgccaccaattcacgggcgatcatcgtacgcgggctcactcgcttatcgccctttaacacaaagcggtcaggcagattccgctcagtaaattcacggagttgctcgtacgaatcgaacaagttggtccgcaccataagtcggtcatcgtatcggtcaatattgtctcgccgaaccacggcatcagtaatatacgctgggcaaaccgaggaaatgacttcatccttgcccaagagcagcactgcagcaagattaaagccctcttcgccggtcgtgtaatcacgatcgtatagcttggcgctgcggaacagttcttcgtcagacatagttccccaagggtgcccagctcgctgagcgaccgccagctgccgcattcgcgcaatcagctcaggacgcaaatcaaacggagtcacgtaacggaaaattcgccgttcggaatagtagttctgcttgcgaatatacatttgactaatctggatatcgctttcgatgtgtgtatccacatcagcaatgcgatcaaacactgcgcccttgaaccgcacaaccgaagaactcggagctacccaaatacgaacaataatccgttcgtcgtactcgatatgttccgtttccaccattggagccggttcgaacatcttacgattagacactacgttgacaacgttgcgctctatctcactaacgcgcttagaatcgacgccgagcacttgaccgtcatcgtcaacgccaagataaatgctgccaccagaacgattggcgaatgagcatacagtctcaaaagtatccgtatgaggcaattcgctgcagcgcttgaactcgaccatagatgattcaccggcctgcagcacttgcataagttcatcctgcgtcatcgcattccgcccttcatagcgataattcatacattaggacatggcacttatcgtattttagcatctaattagtacattaggacattgttttatgtcctaatgtactaattaggcggctaattgtactaataattgcacactgatgtactaatccgatgatcgaatgcactaattgtccgcgcaaatgcactaatcggatgaccgaatgtatcaatgagacctataggcagccgattggctgacgatcagcccagtcattggctatcggccgctagccagtcagccgccaacagccaacagccacccaactaatagccgccagccaatcagcccgtccaatcactccttgtgttccagtgcggcctttaaatcgcggctacggtagcgttcgcgcagcatcgagaatccaccgaagcccacaagccacaccaggccggcaatcgcggaattgcgcgtatcgtccgcaaggaacaacgtcaggtagatgaacacgaagaacacgattgccaccgtattgagcaccttccaagcgggcatgacgaacccgtccggaatgaaatcagcggagcgacggtacttgcggtgtgccatcagcgtcaggatgtagatgaacaggaacaccgcggagctggcggacgagaacagcacgaacgctccggacacgccggggatggcgttgacgatcggcgacagcagtatcagcgccgcggacaccaggatggcgcgggccggcaccttgcgatcggacacctgaccgagcttgttgagcgtcgggttcggcgacacctcggacagctggtacaggtggcggccagccgagtacagcagcgagttcagcgcggaagatgcggcggtaatcaccacgaagaacaccagcgcagacgcccaattcagcccggcatactggaacatcataatgaacggggatgcgaaggagccgtccttgttcggcttgaacgaggtccacggcacaatgcacatgatggccaccagtgcgcccacatagaagatgagcacgcgcacgataatctcgttgatggccttgggcagcaccttgcgcggattcttggtctcggagacggtgacgcccacgaattcaatcatctcgtaggcgaagaacaccatctggaagctcatgaggaaggccatccaaccgttcggcgcgaacgagaagttggcgaacaggttgtcgaatccggcgtggccggccgggctcacgtggtccacgccgtgaatctgcacggctgggtaatggtagccgatcacgatcatgaccacggcggtggcgatcatcgcgcaaatcagcgtgatcttgatcatcgagaaccagaattccacctcgccgaacaccttgacggcaatcaggttgatggagaccagcgacaccaggaaacacagctcgatcagccatttccaatgggtcaggtcgatgccgaacgtgtcgaagaaggtgatgaagtacgtggagacggccgtgatctcggtcatgcccagcagcacgagcgcggcccaatacgtccagccggcgaaatgcccccacccgttgccaaggtaacgggtgatgaaattgatgaaggtgtgctggctggggtcacggtacatcatttcgccgatggcgcgcatcaggaagaacatgatgacaccgaccagaatgtacacgaagatgatcgaggggccggttagcgagattgacttgcccgagcccaggaacaggccggtgccgatggtgccgccaatggcgatgaactgtacgtggcgattgctcaggccacgctccatctcgttggtctggtccaggctttcgacagacttgagtttgcccgtagcctgctgtgtaccaccattcacattcgtatcggccatactgatttcatttctcttctctgccgcccgattgttacgcaccagacgcgatactcgttcaaaacaagttcaaactgtatcaccgaaatatgtcacgaaaaccgctcagctcaagaatacatgcgatgatactgtaaatattccgccaaaaagttcaattcatcaacaccaaattgaacttctacctctattccacggacttgagcgagctgaccgggtctacgcgatcgagcactgggttggtgaacagctgcaccagcagcgcgaacgccagcgtcgccaccacggcaatcgcatagctgtaccagtgcacttccacttcgaaatacagcgacggcatattcaacgcagcagtcagtaatccgcctatccacctgccaagcggcagaccaaccaccacacccataccggtcaatatcatcatctcgcggttcacgtagttgtgcacctcgcggtcatagaagcccagcaccttcagtgtggccatctcgcggatgcgttcggacacgttcgtattggccaacgtaaacagcaccaccagcgccaggccgccggcgagccccacaatcagcgccaccacggcacccatcaaatcgaacttaaacgtggcggccagatgcgcacagctcacggccttgagcaccgacgattcctcgcccaaccgatccgcatattcggcctgttcggtctcggaacctttcagcttggcgagcatcgcgttccacgtcaaggtcgaggcagtgccatctcccgaagccgaagacgtcacaccgtcggccgcaaacttctggtcgtacagtcgctcactgatgtacacatcagagccgatgaggttgcgcgtcaccgccgcaaccttcaccttggcccgcccgctgccgccattgctcaacgtgacggtgtcgcccgcatgaatatccaacgaattggctgcggacttcgccacaatcacaccactatcgtccagcgctacagtgccgccacccgctttgccgaagatattgggcagctcgaaccacccatcgtcaccggcctcttccagcgtgaccatgtcgttcagtttgttcaacgaattgttgggcaccgtcatcagctgcacggtttcgctttcctgcgccgcattgctcatctcgccgctatccacgcgcagattcagcgtttcggtggcccggccatcttgtgccacctgcttgcgcatcgcggtggcgtcatcgtcattggccacgaccatcaggtcgtactggtagatctgctcatattgcttgacgccagtcgtgtcgacggtgtcgttaatcgcaaatccgcagataatcagcgctgtgcaaccagccacgccgcccacggtcataatcaaacgcgacttgaatcggaagatattgcgcgcagtgactttgccgaggaagttcagccggctccataccgggcgaatccgctccaacaatatgcgagcgcccgccttcggcgccttcgggcgcatcagcgcggcgggcgtgtgccgtatctcctcgcggcaggcgagcgcggtgaccacgcccacaccgaccacgaacagcacgatgccggccgagccgtacagccagtcgtattcgagtcgcacaccgggcaatatatacagtccctcaatcaccaccatcaggaatgccgggatgccgaggaatccgaccagcagaccgatgccgccgccgaccaagcaggcgagcaacgcgaacagcagataccggctggacacggcgagtccgccatagccgagtccaaggtaggtgccgataagtccgcggtcttcctcgaccatgcgggtcatggtggtcaggctcatgagcacggcgaccagcaggaacacaatcgggaatgcgcggccgatggattcgatggaactgacgtctgatttgagcgagctgaatccgtcgatcgaagcgcgtgtctgcacataccaacgtgcgttggccacatcgtcgatgcgccgttgctgcttggcgaattcgctttccgcttcgcttcgcttcgcatcgagttcagactgcgcatcatccagtttcgccttgccgtccgcgagctgttgttcgccttcttccagctgccgctcgccttcttcgagctgctgcttgccgctggccagttgggcggcctgcgcttcaagttgcgccgactgggtttcgagggttgcggcattcgcttcgagttccgcggatttggtattgagctgtgcctctcctgcagccgcttcctgttccttggcggtcagttgcgcgttctgctggtccaaggtggattgtgcgggggcaatggtttcgtttaatgtgcgctgcaaatcggctttctgctgggtcagactgtctcgctgcgtttgcagttccgtttgcttggcggccagctgttgccgcagctcactgattgacggcacttcaggcagggtaatgccaaggcgcgcgagcagttgcttgatggcctgccatgtgggtgagttgaagtcgatattcgggtcaagttgcgccagtagattgtcggcctgttgaatcatggacagcatctgatcaatttgtgccacgccttggtcgatttgggtaatgccctgttcgattttcgtgcgattggcagtcagttccgtttgcgccgcatcgagctgtttgcgagccgaggtgagctgcgctttgcccgattcgagctgggtgcgcgcttcggctatctgctggcgaccttgcgcgatctgttgacgggccgatgcaatctgcgcacgtccatcggcgagctgccgttcgccatcggtaatggttgtcctgttgttctccaattcggtacggctatcttgcaatgtcgtttcgttggcttccagctcggcccagttgtcgtcgatctgcttctgggcttcgtccagctgctcgttggcctcgtcttgggcatcatccagtttgcgctgcgcgctggagacgatctgttgacgacgggctttctggcgtgtggcctgtatctgatgttcgatacggtcggccacggttttgacggcttcatcgtaggcatcggaaaacgtgtcaaaatcggacgcaccagtgacggcaaccgatatcgcagtgtatatattgccggtcacgccgtcgctgggtgcaaagaacgtatagtcctcggatgaggtggaccggaaggaggtcatgcccgaatagccgtctggattgttgaggtcgcgcgggtcaagtacgacgccggtgatggtgagtttcgtggggaactgcggggattgctcggcgtcggcgtccgtattggcggcgacacctaccgtatcggcattattggaatcgtcattggaatcattattggaatcgtcagtctccgtggccgctaccgatatgacggatgaagaggtgtcttgtggcgtcacagtaatggtgccgccaatcttgagtccgctatcgttcaggaactgctgagtcaccgccacttcgccggccttgttcggcagtttgccttgttgcaggtacggctgatcaagcccttcggtaccgatttcctgcatggtcacggttttcttggtgccgtccaccaacgtggtcaccgtctgagaacgttcgggctgcacggtttgcacaccgtcgattcggcgcagtgccgccgcatcatcatcggtcaggccgtatgtggatagcacctgcaggtcatgcagtccctgctgatcgtaaaaacgaccggccgccagaaaagcatcgcggcatccggcgtagatgccggtcagcacggccacgccaagcagcgtaatgacggcgatcgagacgaacctcttccagctgcgcagccagcaacgcaacgtatctttggcaaataccgcagaaacgcccgctcctcgaccgccgctatcgtcgaggttccgccgtttcacagaatgtttcacaaatcgcctcgcttgtttcacggggcgtttcacagagtgtcttgcagtgagcatcgccaatcacctaccattcgatatcggcgatgggctgcggcgttgcattgatctcctcgctggccaccttgccggagcggaagcgaatcactttatgagccatcggtgcaagcgcggaattatgcgtgatgatcatcacggtcatgccttgcgtttggcaaatatcctgcagcagctgcagcacttccttgccggtctcgtaatcgagcgcaccggtcggctcatcacacaacagcagcttcggctttttggcaatcgcgcgggcgatggatacacgctgttgttcgccgccggacagttgcgctgggaagttccccatgcgctcccccaacccgaccttgtacaaggtttccaccgggtcgaaatggtcggggcaaatctgtgaggcaagctccacgttttccagcgcggtaaggttcggcacaagattgtagaactggaaaacgaagccgatgtcgttgcgccggtaggtcaccagtccctttttccgcaggcccgtaatatcgcgcccgccgaccgctacgcggccggttgtggcggtatccatgccgcccagaatgttcaatgccgtggttttgccggcaccggactgtcccagaatcacgcttaattcgccttgttcggcggtaaagctggcctcgtcgagcgcgcgaatcacactgctaccagaaggatattccttgaccacatggtcgaattcgatatacgccatcgcacacctccaacgcgctcgtggcagccacctagccccataggccccgccagaacttcctgctatactcaagtaaaacaacactgtgtcggttctgcaaccaacagttggattgtgggttgtcggaacttggggagaaggccatgtccaaagaattgacggaaagccgccgcacccgttacacgagacgtgccatgcaggacgcgcttatcgagttgctgcgcgatcagccgctcggctccatcaccgttaaagcgttgtgcgagcgggccgatgtgaatcgttccacgttttacgcgcattatgcgagcatcgaggaactgctgcacgacattgaagacgaaaccatggcctgggtcaccaccgcactcgaacagctactcgcccagccagatcctgacggcatcgagcatgttattgagcgcatctgccagtacattgccgacaatcgcaatcatctccaagtgctgatgagcccgaaagcggatatcggtttccagcagcagctgctgggattgatttacagccagcgcggtgtaggcgaacagttgcaatcttcggcgggttacccagccgaggcgcagatgcgtatgcgattcgccgtgtccggcagcattgggcttttgcaatactggctcgccaccgatctcgcggcctctcccgaatcggtgtcccacaccatcttcaccatgtgtacgcctgccacgcagtgagcacagtgaattcagtgaactcagtgaagcgtgcggtttcataagcatcgctcgctatagcttcgcctgctcaccggccgcgcccacgcccgcgcttgcaatagcgcacaaatagacgattgaccatttctgagacgatacggcggcatagaataacgaacgttgcgcatcacggcaagccccgcgtgcgccaaacccaagaaatgtgagagaagagcacaatgagtactactgatgcgcctaagaagccgcgcgaaaccgacgacgtgccggtgccggccacgctgcgcaagtcattgaaaaaccgccacatccagctgattgcgctgggcggcgccatcggaaccggcctgttctatggttccagtgaatccatcgcgctggccggaccctcgattctgctcgcctacttggttggcggcctcgcgattttcgcgattgtgcgtgcactgtctgaaatgtccgttgaggatccgaaggcgggcgcgttcagctactatgccacccgctactggtccaagcgcgccggctttatttccggctggaactactggttcaactacatcctcgtctcgatggtggagctatcagtggtgggttcgtttgtgaactactggttcccggcgattccgacatgggtgtcggcggccgtgttcttggtgatcatctgcgccgccaacctgctgggcgtctctaaattcggtgagttcgagttctggttcgccatcatcaagattgtggccgtgatcgccatgattatcggcggcctggccgtcatcatctttgtcctgcccaccgcatccggcatcaaagcgagctttgccaactggttcaccttggaagggggcttcttcccgaacggtctcatggagcagactaaggacggcacctggaccggcctgttgatggcgcttgtcgtggtgatgttcagcttcggcggcaccgagctcatcggcatcaccgccggcgaaaccgaggaccctcgtcgtacgattccccgcgccaccaatgacattatctggcgaattctcgtgttctacattggcgcgctcggcgtaatcatggccgtaataccgtggaacaccatcggcggagacgatgttcccagcccgttcgtgcaaatcttcgattccgtgggcatccacgcggccgccggcatcctcaacttcgtgtgcctgaccgctgtgatgagcgtctacaactccggcctgtacgccaactcccgcatgctgtattcgctggccaaacaaggcaatgcacccgcgtatctgggcaagctcaacgctaagggcgtgccggtggccggcgtgctgacgtccgccgtgatcaccgccatcgccgtggtcgtggtgttcgtgtggcctgagttcgcgttcaactatctgatgtcgattgccaccatcgccggcatcatcaactggacgatgatcatgttcaccgaaatgaagttccgtaaggtggtcgccgcgggcggcgctcccgaggattccgaactggccggcaagtccggcaaggaagcgctcgacgcgattcacttcaagctgccgttcgctaaggtgaccccgtgggtggtgttggcgttcttggcactggtggtggtgctcatgtgcttctccgccagctaccgcgtcgccgtcatcgccggcgtgatctggctcgccattctcttcgccgcctaccagatcactcaggcgaagagataagcccattaccatgtttggtaggccccgatggtcggggccgggtcgccggttccggtatgactttcctgccctgtcgtcgatgatccgggggtgttgtcgccgggaacggggacgcccgatgaccgctgataggaaccaggccggctacacggacgcttcaggggcgcatggcgcaggtctcgtcgtaatgtgggtgcggcgcgggcgtccggactcctccgagcccgcggcgaccggaaaaccttcatgacgggaggaacgatgatgaccccggacgacatcgacgtgtgggtcggcctggacgtgggcaagagcgcgcaccacgcgcacgccctcgaccatgacgggaacaccctgtacgacaagccgttgaaacaggacgagaaggccatccgcacgatgctgggcaagctctccaagcatggccgtgtgctgctggtcgtggaccagcccaacaccatcggctccctgcccctgacggtggcgcggaacatggggatcgcggttgcctaccttcccggcacggccatgcgcaggaccgcgcagctgctgcccggggacgcgaagaccgaccgcagggacgcgcatgtgatcgcgtgggccgcgctcaagctgcccgagacgctcagggacgcgggcccggatgacgagaccctcgccgccctgaagctgctcgccggccacgacgaggacctcgcccacgaatccacccgccacgtcaaccgcctgcggagcctgctgctgcagacccaccccgcgttcgaacgcgcgctcaagggcgagagaatcacgcgcgacgcgacgctcgcgctgctcgaacgatacggcgggcccatgggcgtgaaacgggccgggatcgaggacgtgaaggactgggccaagtccaacgggcttcgcgccggccgcatcatcgacgacatgttcaaggcgatcggcgagcagaccgtcaccgtgcccggcaccctcatggccgagaccatcatcccctccatcgcccacgacatcaagacgatcagggaccggcggcgcgaggtcggccgccaggtcgagaagctcctggaggaccaccctcttctcacggtcctgacgtcgatgcccgggataggcgtcaggaccgcaagcaacatcctgctcggcatcggcggcgacatcgccaacttcaaatcgtccgcccatctggccgcctacgcgggcatatcgcccgtcaccggccaatccggcaccagcatcaaaggcgaacggccctccaggcggggcaacaaacgcctcaagaacgcgctgtggcagaccgcgttcgtcgcatccaccaaacacccgccctccgtggcctattacaagcgcaaacgcgaacagggcaaacaccacaacgccgccatcatctgcctcgcgcgtcggcgctgcgacgtgatctacagcatgctcaaaaacggaaccctctaccaggaaccagccctcgtagcctgaaccgggccacacgggaaaggacgccggacgccaccggcagggcgaagcgcgcccacgacagccaaccggaatcccgacacgtcaactccccaaggagttgacaaaaacataggaacacccccctattgcaaaaaactctcactgactcaacgtcagtgagagttttttgcaaatgaggggtcagatacggcgcttgcgccagatggtcagggcgataccggcggcggcgaggaccaccacggtaccagccacgccgaagacggcggcaccagtgtcggagatgacggcacccggcttcttgccatcagcggagaccttcacgagggccttgcgggcctcggtcaggtgacgaatcgcatcctggacctcggtggaggtggcgttctccttggcgagcaccttcttcgcttgggccagcgcatcggcgtaggccttccacgaatcggcggtgtaatcgtcctggttcagcttctcggcttcggccttggcaatggcgtcttcgagctgcttgagctcttcctcagtggccagatcgggatccggagtcggcgtctcgtcggcaacgaccttcacggtgaacgtggcggtcttggtcgaatcggccacagactgcacggtcacggtcaccttgtcggaggccttcgaggagtcgaagccgagcagctcgtactcatcggcggcgagctcacgggtggtggagccgccgttgccatcggccacggtcgcggtgacgaccagaccggcaacgtcgagcgcttcaccaaccttgtactcggccttggcgggctgcgcggtcacggcgatggagaggatcgtgcctgcggccgggtgctccggctcgggctggctctcctccaacgcattctgcgcgtcggtcagggccttggcggcggcatcgacatcagcctgagacaggccggagtcaaggaaggtctgcttggccgtcttggctgcggcgagcgcatcctcgaatgccttccagctggcctcggtgtaagcagagccatcggtgccgagcttgtcggccgctccaatcgcgccatcaagcgccgtcgtatcggccatctcaatggacacgccttcgtcggtcgggtgaatggtctgcatcaggccgtccgcgtcgaaggtgatctcgtcgatggcggtttcacggtggtagccgaggccggaggtgaacacgccgagcggcgtgtagtggcgatggtaggccatgagccaacggtcgttgccgtccgcgtcggtcacatgcacgtcggactggtgcgcggtaccttgcaggttcttggaggaatccttctgcagcagcacacccttgtaggtgatggtgccgtcgatggaatcggagacgccgtacctcacatggtagttcggggagttggcgtcgtcgcacgaccaggtccagtggtacttgccgtcgcggtaggcgacgaccacggactcgcggaagccgttcagaccgttgagcttcttcaccgtaccggccttgatgctcaccatgtcgtcgttgagttcggcgatggcgggcgaaccgttgccgtacaggatgtacgacttgccggtgttcgggtcggtgaagatggacgggtcgatggcctgtccaacggtgacgccttccatcgtgcgagtgaccagcggttggtcggcggccttgtacgggccggccgggttgtcggccacggcgacgccgatggcggatgtaccgttcggcaacttcgcgcagtagtagaagtagtacttgccgttcttcttctcgatggtcggcgcccacgcggagcccacggaccacggggagatggcggtgttctcatcgccatcggtggtcggctggtggtccttattgacatcgaggatcacgccctcgtcggtccagttcaccaagtcggtggagctgaacgcatggaagtagttgccgctccagccggagaagccgtcggtggtcgggtagatccagaacttgccgtcgaagtagtcgatgtccgggtcggcgtactggccgggcagtaccgggttgttgcccacggtgaccttcttcagcgtccaggtctgcggcgcaccgtcgcccaaatcaacgaccaaagtacggtccttagccaggtcggccgtaccaccattggtgaacgcctgaccatcaagggtgagcttgatggagtcgtcgctacggttgacagacaccttgacgggcaccttggtcgcgccgccacggcggttgagcacggtggtgacggtcttcgtggaccagtcgagggtggaacggacctgagagtggtcgtcagtgccacgcagcgagttcgggtcggacggcacagtgcccacagaaataccctgcagagcaatcgggctggtcttctcgacttcctgagcagtgagcgcgcggttccacacgttcacattgtcgaacgaacccttgaagtatgggtcgttgtagaaggacttgcccaagtaggccagcagatcgttacccaaatcggtgaccttgttcttggtcgccttgttctgagccacctgcgcaccgtcagagtacacggtcatcacgttgtcgtccaacgtgaccgtgacacgatgccatgcgccgttgccagacaacgtagcgttagccgcgtcctccgcaccatacgagttggtggtgatgcggctggcgagctcgccggagttgttgtacttcaggaagtagtacttggtggagttctggccgaaagcgaacgtgaactggtttttattgatctccgacttgacatccatctgcacagtcagcttgttacggccatcgaacaggcccttcgggaactcggcgtaggtgccgtcagagccgtcgagcttaagcaccttgcccttttcggcatcctcggagaccttggcgttgccgttgaaggtcaagtcgttgctgttctcagtggtgtcggtacccttgctgtcttcgaagtcatactcggcaatcggaccggagccgtcttcatcgggtgtgactggctcggtgtccttgttcttatcgaatgccttcaggattgcgttgtactcggtttcagtgacaggcaggatggtgccgtgacgcttcttgagcgaaccgaagttcacatcagaggcaaagccccaatcagccttatcagtgctgcctaaatcggcagaacggtatggggtgtaacccttaccggctgagtactggtcccacatcagaccgtagagcatcttcttgcccgcatcactggtctgcacgtcatcttcattgtagaagaacagctccgggccttccagctgcgcaccggtcagaccggtaccagtcaggtcaccgaatgtaccgacaagcgtccactggttcggatcactgtcagtgttgtagtaaccattcgcaattgtgtcaccagtggtgagcgttgtggcatacggatccttgctacgctcaacaccgaggtacgtgtcaccggacacacgatagtaatagccgtcatcggccttaatcatcgtggtatcgataacggacttgactcggtcgatccacttgacaggcgtcgtgaagttcacgaaatcacgcgtggtggagtagtacatattggtgcgatcgccggacttgttgtccgcgtcggaagcagtggcccagtacaccatgtactgcttgttcacatcatcccagtaggcttccggagcccaagccatgccggctcccggaatctgagaggcaacgtcaacggcgcgcggttcgctccagttgacgaagtcatgcgactcccacacgattaggttggtgctgccattggtggtagcggtggccgcgccccaaccgccacggttatggatgctcagctcggtagcgatgaggtagacggtgtcgccttccggagagcggaccagatacgggtcgcgcacgccgttgtccttaccacgagagttgccggtctggctgttgttccagctgagtaccggatcgccggactcgcgggtgtcatgccagctcaggccatccttgctggtggcgaagtacatctgctcgtcggtagcgctaccttcggtgccggtgaagtgcgcaaacagatagtccgtggtcttcggctgttcgacggcggccttgacggtcagctcgaattccttggtttccgtgttgccgtcagcatcggtaatggtggcagtgagcgtcaccttggtgtcggttttctgacgagcaacgacaccagctgcgatgtcaccatctgccgcatcggtaatgacctttgcgttgctggatttccacgtaatcgcggaaccgttaaccgagcccttggccggaagtgtgatgttggaatacacatcagtgctgccgttgttaatggtcagcgcattagcgtcggccttggcggcatcggacttcgtggaatcgtaggcttccttgatttggtcagcagtatgcgcagagccgtaaatcttgaggttgtcaagtgcgccggtatagtattcgccattcacccagttggccttgccgatctgcagcacgccgccgtctgcgccgagaatatcggtgagctgagcgaagctcgcgccatcagctggggctacggttgcggcctgctcaccgtcaatgtacagcgtggaagcggcctcgtcgatgaccaaatcgacgtgacgccactggctggcgagaccatccttgctcacattgccggtggtgtcgcgcttaccagcgttgttgtaacgctcaacgttcaccgaagtggtgcgatccatcacgccgaggtaatgctcttgctgataggtctgcgcattcgtattcggtgccgcaaataccgaccagccctgattggtgctggcggacttggaatcgtacgaaatcgtgaccgcatccaggcccttgagcacggcagaatcgtccgacttagtcacattcagccagaatccagaaccgagccgaactgcagcagtgccgtccttgctggtagccactgcggcagcaccgttgatggtcgccttggtgccggtggtgtcatcgacaatagtgccagtagcgcctgcagcgacgttgtcgaaatcaagactggcgagcagatcgctgtctgccgctgccttggcatttgatttcagggctgctgccagcgcccgctgcgcggccgatgaatcggtgggatccgattcaaccgcatttgctgctggcgccaacgccatcagcatcgggacagctgcaagagctgccaccgctttcttccacttacccatgtgtctcctctgattgtgggttttggtttttgcgctgagttatggatcgaagttattgatcaacggtgttcagcttcctgaacaggaaacaaacatcgattttgttatcaaattgttatcgtgcgacggtcggccgctcctttatcggcctagtttcgcgcctttttcgcaccgacgaagctgcttcgtttgccagcgcgaactgtgttctcatgcatccgcgcaacgccccgccccctcaaacgacaccgttttgagggaccggggcaacgcgaagccgcatttttggttataagtacttgcaagtttaatatgagcgttcactctttgtggagcgagggccccaatcatccgtcttcggcactcggctcccctcacccaggggagccgagtgcgacgccaatcaggactggcgcttgcgcagggcgtaggctccggcagcggcgacaagcagcgccgcggcggtgaggcttacgccgaggacggcggaaccggtgtcactgatcttgtcgctcggcttggaggcgggcttttgggcaccgtcgtccttgccgtcggtcttgccggagtcgccggacttcttgaccagcttgtcggcggcggactggagccgcgacagcgccttgtccacttcctgctggtcggtggagctctgcaacacctgcttcgcgtcggcgagcgcggcggcgaaagcatcccaaccagactggtaatcagccttgttatagcccttcaccttatcgacaagcgcctgcaacttggacttgtccagcgtggagccgggctcgccggccttgatggtgaacgttgccgaagcagtaccggagtacttgccagcgccggttacggtcactgtggcggtgccgggttcgatgttgttcgtgtaggccaccgtgtagtcggcgccttccttgagcgtcgcgccatcgagcgtaacggtcacggccggttccttggcagcaccgtctgcggtgaactcgttgggttcggccgtgacgaccgccccggagatgtcagtgccagtcacggtgacggtcgcctcgaccggcatacgggaatcgtcctgggcgacgcccttgacggtgaaagtgccggtcttggcataggaagctgcgtcaatggcatcccactcaactgcaacgtcagaaacggaaccgtccgcatgagtcagatgcgcggtttccggcagcgtcggcgccacaccaaccgtcgtctcggcagacagcgcgtcaacggacttcacagccacagccggagcgtacgcctccagcaccttctgatactgggcgcgggtcacgggcagcacagtgccgtggcgcggcttgccgccatcggaattggtcgggaagttcacctcaggcatcttattgccgataacggtccactgaccgctggcgatatcctcagtcgccatcggcacatagtggtttggaccttgatgatagctcggctggtcggcgaacaggtagtactggtagccgttcacgtcgccatcgttggccttgaatagcgatggaccttcgccggaagtgaaggttttaccgtaaccgttagcctggcctttaccgatgttcgtggcaacttcgctccatgcactacccttaagcgcatcggcgtagttcttcacgccggcaccaccaattgcggcagtcaaatctgtggacttctcctgacgcaaagacatcgtgttttcatctttgtagatgcggtagtaggtatcccctaccttttgcacggtcacatcgatggatccactgcctgcaccgcctcggcgatcaacgtcaatccacactgtcgggtcggagaagttgacgaagtcatcggtggtgacgtacaccatgcggttgtaggtcagctgcttgcggctgttctcgtcggtgttgtcgtacaggttcgaggcccaatagaccacgtacttgccgatttcctcgtcgtagtaggcctcaggcgcccaagtgttgcctgcgtaatcagagctcactttgacgtggctttgcttggaccagttgaccagatcgtcggacttccagatctcaatgtacttggaaccgttagcctgtgcaccagcaaagccattcagcccgttgaggggggcacgaccgtcaatcttcagatcggtggcgagcatgtagaacttgtcgccgtccttggacttcatgatgaacggatcgcgcaaacccttctcgccaaactcggaagtgaatatcggcgtgccgttgttcagcgtgttccagtcgagcgcatcgttgcccttggaggccgcgaggctgattttctcgccgcccacgccctcgccggtgaagaacgcccacacgtaggcctcgtccttctcttcggcggcaggcatcggctgaatggtgacggtgaaggtcttagtttcagtggcggtatcgtacttggcagtggctttgagcgtcacagtggcggcatcgctaccggcggcagggcgcttaacagtgaccgttcgagatttgtcgttcacgccttcgcctagtgtggcgatatccttgccaccggtcacttcccacgagatggtcgaaccattgttgcccttggtgggcacggagaagttgctacggatgtcgtcggagtcctcgatggtgacgacgtcaaggtcggccttggcttgctcggcatcggagagctgcttcggcacgaggaccgtgtagtcggcggttttggcgttgttgccgaacgtggcggtgagggtcacctcggcatcagctgcggttgcggccggacgagtgactgtggccttgccggtagcgttgtcaacggcgatggctgcgttgtccgacttccacgcgatgctcacgccagcggcgctggtcggcagcgcgaagtcctcggtagcggatgcgggcacagcggccttgacagcggcctcggccttgtcgagcacctgagcgtcatacagcttggtcacgtctgcggcgctgatggcagtgtcgtatacggcgtaatcgtccacgtcgagcttggagttcgggtcagcgtaggaggacttgccaatgtaggcgacgaggtcgccgtaattggtcaggccaccggccggaatggtgtaggtggcgtctccaacctgcttgccgttgaggtagaagctcatggtgctgttggtgccgctgatgacggtggtgtacagagccaaatcgctggtggccttggtgccggtggtggcggcgttcgtcgatccagggccgacttcggtgccccacgggctgttattcgggtcggccgcagtggcattggtcattacggatttcgcgtagccactcgggttggccgggttgagcagccagtagccgttggccggataattgccggtcttggccgcgccgatgtacgcggcggcggtattgccgttgccgtaattgttcttgagccagatggagacggtaacgtccttcttaccggcgatggccgtggtcggcacgctaatggtttgcgagccggtcaggttgatctggccattggccaccgtggcgtcgccggatagggtggcatcgctgttggccgcgctgccctcgttagcgatggtcttggacgtcagtgcgttatcgaatgaatagtggatgatcggactggcatcgattggcgatgcgctctcggcactggccgtcatcggcagcaacagaccagcgagcagtgttgccatgccgaccgtgagtccggttgcctttcgtatcagctttcccatgtttctcctcattgatagggttgattgtggttgcgccttcagttatggagcgaagttttgtggccgccctctgatgagctgagccgtgaagaaaacgccagagtcgtttttaggcgaaggcgaacgacagtgagcaaatatgaagcgctgaaagctggtccttaattgcgttcgaggtggccgccgttaggcagtcgggggagagacctgcggcggcagccgcgggatacagaatcggccgaaggccatgccgttctttcggtggcttcgccgcggtctctcccccagtcagccttcggctgacagcccccctcgtcagaggggggcttggttgccgtagcagctcaggcgcgacgcttgcgccagagggttagggagatgccggcgatggcgagtgctaccacggcaccacccaggccgagcacggccgtaccggtattgctcagcgcgctgccgggcttgttgacgttggtcttgtcgccggtggtcggggtagtcggcttattgccgtcgcccttatctccgtcaccttcgcccggattggtcggagccttctgcagggcttcgattgcggtcttaaggtcggctgcggcggtatcgacctcgccctgattctcagcggcgagcgcggccttggcagtcttcagcgcggcggcaagcttggcccaggaatcggccgtgtagtcggattccttgagcgcttcggcggcggcgatctgcttgttgagctcagccaaatcgaccttgccctgttcaatgccgtcaaccgtagtatcggatggattgaccaaaccatcggtgtagccgtcgtaagcaaccgcaacagtgccagagacgctggccgggagggtcacagtggccttgccttcggcgtcgagcttcacggtcttggaccagtcgccagcagagaacttcaccgaaccggcgagcgtgcccttatcggcggcggtcaccgtggcggtgagctcgcgggtgccggcgttgtacacggccttggtggtggagtcaacagcctcgatgtgcgtcgggttggcagcggtccaggacttcgtcaccttgagcacagactcaggcacgttcacgaacgcaccgtgacgcaccttgtccggcagaccgccgttagcaccctgagtgatgtagccctgagcgcccggctcggctttgaccggcttcttttcgttgttgaagtccgggtaacgcttggtcatcgggttgtcccacgtggtcttggaaagctcggcacccgtggtcataaatgcacggtaggcgaagttgtcggacagcagaatgtagccgtcgtcgtccttcgtgttgagttcgtcatccttgttgagcttgatggtctctggtccttcgaacggcagcaacgcctgctcgagcagctgccaaccggtgttcgggtcctggcccggagatgcctcggtggtcggtgcagtcagcaccttggaacgctcaaggaagatgctcttaccagtggtgatgtaatcgccagcggcaccgccctgctcattcttggtgaatcggtagtagtagccaccgatcttacgcacggtggaatcaatgcgcgagtagccggtgtcctgccacatctgcggctcggtgaagttcacgaagtcgcgggtgatggcgtaacgcacctgagcataggagctattgccggttttgtcgttcttgaccggagtggtacgggtgtcatcagtgaacatgcgggaagagaagaacaccacgtaagcgttcaggtcatcatcccagtaagcttccggcgcccaggtcataccggcgttcggcgtgttgatggtgatgccgccgttgccgtcgccgttggtacgggtccagttcatcatatcggtggactcgtagacctcaactttccgagaaccgttaacctggttctggctccagcccattgacgagaccttgagatcagtggcaatcaggtagtacttgtcgccttcgtgggaacgcagcacgaacatgtcacgcaagccacccgtgtctgcatcattggtaagtaccgcctggccattgttgcgagtcttaaacgtgaagaaatcgttcttctcagtggaagccacccaggccttttctccaccgttgctgtcgctctcaaaagtgacggccgcatagccggtgtcaggcgcgatgcgggtcttctccttgacagtgacctcgatggtcttggtgaccttctcaccgccgttgtaggaagcggtggcggtcagcgtaaccggcttggaatcaccgtcgccgtaggccggacgattgatgatgccagcaccacgatacgggtcatcggcaccagtggtcttgttttcgtacttctcgttagtggacgtaatgagcttctcgtccgaggacttccacgtaatcgccgagccgttcttggtgcccttggcgactagcggcagattctcggccgccggaactttcagcgcagcaatcgcggcatcgaggtcggctgcggcggcgttctgggcgttcatcggctcaacggtgacgggcagttcggccttcacaccacccagctcagtggtggcggtgatggtggcagtaccagccttgacgccggttacagtaccgtctgcggcgaccttggccacggactcatcggaggaggaccaggtgacgttcttgctcacagcgtcgtccggggtgacggtggcggtgagcttggtggagtccttctcaatcagggtgagcttgttgttcaccacaccggtgccggaaatcgcaacggcggtcggcatggtcaggtcagcgcccctgtagaccttgatgtcatccattgcaccattccagtactcatcgacggagtagaacgacttgccgatgtaggcggtggtcgcgccgagatcgctcatcttgatgccggtgttggccttgaaaataatcagggcattgttgcggaacacggcaaggttggtgccgtccacgacaatcttgtaatcggcccagctgttgtcgttgccggaaacggtgaccttggatccctgttcgttaccccagttgttgttggagataacgcccttgatggcggtcttgctgttgtagaacatcaggtacttgttggcgttggcctgatcggtggtgttggcgtcgttcgagccgtccttgccgacgatgaacgagaagaacttgccgctgtcgtcgtgacgagtcttggacgcgaactccagagtgaaggagtcgcccgcatccttgaacagctggtcatcgatctgggcgtactggccatcgccgcgcagtgagagcgcctcgttgttgctgcggtcaccgtactgttcgatcttggcgccgtccttcagcgtcagcttgtacttgccggtcgaatcggcaatcgcgctgttcgtggtgccgtttttgcccgtgaagtcccagctggcgagcagcgtcggttcagcagccttagtagtctgcactgtcgcggtatcggttgtctgtggttgggaatcttccgattccatggcatacgtcgtcggaactactgccaccatcgttgatattgcaatcaacgatgctgccatcttcttccaatgcttcaccgcatctctccttgtcctttgcctcgacccacttgtcgagtgtctcgttcgcctctacatgaacgcaaacattatttgcgatgataccattacggcactgagactcagtgtgccagattccttatgtatataagcacttacggggggcaaccgcccagcccgaacactccccgtatgccaaaagcccccttccaagccaatcactaatacccctcaatcggcaccccgctccgccagccgccccaaactgttattaatttgttatctttaccgcgcttgcgtggacagagagcgctcagacctcgaagatcgccgcatattcgtgagaacccgcctagtcaatgagatatggcttgaagacacgctcggcgacggggatatggagcatcagcatggtgccgtaaccaaggatcaccagcaggaacagtccaccgggcatgtggaaccagctggccgccagcagtgccacgaacacggcatccacgatgaccagggccacggtcatcgcgatgtgggagatgccgaagatgaaggcgttcttcaaggtgccggccacggtgttctcgaagcgtgcctgaagcgcgaacacccattcgaaaccgataagccagaggatggtcagcgcgaatttgatgatgagcagcggcgtgatctgcaggacgatccatgaccagaccagtgcaatcagcgccaccaagaacggcagccacagcagtgtggctttgatgaagttggttttgaatgacttgaagtagttggaggttacgcctttgccctcgccctcgatggagcggcggcaagcatcatggccggcagtcagggccgcaccgatggtgatgatcggaatcgaagtgaccagcatcagaatgttgatccatacgccgtcaacaagattgctccacgcgcgcatgaatttcgagtccggtgccagccagttcatcaactactccttgtacagcttttggctcccctcagggaggggagccaaattgtcgggctcaacccttgaccgctccgccttcggccctgcaattacggactcgcctacgacgaggctcatcattagcttcgccgctgtcgcggctcagcctggagcctgctggaagcccactgggcttccagccatgggctgacgacgcgagtcgtcagcccttgacggctcccgccatgacaccagagactatatacttctggcataccaagtagaagacgatgatggggatgatggccagcaccaggcaggccatcatggcgcccatatccacggaaccgtagccgcccttgaggtattgcacggcgaccgagacggtcttgtacttgccgaggtcgagcgtcaggtacggcagcaggtagtcgttccagatccacatggcttcgaggatggccaccgagacgatcgacggcttcataatcggcaccacgatctggaagaagatgcgcggcactgacgcgccgtcgatcatggcggactcctcaagctcctgcgggatgcccttgatcacgccagtgaagatgaacacggccagaccggcaccgaaaccgaggtacacgatgcacaggccccacggggtattgagcttcagcatgtcggcgatcttggagagggtgaacatcaccatctggaacggcacgatcatattgaacaggaacagggtgtagagcagcttcgcggcccagttgttcacgcgcacgatccaccatgcgcacatcgaggtgcacaccagaatcagcgccaccgagccgacggtgataagcagcgtccagccgaaggaagcgaagaactgcgtggtctcgatgccgcgcacatagttctcaagtcctacaaacgctttgccggcaggcagggagaacgcgttcttggagatgtacgccttctgcttgaaggagttgatcagcaccaggacgatcgggaaaatccagaacagggagacaacggcaaacagcacggtccataatgcgccatgcttcacaggcttgttctcgttcatcaggctgccacctccttgctcgtggtgagcttgttctgaatcagggcgatgaccgcgaccaggatgaagaacagcacggccttcgcctggccgacgccttcccagcccatacggccgtagaaggtgcgggtgatgttcagcgccagaccttcagacatgttgctcggcgcaccgttggtcaatgcgaggttctgatcgtagagcttgaaaccgttggtcacggtcaggaaggagcacacggtgatggacggcatcatcagcgggatgatgatgcggaacatggtctgccgtccgttggcgccgtccacggccgcggcctccagcacatcggtgggcagggcttgcaggccggcgatgtagatgatcatcatgtagccgatctgctgccagcacaccaggatgaccaagccccagaacccgtaggacgccttataggtcagggcgcggccccagtgggctagtacgccgttcaggagcagcagccagatgtagcccaggatgatgccgccgataaggttcggcatgaagaataccgagcggaacagcgtggagcccttgatcgccttggtcagcatgtaggcgatggcgaaggcgatcacgttgatcacgatggtggtcacgatggtgaacgcggtggagaagccgagcgcgtgcaggaattccttgtctttcaacgctttgccatagttcttaagccccacccattcaccgtcggtaacggtggtgaattcgcagaagcttaagtagacgcccatgatgaagggcaccaggaacccgatgatgaatgcggcgaatgtggggagcgcgaacagcgcccaccatctgcgtatcgccttgccagccatgctgatcatgacttttcctcctccttgagtccgctgcgttgtgacactgcatcgtgcgccggctgcggagttcaactcaatgcgagcttgccgatcgagaaccgcatgcacggcctgttctcgttcaagcctatgttcatagtaaacgtcgaatcattatatgtcaaacgttgtcattttaggcgtttcaagttcgagcacactccggctccagcaatcttctttcacctaagataatggctatataaagccaatctaacgccgacatagacactttgcaaacgtttgtaatacaatcgttgtcatcgccgcagatcaatcaatcagcatgtacactggagtcagttgtgcatgtgtattgcgattttccattcaacgcaagggggccgcaatggctacgagcattcaggatgtcgcccgcgaggccggcgtctccatctccaccgtctcacgttccttcaccaggccggatctggtgtcggccaagacccgcgagcgcgtgctcgccatcgccgacaaactcaatttctcactctcccgctcggctgcggccctgaaatccggccgctccctgcgcatcgcagtactgatgagcggccatatccgcctgtggttcaccgcctcggtcatcgaggggctcaacgaggtgctgcacacgcagggctacgatatttcggtattccagatttccagcatcgaggagcgcaaggaattcttcgagatgttgccggtacgccgtaacgccgatgccgtgattgtggcgtctttcgatatcgacaacaacgaaatcgcgcaactggcttcggtcggcgtgccgatcgtcggcatcaattcagtcgaacccgaagcccgcggctttaccgccgccgtcaatatcgacgatgtgcagggctccacgctggccgcccgccatcttatcaatctcggacatcgccgcatcacctacatcagcaccaatcgcgaggtgtcgctgagcttctccgtgcaaagccgattcgactcattcaccgcctgctgccgcagggaaggcatcgagccgcaggttatcgtctgcaaggtcgatgacgatggacgttatgaaatcagcgacgtggtcaaccaactcataagccaagacgagatgcccaccgccatcgcatgccaagaggatggcattgctttgccgcttatgttccagctggagcgcaatggattctccgtgcccggcgacgtctcgttgatcggctacgacgatagtttctacaccggcgatatcggcctgaccaccatccgccaggatccggtggaaatggcccgcgtggcagcccgcatgacgctcgatctcattgacgaaaagccgattgagcaaccctacatcgtgttcccggcccagctgaaggtccgctcctccacctcccgcgttaagtaggctcacacaacaaagcccaccatagaaaaagtgtgaggcaaccgcacaataacgctcaatcgcacattgtggagaatggcgaaaaatcgccgattcatggccccacagcgtgcgattgagcgggtgcgtgcctcacacttttctgcggcggacgattttgtgcgagactcagcaatacaaagcggcgcccccggagaaggaaatggcaggggcgccgcggattgttgcttatcggctatgggactctatgagactcagtgcgaagcctcgtattcggaagcccaaccgtccacgaaggcggtcttgacggcatcccacttgccggtgccctgcgcgtactcgagcagtgcctggccgaccttgttcttccactcttcggacggcatcatggtgaagttccaagaaacctgggtcttgccggacttctgatcctcaacagcggcttcagtcagcgggttgtcaaacttgacatcatcgaaggtcttgaacggggtggtgaagcccatgtcctgagagatggccttcttgccggtgtcggaggtgatcacccaagacaggaagtcctcggtggccttcttgtcggcgtcggaggccttgtcgttgatgcaccagtagttctcggaaccagtggccaagccctgcttctcttcacccttgacaccggtgtagattggcatcatgcccacggattcggccttcatgccggccttctgcaggtcggtccaggcccaggtaccgttctggtagaaggcggcctcgccgagcgcgaactcggagttcgcatcatctccggtcttggcgctcagctgggtggggtcggtggtggagtcggcgatgtacaggtcgaagatcttcttgtagttcggcaggtaggtgcccttgatcttggccggctgctcggtgacgttgtcatccttgaactcgtagtaaagcggcagattggccaggtgggtcttgaagcgccagtcggagctggagtcgaagccggcggaggtgaacgcgcccttgatgccgagctcgtccttgcgggcctgcatgtcgtcggccacggccttcagggtgtcgaagttgtcgatttcgtccatggacgtggccttggcgccatccagcgcgaagtacttgttgaggatgtccttgttgtagatcaggccgtaggtttccatcacgtacggcacgccgaccaccttgtcgccatccttcagggccacatcctggttggcgagctccttgtacacatccgtattggacatatcggcggtgtacttcttccagttctggtagccgaccgggccgttgacctggaacaaggtcggggcttcggttttggcgatttcggacttcagggtctgctcgtaggtaccggaggccgcggtctgcaccttgacctcaacgcccttctccttggtgtactccttggccagagcggcccactgatcagccgcttccggcttgaagttcaggtagtagaccttgcccttggagtcgtcgccggaagtggagcttccacaagcggcaagggttccgagggacattgcagcgatggccgccactgcgactgctgacttgactgtacgattcatcatcgaacctttctctttcatcgtcgacccggccgtccccggtcaggacaggtacgctagcacgcacctttacgactatcgacatgcactattgtgcaacggtttgcttctttttgcaaacgatagcaatatcagcgcgtcataaatcatcattttcaggccattgtcaacaaatatcccattaattcagtcatttttgcctcattatcgcaatgcaagcgttcgcaatcatgagagcgctaacatatctttcatggcaatcgattgccacttatacccatcaaaaaaaacaacacgccgacgctatcgtttgcaaatcatttatcgacataccgcaattcccaccacaaacaataaaggcccgcccgcagcagcaggcaggccagcgtaatcacagcgcaaccggggctaggcgttccaccgttcgatgacgttatctcccttatagacgctgagcaccgagtagtgcgccgtatccaaacgcagcaaccgcgcgaaatgcgggtccacgcccagccattgcgaggtgaggatgcgcaggatgtgcgcatgagccaccaacagcacattatggccgtctttcagcagcggcgtaatctcatcgatggcgctcttggcgcgtaccgctgcttcttccagcgtctcgccaggcccggcatggaccagcacctgctcgcccgaaggtaaggtctcgacccaatcgccctccagcgtgggcgtcagcgagcgcggcccgtcacgccacacatcccattcaaaaccgctggcctcactcacctgctggcgcgtacgcccctcggctcggccgtaatcccattcagcgatgccgtccaacacaccgtggtccgcaaaaccggccagttcagcggtttggcacgcccgcttcagcggactggaaaacacacagccctggctgaatccttcggggaaagcttcgcgcaggcgccttccggcatccgctgcctgctgctcgccgaccgcggtcaacgggatgttcgtgcgcccggtatgctgcccggattcgctccacacggtctggccgtggcgcagcaacaccaaaaatccgttgccgccacgagagttctcgacggcaacggtgccgttcacgttctgttcgctcatgcctccactctagtctgcgctcgttcatgactccaccattaacgcccatcttttgcgctgagatgattgagatgctattagactgagagtcatgagcgacgaaacgaacaccgacttcccctccagcgccgaccgtgcggtcgacagcctgcaccgcatcgacgagaaggtcaacaggctgcgcgaggaccggctcaacgaccctgattctctgggcgacaagctcatcaagtcggcagtcccagcgctggcaggcttggttgccggcaaagcattccagatgatatgggacaagggcacaagcaaacgcaatctgcgcaagggactggcggcagacgcgccgcaaggtctggcaatgagtctggcattcgccgccgtttcggccgcactcggcgcagtggtttcgcagctgtcggatcggggctccaaggcgttcgtcgaccaccgccatcgcaagcccagccgctaatcccccggttggatgatggtttctgttggctgactgatgactcatcgctggaatttcgtcaaggaaccatcagtcaatcgacaggaaccatcagtccagcacagttccgccacacaatatcggcatttcactgtgaggtaatccaccgtgacgtccggcgtctgccgtgcgacaataaagccatggttaccaacgcaacaatcgaggctcttctgggccgccgctccatccgtaagttcaaggacgaggccatcgacgacgatacccgcgccacgctcgaaaccgtcgcccaacatgccgcgtccagccagttccttaacgactggtccgccatccgtatcaccgacccgaccaccaaagccaagctcgccgaattcggccatcagccgtatatcgccaccgcgccgttgctgtacgtgttcgtcatcgacgagcaccgcaacgcacgcatcgccgaacgcaagggtatcgatcccgcttccgacgaattccatctcaagtacagctatcgcttcacccaagctcagaacgacgcagtgctggccctgcacgccatggagaccgccgcctattcgctgggactgggctgcgtgattctcggctctctgctcaacaacatccccggccttatcgacgtgctgaatctgccggaatacacgtatccggtgctgggtctggccatcggcaagcccgatcagaacccgaccgtcaagccgcgcatgccgcgcacgatgcagttcttcgagaacacctacccggctgacgccgatggcgtactcgaccagctgcccgccttcgacgaggaagttcaccggtactacgatctgcgccaagccgaccgtccggtggacgctttcagcgatcaggtcgccacgatcagtcggcaggatgtcagccatcagacactgctcgacaaggccgccgctcagggcttccgtctggatcagtgagaccagaaccaacgagatagcctcggataggctcgtcactgagtcgtctcggtctcagcactgcgacgactcagttccaacacctcaacatttcatcaccggataccggcaaaattgcacaaccatcccgccggtgtcgcaccatcaacaaacgttcacatatcagtcccattatgcggacaaccaacggccagttttgcaagaaaacccgccaaaccagcagtattcgcaccagtggtgggaatagactgcatgtggccgcaatgattacgaaccggaaaagagggactggatgcggacggtttggcaagtctttctacgcgattgcagacgtatcttacgcaatcccgttgccgttgtggtgacgctcggcgtagcaatgctgccctcgctgtacgcatggttcaacattctcgccaactgggatccctattcagccaccggcaatctgcaagtggccgtagccaatgaagaccaaggcaccaccaacgatctggtcggccatctcgatgcgggccggcaggtcgtcaagaaactcaagcagaacgacgaactcggctggcgcttcgtagacaatgaggaacaggccgtccacggcgtggagaccggcggatactatgcagccatcgtgctgcccaaggatttcagcaccagcctggtcgaatcggtgaccggaacctccaaacagccaaaaatcaagtattacgtcaacgagaagaagaacgcgatcgcgccgaaaatcaccgacaccggtgccaccaccatcgacgagcagatcaactccgccttcgtcaccacggtagccaccaccgttgcctcggccgtttccgaagcgggaggcgatctcgaccaagccaccggcaaagtccagcacgatacgatcaatgatctcaatacggtgatgtccacgctgaacaccgttcaggattcactcaccgacttacaggacacgctggcccaatcagacacgattctcgccgacgccaaacagaccaccgcctcactcaagcagaccgtcgcggccgcgcagaaggcctcccgccagtccggcacactgttgacggaaacacaggccgggtcacaagccttctccaccacactggtcggcgcactcgacaccagttcagcacaactctccggactggccgttcacgtcaacaacgccgccggcagcatcaccggctccttcaacagcgcgcagaactccgtcgacaccatcaccaacacactttcggccccactgaatgccacccaaacgtcaatcagcgatctgaaagacgcgctgaccaaagccggcatcggcaaagacaccaccgacccagtcggccagaacatctggaaacaaatcgatgcgctcgactcattgatcagcaaacagcagacacagctcaacaccttccataccgacaccacacagttcatcaactccggtaaagacgccaccacgaatctttccggagccatgaccaacaccaccaccggcggcatcgcggcgctgaataccgcgcgcggctcgctgaccggcaccgtaatgccgtcgctcacctcatcattgaacagtttcgccgccctgaatggcacactggatggcacgttgacttcgttatccggcaccttggatcaggccgacggactgttcgaccagcttgtcgataccctgaaccaaacaaaaaccaccatcagcagcacgcaggattcgctgcgccaggtggccagcgatgtcgccaccgtacgcaccgatatcgccacgctcgatagttccgccgcttaccagaaaatccgggatacgctgcatctggatgacaagggattcggcgacttcatgggcaatcccgtcaccctgaccacgaaagtcgtgtatgccaccgacaattacgggtccgcagtcaccccgttctacacgaatctggcactgtgggtaggcggtttcgtgctaatcgccatctacaagcttgaggtcgaccgcgagggcattcgccgtatcaccgctacgcaagcatatcttggccgctggctgctgctggtcaccatcggattcctgcaagccatcatcgccaccatcggcgatctggtgctcggcatccaatgcgagcatccgctgctgttcatcttggccggaatcttctgttcgttcgtctacatcaacattatttacgcgctggccgtggcgttccgccatatcggcaaagccatcgccgtaattctggtcattgtgcagatacccggtgcctccggcctgtatccgattgaaatgatgccgaacttcttccgcgaactgcacccatggctgccctttacctacggcatcaacgcgatgcgcggcccgatcgccggcctgtacgcgaaccattactggctcgacatgctgcacctgttctggtatctgccggcggcgcttttcgtgggacttgtcgtacgccggtatgcgatgaacctgaacgcgctgttcgaccatcgtttgggaggtaccgacctgatgatcaccgagcacaacagcatggtgaacgaacaggtgagcttgaactccgtattccgcacggtgtccgacagcaaggaactgcgcgatatcatcgcccatcgcgcgcaccggttcttcgcgcggtacccaaagatgatcgttgccggtctgacattgctgaccgtactcccgttcgtattcctggtgctgctgttcgtcacccaagagaaaatcgccatgctgacctcctggattctgtcgattattcttatcgacgcctatctcattgtggttgaatacgcacgcgaaacctacgccatgcagcttggcgtcagtgccatgagtgccgacgagttccgcaatgtgatgctcaacggatatgcgtggcggcgtttccacggccacggacgtcacgaagcggcgatgggcagcaatccggatatcggcgaaaccactgaacgactcacaccgttcagtgatcaggccgccgagccgactgcgcacaccgcacagttcgagcagtccggtcagtctgggcagtctgggcaaggaggcgcacgatgaagcttatctggaaaatattcgtacgtgacgtgcgccaagccacccgcaatgtgatcgccgtaatcgtggctatgggattggtgattgtgccggcactgtacgcctggtacaacatcgccgccagctgggacccgtacggcaacaccaaggccttgaaggtcgccgtggcaaacgtggataagggctataagtccgatctgatgccgatcaccatcaacgtcggcgaaaccgtgaccaatacgctcagggccaatcatgaccttgactggcagtttgtggatcgtgctaaggccatcgatggcgtgaactcaggcgaatactatgccgcgctgattattccaaagagcttcagctccgatatgatgacgctgttttcaccgaagatcaagcacgccaagctcgaatactatctcaatgagaaaatcaatccgatcgctccgcatatcaccgaccagggtgctaccaccgtggccacgaccatcgaccagacatttgtgaagaccttggcgagcgtggcgctggatttggtttccaacgtggccgattacgcgcaaagcccgcaaatggagcagtacgtcaacaacgcctccagtcatattgccaccatgtcgtctcgtttgaccggcactgcgtcgcagatggattcctatgccaatctgctcggggccgccaacagcatcattgattccaccgataagctgctgggatcaacaggctcagctgcggccacaaccaaaaaggcgttgaaacagacccgcaacggcgtctccagcctcgacaaggcattgtccggagccaccgatggcgtcggtacggcattgcagcaggccggttcatcctacgacaccattgccaagcaaatcgatgccgcttttgccgatgtgggctcacaatcctcacagatatcaaacaagctaaccgatatgcaatccaaagtggaggctcaggccgacagctttggaaagtatgccgccgctttacgagatctcgccaaacaagcggcttcactgcccgtgggcggagataccgttgccgctcaactgaacgcggctgcagaccaagccacaaaggcgcagcagagcatgcagcaagccgccaccgcgttgggcgatgcggccacgcacatagcaaacggtactgccgatgccgatacagcgcgtcgagatctgaaatcacaaatcgctgccgccaaacaatcgattactcaggcttcagacacgtacaagagcacgctgaaaccgcaactgaacaatctgacctcgtccatggacgaagtgaccacgcaggcaagttccgtaatcgacgggcttgcatcgaccgtaagcagcgtgtcaggtctttctggcggcgtttcagacagcctgacggacatccagtcggccttgactgacgcagctagcgctttgacccgttcggcgaagaaactcgacaacttgtcttcccaactcgcctctatcaccaatggcggcaccatcgacctgtctgtgatttcctctgcgaagcccgatgccattgcttccatgctggcggcacccgtagcggtcgaccgcatcgcgctctatcccgttgccaactatggttccgcgatggctccgttctacacgattttgtctatttgggtcggtgcgatcattctggtcgccatgttgaaagtatcgatttccgaccatgagaaggctcgtatcttagggttgggcaatgatctgccgctcggttcggaagtgggtcttcgcgaggccatgattgccgggcggattgccggaccggccgccgcgttggatgtgctgaagaagccgcgtgccgaggctcccggcaatgcgcggcagttcggtttacgcttgcaccacgaatatttcggccgatacatgattttcggtttccttgctttgctgcaaggtacgctggtgtgcctgggcgatatgttctatctcggcgtgcagtgtgagcatccgattcagttcttgatggtcgggtggttgtctgcactggtgttctcgaatattgtgtatacgctgaccctgtcgttcggtgatatcggcaaagccattgccgtagtactgctggttatgcaggtagccggttccggcggcacattccccattgaaacactgccgacgttcttccaggtcgtttctaaatggctactgttcccctatgcggtggatgcgatgcattcggccatggcaggctcattcggcatggaatactgggtttccatgggcaaactggcactgttccttgtcccctcattgctgttgggacttatgttgcgcaagccggtaattcgcttcaacgattgggttatccgcaaccttgaaaacaccaaggtgatgtaagtgttggacgaagtgtgtccgagcgccctgaacgcttagcagcctacgacctgacgtgtttggaccgtaacctgtctcagacacggcgttggcgaggcctgtggagcttctgacgctaacgtctacgtggcttgtagccctttttacgactgtgtggcttgagttgctggttcagcggtacatgccggtaactggattgcggatcgcgatgcgtgagatgccagcatccgcaaaattcgcaacggtacacccatagctcaactccgcgctcgattaggctttgatcagcggcacgctgaacctgcgccttatcgtgatacatgattttattcgacgtagcgcaacgtttaggggtgaagtaatgcatagcagaagccagtgtagagcgaccccataaccaagccagtttctggctcccctcagggggggggagccgtccgcacagcagaccagggggaggaggcccgggcgtcgggattccacggtcacggacgtgctgttttccggatttcctgcggaaatgggaacgcgccgcgccgtctctcttcggccccgacggcggggccggccgggaatggtcccggacgtgggtctcatgagtgcgagaagccccgggtgtttttgtgggggtgtgtgggtttgggtcgtgagtgtttcgggtatgcgaaagccccttggggcgtgtgctccaaggggcttcctgtacgtgtgatgcggcggcgtgctactctcccacaccctgtcgggtgcagtaccatcgccgtgccaggccttagcttccgggttcggaatgggaccgggcgtctcacctgggccatggccgccgcaaatcttctcttgtacggtcagacgctggggtctgccggcctgtggcggcctgggaaccggacagcggacgcggatatgtcgatgtttcgtcttgtggccagacaatgctcattgccgtctggtgtcgtttgcaggaggaagatgcggtccaaccgccaggggttggaatgttagtgttgcctttcgtccgttagtaccggtcggctccacccctcgcggggcttccacgtccggcctatcgaccacgtgttctgcatggggactacaggaactcgaaggttccacggaatgcttatcttggagcaggcttcccgcttagatgctttcagcggttatcccttccgaacgtagccaaccggccgtgccactggcgtgacaaccggcataccagaggttcgtccacccaggtcctctcgtactatgggcaggcctcctcagcattccaacgagcgcagaggatagagaccaaactgtctcacgacgttctgaacccagctcgcgtgccgctttaatcggcgaacagccgaacccttgggacctgctccagccccaggatgcgacgagccgacatcgaggtgccaaaccatcccgtcgatatggactcttgggaatgatcagcctgttatccccggggtaccttttatccgttgagcgatgccgcgtccgtacaccggcaccggatcactagtcccgactttcgtccctgctcggaccgtcgtcctcgcagtcaagcccgcttgtgcacttgcactcgccacccgattgccaaccgggctgagcggacctttgggcgcctccgttactctttgggaggcaaccgccccagttaaactacccgccaggcactgtccctgaacaggatgactgttcgaggttagacatccaatgcgaacagagcggtatttcaccttacggctccgcgcgatctggcgaccgcgcctctcggcctcccgcctatgctacacaatccacaccgaatgccaataccaaggtatagtaaaggtcccggggtcttttcgtccttctgcgcttaacgagcatctttactcgtactgcaatttcgccgagctcctggtcgagacagtggggaagtcgttacgccattcgtgcaggtcggaacttacccgacaaggaatttcgctaccttaggatggttatagttaccaccgccgtttaccggggcttgaattcaccgcttcacccgaaggctgacggatcctcttaaccttccggcaccgggcaggcgtcagtgcatatacagcggcttgcgccttcgcatgcacctgtgtttttggtaaacagtcgctaccccctggtctgtgccacccccaaaagctcccacagcaagtgtgttcaccatcgggggtctcccttaaaccgaaggaacgggagtgatttgccgagttccttgaccaggattcgctcgatcgctttggtattctctacctgaccaccagtgtcggtttggggtacgggcggctttgagcctgacgccgaagcttttctcggcagccgggatcaccggatatcgggccataaggcccccatcatcgcacctcggacccatgcgggacggatttgcctgtcccacgccctgcgtgcttgaccacggaagaccacctccgcggccggctacccttctgcgtcactcctgcgctgacctactacaaggatcggtcccaacaggccagggcatcccgcccccgaaggagcagtaagcccggacccggaggttagtactccaagcctcggttttggcggctgaaagccggtacgggaatatcgacccgttcatccattcgactacgcctgtcggcctcgccttaggacccgactcacccagggacgatgaacgtggccctggaacccttggtcatccagcggacgggatcttcacccgtctctcgctactcatgtctgcattctcactcccatgaagtccacggcgcgttcacacggccgcttcgcccctcatgggacgctctcctacccagtacaaaatactgccgcgtcttcggtggtgtgcttgagccccgctacattgtcggcgcggaaccactagaccagtgagctgttacgcactctttcaagggtggctgcttctgagccaacctcctggctgtctatgcgactccacatcctttcccacttagcacacgcttcgggaccttagacgacggtctgggctgtttccctttcgacgacgaagcttatcccccgccgactcactgccgggatacgcgtcaccggtattcggagtttggttgctgttggtacccgatacgggcccgcaagcatccagtagctctacccccgggacgtaatgacccgacgctgcacccaaatgcatttcggagagaaccagctatcacggaatttgattggcctttcacccctagccccaagtcatccccccggttttcaacccaggtgggttcggtcctccacgcggtcttacccgcgcttcaacctgctcagggctagatcatcccgcttcgggtccaggacacgcgactcaaacgccttttaagactcgccttcgctacgcataccccacacgggttatgctcgccacatgccactgactcgcagactcatttttcgataggcacgccgtcaccccacaaaagggctccgacggattgtaggcgcacggtttcagagactgtttcactcccctcccggggtacttttcacctttccctcacggtactcgttcgctatcggtcagacaggaatattcaggcttacccaacggtctgggcggattcgcacggggttccacgggacccgtgctacttgggagacgcgatcggcagaccatgcgcgttcaggtacggggccctcaccctctgcggcccggtattcaacccggttcccctgacacatggttttctgcaactgccggccggcccgtcggagccggcgcacgcgatcccgcaacaccccgcgcgcaacccccgacgggtatcacacgcgcaaggtttggccatcatccgctttcgctcgccactactcacggaatatcctttcctgcaggtactgagatgtttcacttccctgcgtaccccccggccgaagccggtaccgacccatgacggtcggtgggttcccccattcggaaatcctcggatcaaagccctgttggcggctccccgaggcatatcgcagcctcaaacgtccttcatcggtcctgtctgccaaggcatccaccatacgcccttgcaagcaacacacaccacgaaagtgcatggccgcaagattcctctagcaaattcccagacgacaaatcatcacactaaaaatgatcacaaaacgatcgaaacgaacaatagagttcgattcgaaatcaacagcaaaacaaagattcaaaaacccttgttttgctcgcgtccactatccagttctcaagccaccacgcaccgccacgccatcgcgccggcacacggccggcccccaggcacgacgggcatcgaatcgcgccaggcaaaaagcctggggtggcgatccgggagcccaaaagcgcatccataccaccccggcacccaccgcacgaccggcagggcaaagccaacgacgtcttccacaccagcaaccccgccgccatcgcaccatgcgacgcgcggggcgcacaccgtcggacgaacatccgactgaattctccgtagaaaggaggtgatccagccgcaccttccggtacggctaccttgttacgacttagtcccaatcacgagcctcaccttagacggctccatcccacaaggggttaggccaccggcttcgggtgctgcccactttcatgacttgacgggcggtgtgtacaaggcccgggaacgcattcaccgcgacgttgctgattcgcgattactagcgactccgccttcacgcagtcgagttgcagactgcgatccgaactgagaccggttttcagggatccgctccgcgtcgccgcgtcgcatcccgttgtaccggccattgtagcatgcgtgaagccctggacgtaaggggcatgatgatctgacgtcatccccaccttcctccgagttaaccccggcggtcccccgtgagttcccggcataatccgctggcaacacgaggcgagggttgcgctcgttgcgggacttaacccaacatctcacgacacgagctgacgacgaccatgcaccacctgtgaacccgccccgaagggaagccgtatctctacgaccgtcgggaacatgtcaagcccaggtaaggttcttcgcgttgcatcgaattaatccgcatgctccgccgcttgtgcgggcccccgtcaatttctttgagttttagccttgcggccgtactccccaggcgggatgcttaacgcgttagctccgacacggaacccgtggaacgggccccacatccagcatccaccgtttacggcgtggactaccagggtatctaatcctgttcgctccccacgctttcgctcctcagcgtcagtaacggcccagagacctgccttcgccattggtgttcttcccgatatctacacattccaccgttacaccgggaattccagtctcccctaccgcactcaagcccgcccgtacccggcgcggatccaccgttaagcgatggactttcacaccggacgcgacgaaccgcctacgagccctttacgcccaataattccggataacgcttgcaccctacgtattaccgcggctgctggcacgtagttagccggtgcttattcaacgggtaaactcactctcgcttgctccccgataaaagaggtttacaacccgaaggcctccatccctcacgcggcgtcgctgcatcaggcttgcgcccattgtgcaatattccccactgctgcctcccgtaggagtctgggccgtatctcagtcccaatgtggccggtcgccctctcaggccggctacccgtcgaagccacggtgggccgttaccccgccgtcaagctgataggacgcgaccccatcccataccgcgaaagctttcccagaagaccatgcgatcaactggagcatccggcattaccacccgtttccaggagctattccggtgtatggggcaggtcggtcacgcattactcacccgttcgccactctcaccaccaagcaaagcctgatggatcccgttcgacttgcatgtgttaagcacgccgccagcgttcatcctgagccagaatcgaaccctccacaaaaaaacttcatgaaaagcatccgaatagatgactctcaaaacaaaaattgacgagcacgtccttaaggaaggacgccctcaaaaaacctcacccctcatcaaaccctcccgggtacccgaccaccacgacaggcaatcaggcgaggaatgaactggcaatcattgactataaagaagtagtacaaacacgctcttgagttctcaaaccaccaccacaccagccagacgggaaaccaaccagaggaaggaacccgccgcgctgagcggcaacaggtgaataacttacacgcatgtccggattcacgcaaatcaaggcgcacaaaaacccaggaatcggcataacagcgcggttccctcggcgtgtcgcacagagcccactttgctctgatgaggctaggttaacccctcaaatgtttctgaaaagcatcaaatccactattcggctggcgtgtcgcgagagttttcagcttgtcggccctgcgttcatctctcggcaaccacactgccggcgcacaatcggcgcatgacagcgctccgtcatcggatttcgttcatgaatcgcgggtatacctgtagttatgaccaagaagattgctgtattaaccggggcgggcatttccacgtccgccggcatccctgatttccgcggtccggacggtgtgtggaccaagcatcctgaccaaatgagcgtttacgacatcgatctgttcctgcgcaacaaagaggaccgcgagtactcctggcgctggcaaaaggaatcgccagtatggaatgcgcagcccggcactgcgcataaggcgctggtcaagctggaacaagccggcatgctgacgctgctggccacgcagaacttcgatgcgctgcatgagaaggccggcaacagcgacaacgtcatcgtgaacctgcacggcactatcggcacctcgcattgcatgaagtgccatcaggaatatgccacggcggacatcatggcccgtttggatgaagagcccgacccacattgccatcgcaaactgaagtatcgtggcgatatgccgtgcaatggcattatcaaaaccgatgtggtgtatttcggtgaggcgttgccggacggcgcgatggagaagtcgtacagtctggccaccaaagccgacgaactatgggtaatcggatcgacccttgaggtgtacccggcggcgagcattgtgccggtggccgcgcaggcgggcgtgcccatcaccattatgaatatgggtcacacgcaatatgaccatcttgcgagccgcttgattcatgaggatatcgccgttgccctgccgaagttggtggacgagacgattgcggagaacaagtagccctcagcataacgaaagcgccggtgggtgggttaagcaactgatgattgtcggttaaccacccaccggcgcttttgcgccacctcccgccagcgggaggtattggagcacacttctgcgcggcttcccgccagcggtattggaatcagtagatgcgcttgggctggaatccggcttccctgagtgccgcgaggatgcggtcgatgtgctcggggccgttggtctcgaccgtgacgccgagagacaccgcgttggtgtagtggccggatgccttgaactggtcgtgatcaagctgaatgacgttggcgcgctgctcggcaagcagggtggccaccttgacgagctggcccggagtatccggcagctcgacctcgaagttcatgatgcggccgcgggcgatcatacctttctgaatcaccgcacccatggtcacggtgtcgatattgccgccggacataatcggaaccaccacgtgcgggccggtggcggcggcgaacttgcgcgaacgcaggttcaggtgttccagcgcagccagcgaaacggcgccggccgcctcgaccaccagcttatgcttctcgagcatgagcagaatcatttcgttgatgtcgcgctcggtgacggtgaccagatcgtccaggaactcgttaatcagagcgaagggcaggtcgccggggtgcttgaccgcaacaccttcggcggaggtaaccacatggtcagccggagacacacgacccgcggccagcgagtccttccaggccggtgagccctccggaatcgcaccgattacgcgcacttcaggcttgaatgtcttgatggcgagcgccacgccggcacccaggccaccaccaccgagcggcacgaccacgtcagtgacgttcggcacgtcttcaaggatctccagaccgatggtgccttggccgcagatgacttcgtaatcgtcgaatggcggcacgtaaatcatgccttccttgtcggcgagctcagcagcgtgggcggcggattcatcgaacacatcgccgtacagcaccacgtcggcaccgtaggccttggtggcatcgaccttcagcggcggggtgatctgcggcatgcagatggtggccttggctccacgctcgcgggccgcataggccacaccctgggcatggttgccggcagacgcggtgacgatgccgtgagcgatctgctcttcggtgagcgaagcaatcttgttataggcaccgcggatcttgaaggatccggtgacctgcaggttttccggcttcaggagaatctcatggccggtcatctcgctcagcaccggagaaggaatgatctccgtgtggcgggcagtgcctttgagtcgttcggcggccagcttcagttcggctgcatgatcacgttgcagcgccttcaaaacatccttttgttccatagctttccattgtaagcaccacaatgccgagagacaccagctatctcgcttcacagaggtacattcggccttttgcagacagctatctgttttcataggggtaccgagaagcaaaaaccccgggtataagccttgattttcaatgcttatacctggggtttcgacgttacggtacctctctcaagacagatagcatttcgggatagccccgaagtacctctttgagcggagaaaggcactcaatgcactacaactggatgacggctgcctcccacgggtcgagctcgcggttggcaagggaggccacggtgtgcggagcgtcatacgtgctgatcaccacattcggctcggcgattccgacggcggttagttcggcagcctcacgtggcaggtcaacggttcgactggacatattgactacgaccaacaacttctcagcgtcgagctcacgggtaaaggcatagacgtgcggatcagcggcgtcaatcagtcgccagtcgccggcggccacgaccgggctgttgtgacgcagcgcaacgagttgcttgtagaaggagtacaccgaatccggatcatcgaattcaccggcggcgttgatctcggcatgattcggattcacggaaatccatggctcagtggcggcgtccggagcggtgaaaccggcgtagccggaaccgtcccattgcatcggagtacgcgcgttgtcacggctgcgcgcggccagaccggccatcattgactcagacgactgcaccttggcctcctcgaccctctgccggtaggcattcaaggattcaaggtcacggtactggtcgagacgcgtgaagtgggcgtcggtcatgcccagttcctcaccctgatagatgtacggggtgccgcggtgcatgtgcagcatcaggccaagtgccttggccgaacggacgcgggattcctccgcggagtcgtcgccccagcgggagaccacgcgcggctgatcatgattgccggtgaacaagctggcccatcctgcgttctgcacggcagtctggtaaccggccataatgctcttgaatttcggcaggtcaagcggcagcggcttccacttggtaccttcgcaatcaaaatcaacatgctcgaacaggaagagcatgtccaattcaccgttgcccggatcagtgatgtgctcgttacgctgagccgtgacgcctggcgcctcgcccacagtcaggaagccttcacgcccctcgaatacctcacgtcgcatttcagccaggaattcatcctgacgggggccgtccgcacagaacggattcgggttggaatagccctcctcgcccacaggaagatcctcaagctccgagccgtactcgcccggcagcttgccgttcgaatcggtgcgcttggagatcagggtgatgacgtccatgcggaagccgtcgacgcctcggtcaagccaccagttcatcatgtcgtacacagcgcggcgcacggcagggttctcccagttgaggtccggctgcttcttcgagaactgatgcaggaagtattcgccacgctcggggcagtattcccatgcggagccgccaaagtaggagccccactgattgggctcggcgccgggctcgccgggcgtggtgccgggacgagccggacgccaccaataccagtcggcgtgttcgtcgtctttgttcttggatgcttcaaaccaggcgtgttcatcggaagtgtgattgacaacaagatccatcacgatcttgagcccacgcttgtgggcctcggccagcagctcgtccatatcgtcgagcgtgccgaacagaggatcaatgtcctgatagtcggaaatgtcatagccgttgtcgtcttgcggagacttatagaccggggatagccacagcacatccacgccaagatcagctaagtaatcaagacgcgacgtgatgcccttaagatcgccgaatccatcgccgttcgtgtcttggaaagagcgcgggtaaatctgatagaccaccgcgttggaccaccacggattgggggtggcgccgttggtgcggatggcgtcggggattattgcgcggttgaaagtagtcatcattggctccttattgatatctatattgctcgttgctcacagtctaaaaattggcgaattacattcccattggagaactgcgttggtgtgccggaaaataaatatcaatcggcatatgcgctttcatgattgcacccggaaaacacgcagtcggccgtactcgatctcgcaagtatgggtttctcccggattcatatcaatcgtcgcaccatggtcatcgatgatgcggcaagagcgaccgctagccgtaataatgccgatttgtggctgccggcgcaatccgacgaaagcgatgacctgttctgcgccgaatcttgctgtgacaccgagcgcatagtccgtatgttcggggtcattgagcagtgacgcaatgactggtcgggccggctcatcaggacgcggtaatgtaccatcttcggcaagtaaatcacgcaagacagccgcatcagtgtgaccgcaggcatcggaacaatacactggtccgccgctaagcaatcggagcacggcatggactcgcgcatggggatgctccgtccagaacatgtcccaatcacagtggtacagctcccccatcagcagtgcacagtatgcgttctggataaggtgttcgcccagcgaatcaggattgtgcggtagatagtcgtcgctactacgggtgattggcgatgaaggacgatgccaataatcctccggtgccatgcccatgcagttaatcaatgcgccgccgaatcgtcgtgaggtcacttcatcaagcgcctgatggcgtccccaggtggcttcaccgtaactttcggtgccacgaaccattactgacgtggaactttgcgaatccactttgacgaaatcgacgccggcttcggcgagttcgccgtcccaggcatcccagaactgtgcgggttgttcagcacgacttccaggaatcaggcaaccattcgccgtggtggttattgcggtcgggcagctggccgcggctacacccgattcgtccaaaccattccaatagccttggaacgcctgccacacgcctacgctgcgcacgccatagtgcgttttgagcagcgcaatggtgtgggcaagcccgtgggggaaacgttggcgatccgcgccaaagtcgatcagggtttcctttgtgcgatccgtgttggaccaaccgtcatcgataagcacccaggaaatgggcacatgcttggcttggaactcctccatcttgttgacgatagcctgctcgttgacatctcgccccaatgaatcccaagtacaccatcccaacccggtgagcgcatccgggaatggacgctccttacgggtgcgaatacccagctggcgtgctgccgtttgtgtggcagctcgaatggccatatacgggtcggatgcgcaagcgatatatgcggcagtgtcacatagagtcgtgcgaccaacccggttggaagacagcacgagccgcaaagccgtgtcatcagattctgttgcgggctgcccactgaaatcagcccgaatatccgtgccgcagatagcgaccaacactagccactcggcatcttcggcatcgttgttgcggcgtaacaataactgcgtgcgttcaggcagttcagatggtgtacgcacccaggtcgggcgcatccaccactccttgtgctggtatagcgccagcatggtgtcatcgttgccgctgtcgacgccggccatggtgagcgacacgtcaatcgcatggtggggctcaaacgcttgttgttcctgaaaggcagcggcgcggtccttgggctggggtgcatgcgcgttcacatcgatacgccagagtcgcacctgagcatcaccctggatacccgcactggacgtgcactcgtcttcgcatgattcgggaacgattgtgacggcttctaccggcagttcacagattgccgaagcctgttcgccatagacggcacgaccgatatcaagatgggccgttaccgtgcgaacggttattggacaggtttcggcaatcattggcgtaactccttggtgttcttcaatgagattatgctggcaaggcccagacggtagcagctggaggaacgctctcgacctgagtgttcgcctgcacagtcgcgtcagacacaagtagcacggtcatcggctgcggcaaggcgactggttgactgtcagagaagttcgccatcacaaccatgccggacggcaagcgccaaccaagcagcggcgccggacactcttcgttggtaagccacgagaactggaagtccgtgccgttggccacccactgtttgcgcaatgcgacagcagcacaatacaggtgcaggacggaagccccgtcaccaatctgacgattagtggcatactgcgcaaaccatgccggctggggcagccacgaagcaccggtggcattgaagccgaacgccgggccgtctgactgccacggcagcggtacgcggcaaccgtcgcgccccttgaaataatgaccggaacgttcccaattgggatcctgaatttcatcttcggtcaaatcaaagtcctccggcaaaccaagctcttcaccctgatacacaaaggcggtacctggcaggccgagcatcaccagcgctgctgcacgggcacgacgagcggcgagcgcggggtcaatcggcggattcgtgccgttggacgtcacccactgctcgatgtttgcaccgctcggcagtccgagacgcgaggcgatacgtggcacatcgtggttgccgagcacccaggtgggggcggtttcggcagcgagagcatagcgatgcgtgcgctcaatcgtggtgcggtattcttcgcgattccaggcggcctttgacatggagaagtcgaatacggcaccaagttcatcaggcttggcgtattggaaaatacgggtggtgaatggcgaccacgattcgccgaccgcatacttggctggcgtgtactgattgaacaggtcgcgccattcacggtagatatcatgcacggcgtcgcggtcccagagcggatcggagccatcggtagcctgtggagacatcagtgtcgggtcgatacggtcgcgcagcggctcacgcaggtctttggccagaccgtgcgagacatcgatgcggaaaccgtccacaccgcgatcgcaccagaatgtgagtacacgcaggaactcatgccgcacctcgggattgtcccaattgaggtccggctgctccttggcgaacagatgcaggtagtaccagccgtctccacacgactcccatgcggaaccgccgaagttactcagccagttggtaggcggcaattcgccgtgctcccccttgccctgccggaacacataccgttgtgccgcttccgattccggaccttgagccagggcctcttggaaccaacggtgctgatcggacgtgtggttcggcacgatgtccacgatgatgccgataccgcgttcgtgcgctttggccactaattcgtcgaactgatcgagtgtgccaaggcggggatccacatcacaatagtcggcaacatcataacctccatccgccagcggcgatggatagaatggagaaagccagagcgcgtccaccccgagcgcctgcagatagtcgagacgatcgatcacgccttggagatcaccgttgccgtctccattggcatcgctgaatgagcgggggtaaatctggtagatgacggcgtcgcgccaccagtcattgttggtgaaagtcatatcgttcccctgtccgattgctcggtacgtatggttttaccagtatggccgcacgaaacactgttccggcggccataccctacatcctcttgccttcggatcagcccttaaccgagccggcaagcatggcgcggatgaagtagcgctggaggaagatgaacaggatcatcgtcggtgccatgatgagcagtgcgcccgcgttgagcagcaccacgtcggtctgatactggccaacgaacgactgtagggcacctgccatcgtgcgcttgttcgggtcgttctccaacaccacagccaacaggaactggttccaggtggccaggaaggtcagaataccgagcgaggagatggctggcagtgccaacggcagctgaatggaacggaacgtgcgcagatggcctgcaccatcgatggatgcggcttcgatcagatcacgcggcatctgctcgaagcaggagcgcatccacacaataccgaacggaatattcaggccgatgagcggcaggatcagggcaagacgggtattcagcaagcccatgccactgatctcgtagtacagcggagtgaccaaggtttcgaacggaatggtcagaccgacgaggaacagcacgtagatcaggcccttgcacggcaccttgagctgagcgaaggcataaccgccgagcgagcagaagatcaccacgcagggcacgaccacgatcaccagaatgcagctgttgagcagcagcggggtgatgtttgccatgttccaggcgtcgatgaagttctcccagtgcgggtgggcagtgaactggataccttcgggcatggaaccttgcggctgcaatgccgcggagagcatgctcaggaacggcagtacgcagaagaggacggtcagagcgagcatcgccgtgccggtgatgcgaacggctttggattgctgcatggtcactgctcctttccgttgaccagacgctgcagaggtccgacgaccagcagcacgagaatcatcagggtgacggcgagtgcggaggccaagccaacgctctgctgggtgaaggccaagcggtagacctgcacgccgggcaccatggtggaggtgccggggccgccctgagtggacatgtacaccacgtcgaagctggcgagcgcggagatgatggtcatggtcaggcatacgccgatttggccgcgcagaccgggcaacgtgatggagaagagctgacgccaccagccggcaccgtcaagacttgctgcctcgtacagggactggtcgatgccgccgatgcccgagagcaagagcaccacacagaagccgagctgcagccagaaaccaatcacgcctaccgcgttcagggaggtggattggtcgccgagccacacgtgggcgaagtcgccgaggcctactgcgcgcagcagctgattggcggtgcccttgtcggccagcatccaggtccaggccacaccggctgcagcgcctgggataacgcgcggcaggaacaggcaaacctgcgcgaaggaacgaccgaccttggacttcatgtctttgatgagcacggcaatgatcaggccgagcacaatcgggatgatggagaagaagatgatcaggtagaaggagtgcagaattgatccgtacagatcggggtcggtgaacacggtgatgtagttttcgacaccgatgaaggtgctagcatcgataccgttccactcgtagaacgagtaccagatggtctgaatgatcggccacaactcgaaggcgatgtagaacacaagcgccggagcgaggaaaagcaggctgaccagaccgagggacatattgcgcttgggcttgaccgccttggctgccttatgggaatccatgattgtcaccacgctttgctggtttggtgtgaactgggaatcgaacatcgcacacaacgtcgtgcgcgcgatgggaaggaaccaggcggagcgggaaaaagggaagaacactccgcccggtaagtgcaagggttacttgacctccttctcgtactgagcctgaatggattcgacgaatgccttgggggtcatcgtgccgtcaatcagggactggaagccggggataatggcgctggcctgcatacctgcggtggcgttgttgatgtagtcggtggtgttaccggtcttcaccagaccttcgtaggcggtaaggacctggccgagaagctggttatcggtgctcggagtctcgccttcgccgaccggcgggtagccgttgtcaactgcgatctggcgggcttcgtcggactggaggaagtcgaggaaggcggctgcagcgttcttgttcttggcgttggccgggataccgaaagcggtcacggcgttggctgcggcagaaccggaatcggccttttcgccggggaaggcgatccagccggcgtcatcgccaagtgcatcgttgatggaggcggagtaccagctgccggaggggaagaacagggcttcgccgttgcagaagcggctcagtgcagtggaaccgtcaagggcgagcgcgtcggaggagaagtaaccggcatcctgccagtccttgatcttctgtgcagccttcacggcaccgtcggtgttgaaggtggcgccatccttctggataatccaatcctgcacggtatcgcgaccctcatagttggtgagcaatgcctggtagatgtaggaagtgccgccttccttggccggcatcatcatggcgagcttgccagcgtcggaggccttcttcatatcggcctcgagctcttcgacagtggccggagcctcggtgatgccgagttccttggcgactttcttgttccagtacaggccggtcatcgagacaccgtccggcactgcgtagaggctgccggaaccgatcttaccgtcggagcccacgcggtagacctgagtctgggaatccggcagcttccaaccgtaagcatcggcgtaagcgtcaagattgacgacatggttgccacgcacagcggagttgatgtcggtgatacgggcaatgtccggggtgtcggcggcggagatgatgcgcgggccattctgctgggaggtgttgtccggatcgtaggtggccttgatggtgatgttcgggtacttcttctggaaggcttcgatcagctggtcatcaaaggtcttcaggccagcgccgtcccacagcttgagctcatacttggtatcgccaagatcagtgctcaccgcttcggtttcggtgttggctttgttgctggacgagcccgggccgcaagcggcgacggatgccaggcatgccacagacatcagaccggcaataacggttttggcggttcgttcgatcctcattgatcattcctttcttccttccgggcgatcccggctatgtcttccttggctatctcggcttagcgtatttgctaagcgcttatgtatgaggataacagatgtcgaaccggttcgtcaaatccgcaacacgcaaacaaatggccgattcccgaagaaatgaggaaggcttgacgttccccataggcaagcacttccttctcgcgaaattgcaacatcggtcccttaaatacctaagcgcttattcattcacctaggatgacgtttcgaaggctcgggcagctcgggaaaaattgaatgtggctcaatttgataccagtacgccacgctagacacatcatcctgacgctcaaatgcaccttcatatcctgaaccaatttgttgaagcgtgactctaagctcactatcaaacctgatgggatcaggaatatgccatcggtacaagccacgcataggtggacaataatcgtcatgatattggtttgctatagccccatcgcgcacagaataaaatggatatcctacatatggggcacaaaaagtacgctcgcgcgtatgaccatctcgctgctcagcgaagctccatgcaccgccaaaataatcttcggtgccggtactacacactgtgggataatcgttatcgccatctaggaaaaacttaatctctccctcaccccaccaatatcgttgcaacgtagaaatagcaagatatgtgccgacgtaatggccccgtccgctgactccatcgaggattacatagtcctcgcctaaagtagtgattggctgtctgcgccattgcgcatggaaataagccatttcacgggaggaatacgcattacccaatgcataatcaatctgataaaacaaagccggaatagcatgagcgtggtcattgcgcactacgatacgtgcccgtttacgaaacggcatcgtgaaataacaattcatacctcgtgtaggtgccaccacaataggctctgagaacacatcgcaactttgtccaaagccgcaacagaagaagtctcctaggggacattccacagaaggtcgcttttcatcatcccaatagatggcaagcaccgcatcgcgcagaacgtatcgatcagcgtcactggtgcgatccgtaacggtaaaccacatgtgccgaatacaaccggggccttcaatatctgccaatgtcacagactgcccgggagcaatgtcattcaaacacggctttcccttgcgcgacggccccaacggaccagtttcacggcaaccaaaacccttggctcccgttgggttctccgcattaatcgaacatgttacttcgtcgcggacagtcggcaaatccgataaagttcccgcgtacggtcctgccatcatcataggttaactctcctcaattcaagcgtcgctagcgaaaccggcatatagttgaagctgtttctaccgcttcgcttctttgtcatattgcgcctgcacattctttgtgaattcctgaggcgtgatgctgttatccagcagtaactggaagttagggattagcccacttgactgcattcccgcagtagcattattaatgaaatcgctagtatgaccgctcgtcagcacgtcggcataggcatcaaacatactctgctgcaatgcgctattcgccttgagatccaaagtagatgattttggcaaatagccagaattgtcaacaataatctgttgcgcttcggcactttgcgtataatcgaggaacgccgcagcagcatcacggttcttagcattcaccggaataccataaaatgcacctgcattagcagcaacgttcggctcatcttcactggtggcacccgggaaagcaaagaactgaacatcatcacccagcgctttggccacagtatccagattccaattaccgctcgggaaaaatagtccttcaccattgcagaacctgctcagagcagtagaggcatccactgcgttaacaccttcaggcatatatcccttgttattccaatcctgcaaggtggacgcagcgtcctgcgccgcctgattgtcgaaggtaccagatttctgcaaaatccaattctgcacatcttccgcagaactgttattagccattaacgcctgaaagacaaaagaggtaccgccatccttggcatatgtcatcatcggcagtatgccggcatccttggctgtctgcatatccgcctcaaactcctcgacagaggtaggagctgcatcaatacctagctgctcggcaagcttggtattgaaataaatgccagtcaccgaataggagttcggcaatgcgtacaaatcaccgctgccgagcttgccatttgaatccactcgatacaattcagtctgcgaatcgggaacatcccagccgtacgcatccacatatgcctctaaagacaccaaatggttgccacgaaccgctgaattcatgtcggtgacgcgggcgatatccggcgcatcttttgctgaaatcacacgcgggccattttgtccagagacattatccggatcatattgtcccgtgatggtgatgtttgggtatttcgcttcgaacccggcaatcagcgcctcatctacagccttcagacccgctccatcccacaaagtcagctcatattttttattacctaaatcagtgctgacctcagtaggatttgtatcacttcgtgagctacttgccgagccgggaccacatgcagtcagacttccagcgataaatatcgcagcaagcgccgcgccgctgttacgcataatcctattcatcggttacctccttgcatcctcatcatatgcaatcgatatttctctttactgtcaccatttttcggcggcaataaaatatatttgcgatatcgattacgcacatcgtacatctttttgcggaacccgtcaaccttgcatcacaccaatggtggccttaacttcaaaatccagatacaatacaatcgattacgcaatgcaggagatcccatgagcgaaccaacaatctatgaagtagccaaggaggctggagtctctgcggcgaccgtatctcgtgcaatcaacggacgtgaccgcatatcggaaactactaggcaaaaggtatttgatgcatgtgcaaagttggggttttcagcatcgaaaacagcctccatgctgcgaacgggaaagacaaatcgtatagcacttaccgtaggtaactcactggctggctggttcagttcacaactagccgaaggcgtatattccgtgctcgcatcccaaggatatgacttgctatcataccgacttgcaaacgccgatcaaagacgcgatttcttttcctcaatgccagtgaagcgcaacgcagacgcggtcatcatctcctccttcgacatcagcgagacagagaggcgaaccttagaacaactcggtatgccagtcatcggtgtcaacaccatcgggcttacggaacagcgagatatgatttccatcggcgtagacgaaattatagcaatgcgacaaaccgttcatcagctcgcaggactgggacatcgcaatatcgcctttatctgcaagcagcaagacagtaacggattcatatgggaagctgaccaacgtatagaagggttccgtcttggcatggcggctgagggactcaacttgcccgacggatacatcatcgcagtacaggacaacgaatttgccggagcagaggcactcagtagcctgctcgcactctcccctcgcccaaccgccgtatgctgcatcagcgacgagaatgccattcctctagtccatgcgcttcgctcatacggattccgcgtacctgaggacatatccgtcatcggattcgatgactggccaatggcacaagcgctcaatatatcaaccgttcggcacgaccctcggtcctacggagcattagcggcagatgccgcaatccgattatcacgaggcgaaattctgacagaaagttgcatcgttgttcccacgacgctcatgttgcgcggcaccacaggcccagcacctcgagattaaacatcgacaacgtccgcatttgatgatgtgcatatcattattgcaacagcgaaacaacaggtaccagccagaggaaggacgaccgggtaacagccacaaggcggccacccattcaccatgaaacgcgcgaccatcaacgacgtagctctcacggccggagtctcaacttttaccgcatcccgcgctttgcgaggtaaggatcacgtggcagcagctacgcgggataaggtgctgaaagcggccaaagagctgaattacaccgcgtctcgctcggcggcggcgctggcaagcggacgcaccaatcgcattgccatgctggctcgcgaacggctggccggctggttcatgggcgaattattcgacgggctgtatgacgaactgagccgcgcacgctatgacttgaccgtataccgagccggcagcgtcgaggagcgtgcggaattctttactcggctgccaaccaatcgtaacgccgacgccctcatcgtatccggattttccgccaccgatgaggaagccgacacgttggccagcatgggtatgcccatcgtctcggtgaattcgccgtatatcagctgctgccaagcctccgtggccattgatgacgaggcggccgaagccatggcagtgcgttatcttgcggccctcgggcatcgtcgtttctgctatgtggggcgcaccgatccgctgaccggcaaggaatggggattcgatgcacgcgcacgcggatacaaagatgagatagtctcgcttggcctcaccgactgcggcatccacttcatcgactcggaatcaccacgctcggccaaacaagtcatcgccaccatgctcgcgcagcctgagcggccgaccgctatctgcgtgtggtctgactactacgcattgcgcgtggtacatgagttgcaggcaatcggagtacgaatccccgaagacgtttcggtctttggctttgatgggtccgacgtggcggaatccattggattaagcaccatggtgccaactcccccgcgcgaaatcggacagattgccgcgcgcaaggcactgaatttggttgaggggaagaccttggacgaccctcatacgactgtacctgtggcggtcgagcccggcgcgaccagtgggccagtgcgggaataggcgatatgggaaaagcccccctcggcggaaaaccgaaggaggcttgggtggagctgcactacttcacagcgcctcgcatgactccaccgacgacccacttttgggcgaagatgtagacgatgaggatcggggccatggccatcaggtagctggagaaggccatcgggtagttggtggcgaactgcgagctgaagacgtactgggcgagcgggatggtctggttcgactggtcggtcaggatgatcaacggcaggaggaagtcgttccaggcccacagtgcggtcaggatggcgatggtggcgttaatcgggctcatcagcgggaagatgatggtccagaaaatgcgccacgtggatgcgccatcgattcgggccgcctcttccagcgaaaccggaatcgaacggatgaagccagtggcgatgaacaggttcgtgcccaggccgagcaccgtgtacagaatgatcaggccgacctggttgtccaggtgcagggagcccatctgcttcgcaatcggcagcatgacgaccgggaacggcacgaacatggcggcgatgaagaagtagtacaggaagcggaagaagcgcttgtccatgttgcgggccacggcgtaggccacgaaggtgttggtcagcagggtgagcaccacggcggccaccgtgatgatcgcggagttgagcgcggccttcgggtagttgaccttggcggaggcgtcggcgaagttgtgccactgccacgaggtgggcagggcgaaggtgccggcttcggccggagtcttcagcgcggtgacgatggtgaagtagagcgggatcagaatggtcaggctcagcacggccacggcggcggtcagccaccagttgatcttgtggtccctgcggaacttggcgggcttgccggacttggacggggtaactgttgcagtagtcatttcttatcctcccctaaatcagatctgttcctggctgcgggagatgcgcagctgtacgaaggcgatgatcgccagcacgatgaagaagagcacggcgtttgcggtctggtaggcgtactcgccaccggtcaggccacccttccagatgaggtaggtgacggtttcggtggaggagttcggaccgccctcggtcaaggcgacgacctgatcgaaggtgccgagcgcgttcttcatggacagcacgaggttgatggtgaagaacggtccgatcagcgggaatgtgatcttccagaacttctgccaggcgttgacgccgtcgatggcggcggcctcgtagatttcgtcgtcgatggtctgcaggccggcgaggtagatgagtaccgagtaggcgatgccctgccagacggcgaggaagacgattgggatccagctgagttgctcattggtcaacagcgaggtggacagccacttgatgcccagcgccttgccgagctcgggcagcgggttcatgaagatgtacttgaacacgtagccgatgaccagcacggagagggtgtaggggatgaagaagatggctcggaagccattcttgaaggcgatcttcgagttcagcagcaccgacaggaacagggcgatcacattaatcagcaccgtgatgagaatggcgatgaggaacgtgaacaggtaggcatggcccactcggttgtcctggaagagggcgatgtagttcttcaggccgatgaacttgtaatcgccgtagccctgcgagttggtgaaggaatactttacgccatcaagaaatggcaggtacaggaagaaggcgaagatgatggccgccggaaccaccatccagtagtaggcggggtccactttgcgggtggagaaggcggagaccttcttcttggccggtttcttggcagcggtcttggttgcggttgcgtgtgacatgatgttctcctctcctaccgatcactcgaaggtcctggcttggaccttgtcccattcggtctgcatctggttcaggaagcggtcggtgttgccggaggtcaccatggtctgcaggtagccgccgatgttgatggacgaaggaatgtagtggtcgcagaagtcggccagtcggttttcctcgaagaacgggcgcacggtttccagcgcatcgttgccgaagtaggtgtccttcagcggcgtgatggcggactgggcgtcggcgtaggcgtcaagctgatccttctgcatgaggaactcgacgagcttcatcgcttccttggggtgcttggtgttcgcaccgatggtgagcatcacgtcgtcgccggcggtgaggatctgctcgctggcgtcatcggtggccggcatctgggcgaaaccaagttcgatatcggggttgatcagcaggatctgcgggatggcgtaggtgccgagcgggatgatcgcggccttgccttgggcgaagttctgcgtgccctgctggtaggtgacgccggtgtccgcagtggagtaggtgaagagctcggattccttctcgactgcggtcttccacagttcctggaacgtggtcttgccttgcttgagctcggtgtacttcgattcgggaaccagcgtgccggtcagggaggcgagcggtgcctgggtggtccaggcgtcggccacggaaccctgcagcgggttgatgccggcgtccttgaaggtgttgagcatatcggtgaactcgctccaggtggtcggcggattctccgggtcaaggccaaccttgcggaacagagccttgttgtagatgtagccggaggcgttacccgcgaagggcaggccatacaggcgcttcttggaggaatcggtggtctgcaccagattcttggcgatctgcaccatgccggggttgagggtgtccacaatgggttcatcggtgaagtcgtagaacacaccggaggcggcgaagttgccgaagctgatgtcgccgttgaaggtgatcacgtccggcacacgattcttgacgaaacgggtgcgcagatcggtctgggcgttggcggagttgttgatgttgaccttgatggtcgggttctgcttctcaaagtcggcgaccatggacttgaactggtcggcggcctcggacttgaactggaagaaatccagcgtgacggtgcctgcggtgctggagccgcagcctgccaggccgaacccgacggcgatcgcgcacatcacggcggcggtgcgcacggccagacgcttcagtctaggcgttgcatgtggggaatcggacagcataattgttgactcctttatctttcttttcctccggcttcggtgccggcggttcttccactttccaaggtaacggttcggccatttcattcccagcgccagcgagcccacttgcgcaagcaacaaaaagcgcggtattttgtgattaacgcaataaatacagcgaaggggcttgcatgtctgatgtcaacgcgattccacagtggttttccggatccgagcatacgcatcgcgtggcggcggcaattgcccaatacgggccgatagcccgcactacgttggcacagatgctgggactgagccaaggggccttgtcccgcatcaccagcgatctgatctacgccggggtgatcgaggagcttccggccgaggccggcccgtcaggcaagctgcccgagcgattcacgccaagggaaagttcggatcgtcgcggacgcccgcagacttcgctggtgttgtgttcgaacgcacgcaccttcattggtgtcaaggttcatgggatgtcgattgtggccgctgcggtgaacgcgcatggcgaggtggtgtccggccggcacgagatgccgatcggggcggatcagtcggctgagtatgtggtgtcggccatcacgcggctggtgcgcgaatgttccgccgatatcgcctcttccggactaccctcccccactgcggtgggcgttgcggtaggtgggcatgtggtcgacgattcgattgtgacgttcgcgccgttcctgcattgggacggggccacggacttggggacgatggtcacagaggcgaccggcctgccgtgcggggtgttcaatgatatcgattctctgctggtggatgcctcctggttcgggccgggtgtcggcgtggatatgttcgccgtggtgaccatcggcgtgggtgttggttattcgctggccgtgaacggcaagccagtgcagtacccggataagagctatggtctggtgggccacgtgcttatcgatccggaggggccgcgctgcaccagcggacatatcggctgttcacaatgcttgactgacgattcaatcgccgaacagtactctgcgattgtgggtcgcgcggtcagttttgaggactttgcgcgcgatgccaaggaacgcgtgccgcaggccacgcagttggtgaaccggacgtgtttccggttgggatcgctggtggctacggtggcgaatatcgcgatgcccgggcatgtgatgattgccggggagtccgcgtttttggccaagctcggcaccgattcgctacgtgacggcattcgtttctaccgtcacagccagacccagccggtcaagttcacgattatgaaccacgactggcagctctgggccaaagccgccgccagtcgcgtgattgtgaagcatattgggtaggccgttcttggctcccctcagagaggggagccaagaacgttgcttcgccacagttactccgccacgaccagcaattacggacttgcctatcggcaaggctcaatcccaccttcgctcagctgtcgcttcgctcaggccgtggctactgacagcctactaggctgtcagcttaacgccacagccttgagcaatactgcctgctgggggtggagggacgggggacgaatgccgtagcgctgcagggcttcgccggtcaggactacgccttcctcgttccaccagccgagagtgctctggccgttggtcagaccggtcaaatccaagctcgggtcaagcgggctgacacggtaggtgcgctcggggtcaagtccgggcagatgcacgggcgcggccggataggtctggctggtggtcagctgggtgaagcggtagatggcggcgtcacggttcggcatcaccataccgtccagacgcacggccggatcgttggagtcggcgtgcacgcaggtgtcgatggcgaaccagtcgcggtgcttcttgaattcggccacccacacggccagcttggcgagcgcctcgtccggctccttcaacaggttccattcgatgcccatgtgaccgaagaacgccatggccatgcgcagttcctggctggtggcgcgctgggtggagtgtgcggggctggcgcccacgtgctcgcccatcatcgccggcggcaccagcagcgaggtgtagcgctggatgtccgcgcgctcgaccgggtccacgcagtcggagacccagatacgatcggcgtgctccaggatgccaagatccacgcggccgccaccagaggagcagctttcgatctcaaggcccggatgtgcggtcttgaggcccttgaagatgttgtagacggcaagggtctgcgcgtgcacggccgggcggccggagcggcgggaaccgggctcggtgacgagcttgttgtggtcccacttgatgtagtcgataccaagctcgccgacaagctggtccatgcagccgtagatgtagtcgaacgcatccggattggtcagatcgagcacctgctgagtgcggccctgcagcggcagtcggccagcggtgggcgagagaatccaatcagggtggttacgggccacatcggaatcggggttgaccatttccggctcgaaccacaagccgaattccatacccttggcgtgcacgtagtcggcgagcgccttcagggacttcgggccatcgggccagacgtcctgcgcaatctgccagtcaccgaggccggaggtgtcgtcgcggcgggaaccgaaccagccgtcgtccaccacgaatcgttccacgccggagtcggcggccttgtcggcgagcgccttcagcgtatcgaagttgtggtcgaagtacacggcttcccatgtgttgaggatcaccggacggccgtgcgagaacaggcgcgggtgcagggagcgcacgtaggagtggaatcgggcggcgatctcgttgagaccatcgccataggagccgaacagccacggggtgtcgtaggagttctggccttcgccagggccagcgagcgtcacttcgccgccgaacaggagttcgccgccgccgatcacgccggttgtgtagggcagacgttcggcggacagcacggagttgccgctccagcccacgtgcaccgaataggcgtcgccatgctcgaagccgaaaccgggcacgccggcggtcaggagcagggatgcgtcgaagtcagggcggccggcgagctgcggcttttcgaaacggccgacggtcagcggctggcgctgcggactgcgttcacgtagatggtgaccggtggtggtgaggatttcgccggcggattcgggcagcgggaagccgagctcgatcttgccgatctcgagcggggctccggcgtctgcaccaaacaggttggttacggtggccttctgacggaccaggccgccggggagcagttcaaggtgccattcgacttccacgccctgctcctcatcgcgcgcggtgactatgacgccgggcacgcgggccgggccggtggcgcgggcatggccggccacatcggtgtagctttcgccggacacggcatcgagggtggcttccagcacgccgccggtctcgatgttggtcacggtgaacttggggaagagctcgacgccggcgcggcgcagcaccacgcgttgctcgccgatccagctttcggcctgggtgggcaggatggacggccagacggtgtcgtcgagcgcgccggacacgcgctgcggcttcagggcgtcataggcggccagcagggtgtcgggcttggccagcgggcgaccccagtggacgatgcgcggcaggtcgctgccggcaaacaccagaccgatcgccacattggcggcgggctgggtcaggtagacggcggtgagtgcggtaccgtcagcggcggcaccggtgaaagtcgaggtgttctcggccatattgtctccttcgacgtgtgtggattggcattgcactactggtttcgatggtagaagaaatggaatatgttgccttggtgccgcgtgttggttgcgtgaggtaagtaatgcgtccgtgtctatcgccgctgggcgaagaaatcagtcaggatggactgacactcgccttccaacacgccgccgtgcacttcaggactatggccgatatgcggatcgcgcggaatatcccaaatcgaaccgcatgcaccgagcttgggatcccaggcaccgaacgcgatggtgccgatatgggtctggatgcaggcacccgcgcacatcgggcacggctcaagtgtgacggccagcgtgcaatcggcgagattccaggcgcccaaggcttgggccgcctgacgcatggcgatgatttcggcgtgggcaagcgggtcaccatcagcctcacgcgtgttgtatccgcgcccgacaatctggccggccgcatccagcaccaccgcaccaaccggtacgtcaccagcggctgcagcctgaccggccagttccagtgcgcggcgcatcgcctcgtcatattccataccaacgagtgtatgccttttctcatatcgtctcatgatgtgcataatcggccgcaagcttaacgttttcttcatggttcccatatacttttggtggagaaaaatttaagggagaaggcggcaacatggcggtatttgagctcatcctatgcatcattgcggcggtggtggtgagctcgtttgtcagtcgcttcgtgcccaaagtctccacgccgctggtccagattgtgctgggcgtgctggttacgtatctgccgtttttcccggatgcaacgctcgacccggaactgttcatggtgctgtttatcgcgccattgctgtatttggaagcccacgaaatcgataagtcggcgttgctgaaaacgctggatctgagcctatcgctggctatcggactggctatcgtcacgatggcggcggtcggattcactttgcatgccgtctggccgtccatcaccttagcctcagccttagcactcggcgcggcactcggcccgaccgatgcggtggccgtcagctccctcggtaaagaagcctcgctgacgcagcgtcagcgcagcgtgctgaaaggcgaatcactcttcaatgacgcttccggcatcgtcggcttccagttcgctctggccgccgccttcactggagaattcgccgtggggcaggccgccggcgaattcgtgatctccttctttggcggcaccttatttggcctggtgatagcagcagcggccaactggctattcgagaccgtgcgatccctcggctgggaaaccactaccacacgtattctgatggaactgttcctgcccttcctgctgtatttgggcgcggaggaattcaatgtgtccggcattctgtcggtggtggccgctggcctgttcatccgattcgaccgcaccggcgtggggccgaatgtggcacgtacgaatatcgtttccacttcagtatggggtgtgctgagtttctcgctcaacggtgcggtgttcattcttctgggcatgcagctgccgcgcgccatgagggccagctggtctgacccgtatatcagcaataccgtgctgatcggcattattctgctggtcactctggtggtaatcgcgcttcgattcttctggattgcggccatgctgcgcgttgcgcgagatacaatcaccggccagcgccgcaaaatgacacccgaacgctggcgctcggccgcagtgatgacctttggcggccccaagggaaccatcacgctgtcattgatgtttaccatcccgtattacattgccggcggtgcgccgttcccgatgcgtgacgagctgattttcattgcgtcaggcgtgattatcgtgaccttgctgctggccaacttcctgttaccgctattggccccgaaccgtggcaaggatcccagcgcggaaatgattccggtgaccatcgatgtgttacgcgccacggtggaggaattgaccggacgcatcacgccagagaatcgccgtgcgattctgatggtaatcgaccaatacaccaagcgcatcggacgattgcagcagcgcatcggcgataccgatcctcagggattcgagcaattgcagatcgaagcgctgcattgggaaaaggaattcgtgcgcgaccgacttgccgacaccaaggcgcatccggcggcggatacggccacgcaagagctgaacgtcgaagcctgcgagcgcatgcttgaccagattatgaatacgttgcgtcacacttccactgatccgacttcggggcacgcggtatcgcagattcgcggtcgtgtacgcatgttccagcggcagatgagcaattacgccaaacgcacggtgtccaagattcgccacaccacaccattggtgagcgaggaccagattttcgcgcgcacccgcgaactgcaggtcgaggcgattcatcatgttatcggtcggcttattgacgagatgggccaggatacgtacaacaccgagcattgttcggcactgttgctggattatcgtcgtgccgaggcttcattgcaggcacgtccgaccatgagcggcactacggaaaccatcacgcaggtcgaggacgtaaagcgcgagagctacggtatcgaactcggtatgattcaggacatgtacgaagccggcgacatcaaccgagcccaagcccgctccctgaggcgcaacatctacgttatgcaagtggacgctgattccggcatctagtttcccttgctcccttctctgaggggagccaagttggggattgctatttccgtatgattctcttcagtatgtgcagtagtgcttgcagtgctcacttcgctcatgggagaacagtctatgaccgcgccggccacaagcgccctcgatgtccgattgctgtgacggccgcgccaattccagtgatggcggctgactacagcacgccagaggtaatgtcgttgtcgagcagccactggcgcaaatcggcgaactcctcaagactcacattgtgatccagaccgtggtagctcttggttttcagccacgtatgctcttccagccaagcggcggtggcgaacagttcgtatttcgggattacgccatcgttcttgccgtacgtatagaacacggggatatcgtaatcggccaggcgagagtcggcgggggccgtgccgggcacctgaccgggtgtgttgaagccggacagggagacgacggcccggtaccgctcgggattgatacgcaacaaatgcacggcgaccagcccaccttgcgaaaacccaagcggcaccacgtcacggtcggcgggaatgttgtcggccacccatcggtcgactgctgtggcggcggcatacgcgtcgtagtcacgatcatcgccgataggcagggcatcgtgaaaccacgcgtagttgccggggtcgggactgccttcacgggccggcgcgagtgtcagcggcccgcgcagtgccacgaagtcgttatatggagcgatgaggcgcatgatgtccgccatgtcttcttcgctggatccccatccatgcaggcacaggaacagcggatgcgtggcatgctggtcgaagccgccgcgcgaggtgacgctgtgttccacggtgagtggctcgccaaaacgtccgggcacagtggtggattcgcggccgatcagaggctggctggcattcgcttctttgctcataccattccaatatagaggtcttgcgcgctgtgcggaaaacgatggaccatgatttcaatcatattgggtaatccgcgccgaatcgccttgggacttttcaagggataccggcaatctgtcaggcgttaccgctgtctgcggtatctgcggctgcggtgattgtctcaagttcgccgccccactgctgctgcagtgcggtcatcttgctggcctcgccgaacaccatccagcgtttgccgttcagcaatcgccaatcacctttcgtttgctcattatcagcgtattggctcagcagttcggaaatcttgctttcgataggtgcccggctgatggctgcggacgattccgattcaaaggatacgaaggccactctcggatcagtgcacatctgtacggtggtgatgcccggcaaaccgcccgtatcaagcccctgccatccttctttgcacgcgccggcagcttgttcgatgccttgctccatctgtgcggtatcttcgacgggtgccttgtcgttcgactgctgaatcagtccttccgggaacaatacgcccacggccatgccgataaccaagcaaactatggcgcacaccagtgcgatgatgccgcccgcgcccactcccccgtgagtggcgtaccgaggcatggtgactcgcgcagcgatgaccagaatcagggtgatgccgataagcaccgccgccatcaacgcaatgtatcgtcctggcactgccgtcataaaggaaatggcgtaaggcgcgatctcatgaaccgccgaggtggccgataccacgacggctagcagtccgctgacaacggcaagtctgcggcacaatatcgacgttgggctgctggcttttgtagcggcgaatcgccggccggcatcccgtctggatgggcgtcgattctgtgcacgacgtgagctgcgcgaatcgtcatactgaccatcgccgaagaaatcgtagtcctcatcgttgcgggccatcggtgcccccttcctgccgattacacagctagtgtaccgctatggcttgggaatggcggtcattcgggggaatgattcagggcacaaaaagaaccccggcggttgcccgccggggagagaaaggagagagaagaagaaagggggttcaattgtcgggaactgctgcggctcctgatcagctttccgctgacatcttttatataaccactgctttctgggtctacctctaagtttctctgagaaaaacctgagaatacttgcgattgatggaccgcggaagcgtgaggagcctctcacgtttccgcccaaggcgctagacttgaaggcagtatttatttgcccaaggagtttttcacatgctgctgtccgaccgcgacattctcgccgcacagtccgcaggtcatatctcacttgatccgtggacccccgaaatggtgcagcccgcttccatcgacgtgcgattggatcggtacttccgtttgttcaataaccacgcctacacctatgtcgatccggcggaaaaccaaggcgcgctcaccgaacagttcgaggtggctcccgacgaaccgtggattttgcaccctggcgagttcgcactgggttccacgtgggaatacgtcaagttggacccgtccattgccgcccgtctggaaggcaagagctcactgggccgattggggattctcacccattcgactgcgggcttcattgaccccggtttcgaggggcatattacgcttgagctgtctaatgtgtcgacgttgccggtcaaactatggcctggcatgaaaatcggccagatgtgcttcttccagctgagctcgcccgctgagcacccttatggctccaagggcaccggctcgcattatcagggccagcggggtccgacgccgagccgttcctacgagaatttctaccgcgcgcacatcgacgactgagcgttgcgacgtaccattcggccggcggatgccggccatttgcttaatcccaaggagatgtcatgaccaacagcgatggcgggttccagttcgacttccagcagcccgaaaagccggtcaggccaacggttcctccgattcccgggcaagagacggcagcatatagcacagaacccacggcacaagccacaccggctctgcagttcccgcagtctgtgcagtctgcgcagtctgcgcagcccacacagcccacacagtttgtgcagcccgcgcaagtagcgtatgcctcacaacccacgcaagctgtgccgaccgtacaagccgctcagccgacgcagcccatcgatccggccatgacgcaaccgttctcgccgcaattcctggctgcggttgccgcacaagcaccacagccggcggcagccacgcagccagtagtatccgaaacaccaatcgccgctgcgcccggccagcagcaatacgtttgggatcagacgacgcaaagcttccgcccggtggaaccgacagcgccggtgacgccagcagcaccagccgcaccagcggcaccggcgacatcgcctgtttcggtagcttcaaacgccgcgacacaggcgttccaccccaatcaggccgagcagcctgcggtagatgccgaggcaacacaagcgttccagcctgatcaggtcatggcaacacagcctttcgaagctcaggccatgccgaatgccgaaaccgcggccgcacaggcatacggcgcatcatccaccgtatccggtgagaccgttgccatgccggcaacgcaagtagcgtctgccgatgatgctgcagccacacaggtgttccaaccggccgccctggccgcttcggcacaggctcagcctgctgtgatgcctccctccattccgttggatcaggtctccgatgaggacgattccgatggcgccgagcctcgtcacggcggtagcggcaaaaagaacaccagcaagatcgtcggcattgccgtagcagtagtcgccgtgatagcgctggttgtcgccggcctgctctggtggcattccaacagcagcaaggcgagccaagccgtggcattggccgagtgcaaggtagcggccaagcagtacacgaatgctcagaagaagctcaccaccgccatatccaatggccaaaccagcgcgcaaacatccaccagcgatgtggccgatgccaatacgctcaccacgctgaatcaggcgttgcaagacgccggcaatccggctgacaccgccaagtgcgattccagcctcaacgccactgagttgaagtctcacactaaagagctgcagaatgatgccagcgacatggctgacaagacggatgccatcaacaacgcgatcaaggccgttaatacttcaaaggcgacggccgataccaacacactgaaatcgaacctgagctcggctatttcgcaggcgcagggcacgctggataattccgcgggcagtgtggccgatgaaaacacccgcaccgcgctgcaaaacgccatcaccgaggccaatacggtgatgaacgggaccagtccgtccgaatccgacgtcaataatgcgatttctaaactgcagaaggccgagtccgacgtcaccgcctcgatgcaggccaagcagcaggcagatgccgccaagcaagctcaggaagaggctcagcagaaggccgaccaagaggcacagcagaagtctcaagacgagtccaacaatagcgacaacaataacggcggcgacaactccacctctactgacggcaccgacggcagccacaactgaggtctgcagcgttctcctgtttctcatgggcggtaacttcctcatgtggcggctagcacatttccctttttcgcggaataatgccgttttcagcgaccgccccatgggatagttaccgccccatgaggagccgtttggatatagcagtgggccgggctctgaataccagagcccggcccactgctatatgcccacaatcagggctattgcgatggcttaacgcttggccatcgcgcgtagcacaatcttgcgcagttcggaggcaatcagcacgattgcggccaggcagatgcattccacccaagccatcgggctcaatgccacggtgccgaacggaccgttgaggaacggcacgtaaatcaccacgagctgcagcgccacggacaaaccaatcgcaccccatagccacttgttggagaacagacccacgaatgcggactgcagatgcgaacgggaggacagcgcgttgaacagctgggcaaacaccagaatcgtgaagcccatcgtacgggcctcggtcatctgcgcttcatggccgatggcatccaccgagcggtcggtgaacaagccgccggacaggtgcatgtccataccaatcagcgtgacgatggccatgatgacgccgatgtagatgatgtcgccccacatggaggcgtcaatcacgcggtccgtcaccttacgcggtttacgacccatcacatcgtcggtctgcgggtccacgcccatagccaacgccggcgcggcatcggtcagcaggttgatccacagcaactgtgtggcgagcagcggcacggtgacgcccacggtttccggctggcggatgccgaggaagccggcaaacaccacaccgaggaacacggtgaacacctcacccacattggaactcagcaggtagcgcaggaacttgcggatgttgtcgaagatcacgcgaccctcgcgtacggcggccacgatggtggagaagttgtcgtccgccagaatcatcttggcgctctgcttggtcacttcggtgccggtgatgcccatggccacgccgatgtccgcggacttgactgccggggcatcgttcacaccgtcgccggtcatggccacgatgttgccttggcgctgcaaggattcgacgatcttgagcttgtgctcgggggccacgcgcgcgtacacggacacttcggacgtggccttgtcgagcgcggcctcatcgggcagctggtcgagctggtcgccggtcagggccttgccatccttggcgatgatgccaaggtcggaggcgatgcgggcggcggtcagcgggtggtcgccggtgatcatcaccgtgcggatgccggcacgatgggcctcggtcacggagtcgcgcacctcagtacgcggcggatcgataatgccgaccatgccattccagatgagatcggtttcaatggcttcggcctgatcggcgatgtcggacacctggcctgcagcgttgacgcttacaccgggcacatcagccaaagaaccggtttccagcggacggcaggcctcgccaagcgtacggtaggcctcggaggagagacgttcgacggtggcgagaatcgactggcgatcgccttcggtgagcttacggacctgaccacccacgcggatgcgcgtgcagtagctcaacagcacgtcgggcgcgcccttggcgaacacggtgagcttgtctgaatcggtgctgtccttggcgatgatggacatgcgcttgcgttcggaggtgaacggaatctcgccaacgcgcgtgtatcgcttgatcttgcgatcggccttgaccttgcgtgcggccacgatcagcgagacttcggtggggtcgcccacaatctcccaacggccgttctcctcgcgtagttcgccgtcgttcgcgagcgtgccggccacgagcgtggcgacgacttcatcggccacaatctgggcctgctcggattcaggactgacgccgccggtcataaccatgcggccttccggcgcgtaaccggtgccagtgatctgcacttcgccggacggggtgaccacacgttccacggtcatctcgttgcgggtcagcgtaccggtcttatccgagcagatcacggaagcggagcccaaggtctccaccgaatgcagtttcttgacgatggcgttgtgcgcggccatacgctgcacaccaagcgccagcaccacggtcaggatggcggccaagccttccggcacggcggccacagccagcgagacagccaacagcaaggaatcaatcacgtcatggacgtcgttgaagccttccagcacggcgagcgccaccagcaccacgacagcgatgacgcacaccgcaatgccgaggatcttggagacgtaatccatctccttctgcagcggagttttctcatcttcggtggcggagagcatgtcggcgatcttgccgacctgcgtattcataccggtgccggtcacgattgcgcggccggtgccttgcgtcacggaagtgccgttgaagatcatgttggcgcggtcgcccagcgccttggcttcggtgagtgtgtccggcttcttgccaaccggcacggattcgccggtcagtgaagcctcggcgatgcgcaggctggccgcgttgaccagtcggccatcagcggagaccgaatcgccttccgcaaggacgatgatgtcgccggggaccacgtcggcggtgttgatgcgcatgaccttgtcatcgcgcagcaccgaggtctgcggggccgtcatttgtgcgagcgcttcgacggccgcctcggccttggcttcttgcatatagccgagcacagcattgacaatcaggatcaagatgatcacgatggcgtcgaacggcagcacttcgccgccttccgcgccgggctgcgcattggctttttcgatgaaccaagcgatcaccgagataatagtggccgcgatcagcaggtagaccagcggatcttggaattgggccaggaatttcttccatttcggtacgggcggggcgctggcgagctcgttcgggccgaatttggccagtcggcgcttggcttcttcctcgctcaggccgtgggatgggtcgacgttcagggctttggccacgtcgtcggcactggtcagacttggatcagtatcccccaatagcgcttcctgtgcgcgcacctcttccgattccacgaccccgttcgttgcggtcgtggacactgcggattgatctttgagatcatccataatgttctccttggtattgccgcggagtagtcagccttgcggccgctgccgggttttctctcccggctggacgcacaggactgcgcggttatggacaccggcgcaactgctgccgatgcatacgattgccattattccataaccgcgtggcgcacttggcgcacagcgtaatagcgttttgcctagaacaggcgacgcaaccaggcctcagccaaatcaggccaacactgcacgcattcgacgatgtgcgcatagaagccgttaccggcagtttccgcattggccaaggacaggccgtggctgccttcagggaacaggtgcgcctcaatgctcacgccggcggcccggcaggcctggatgagcattagcgtgttctccacgggcacggcgtcgtcggtcatggtatgccagacgaagacgggtggcgttttggcatcgatgtgcttttcgatggagaacttgtccagcaaagcctgattgtgagcttggtcccctagcaggcattggaagctgccgcgatgggcgtacttgccggcggtgattactgggtacgagagcatcagcgcgttcgggcgcacggcgtccgggtctatgccgccctgttcgcggatgtcttcgtcgccgaccgaggtggcgaggttggcggccagatgcccgcctgcggaaaagccgagtacggccacttgcgcggggtttacatgccactgatccgcattggcgcgaatcaggcgcattgcctcggcagcctccagcaaagccaccggatagcggctgggctgcaccgaatagcgcagcacgaatacggcgaagcctttggccaggaattgcagggccactggctcggcttcgcggtcagaagtcatggcgtagccgccgccaggcaaaatcaggatggccgggcgtatacggtccggttccatctcctcgctgttgtcggccacatagccaaagaatcgcgcctcgctgccatcaatgccaacgatggtttgttgaatgtattgcatgccatacatcatacgcgcagagaatagttctcgataagaaccactcgccatatgcggtcttgcccgtatctccaaaccgaataacacttacagcgaatcgtgaagactgcgggccatggcgcggtcgcgcgagcctttggtgagcttgagaccgagggtcacggcaatcaacacaacagtgcaggcgatccacagcgttcgaccgccgaagttgctgatagtccagccaccaatcagcggcgccagcgcaaccgacgccgaccacactacgttgtagacgccctgatacgtgccacgcgccgacgcgggtgccatggcggcaaccgtagtggtggcgatagggaatgtgcccagctcacccagcgtccacagcactacggcaagcgcgaatccgccccaagaatgggccgcggcctgcaccgcatagccgatgacggttacggcgaggcccatcaccagcacgcgtgaattgcccatgcgcgcgaacagtttcatcgcgggaatctgtagcaggcacaacataccgccattgatggtgagcagcaccgaatactcgcccagccctagaccaaggtccgtcatggcaatgggcaggccggaggtgctttggaagtacacaaggaagtagccgaacatcagcagggagaagccgaggaatggagtatcggtgagcacgcgccgccaattgcgagacatggcgcccttgacactggcagccggtgcggcatccgagtgattcggcatctcaatgccggcgaattccgcatgggtaacactgcattcgtcttcatggcgcaccgcacttggcaccgatacagtaatccccaaatgccgcacctcgcggaagaacgcaatcagcaatatcgtgacggctatcatcaccgccgcttcaacgtagaacatcagcgaatacgagatcttgaccagctggttggccacaatcggtccaatcgcgtacccaaaattaatcgcccacgattgcagtacgtatgcacgttgctgacgttcggcaggcaccacatccgcgatatacgcggcgatggccgggctgggcagcgaggcgaacgcaccatagacgaacagagccgcgcctaaagacacaggatcagtgagtacggaaacgaccagcagggcagccgctgcgccgatttcgccgatgataatcatggattggcggccgaatctgtcggacaaggtaccgccgaacaggcagccgatgattgcgccgaagccgtacatggccacgactgtgcccaccacaccctcatcgaggcgcagcgcggaaaccaaatatatcgacaagaatgaggtcacgaagcgacccatccacagaatcagaatcgccaaccataatccccaatacagcagggacagtccgaatatcatacgctgcttcttcactctcaataccttaccggctaccgacggcggaatagccgcgttttggcgcggggtgctgggacaatagcacctatggctatcaaaaaaggaccgaccaaggggtcgggtggcaagcatcgcaacaaactgaagggctacggccccactcccaaggccgaggaccgcgtctatcacaaggcgtacaaggccaagaaagcggccgaacgtcggcagatggccgacccgcgtctggcagcccgccgtcgagtggacaagttcgcttcggcggatacttcggatctggtgtacggccgtaattccgtgctggaagcactgcgcgtaggcgtaccttcttccacgctgtacatcatgtctcgtattgaacatgacgatcgtactcgcgaaatcgtgaaaatcgctggtatgaacggcctgcacatgctggaggccgatcgtctggagatggatcgtatcgcccgctctggcaaccatcagggcgtgattctgaaggtcgatccgttccagtactcctcgctgaacgagctggccgatcgtgctgagaagaaggccaaggcaatggaggccgcgaattcggcggccgcccgtattgctgcgcgaccgctgtttatcgcattggacggcgtgaccgatccgcagaacctgggtgccgtgattcgttcggcggccgcattcggtgccaatggtgtgattctgccggaacgccgttccgcttcagtgaacgccgccgcttggaaggtgtctgccggtgcggccgcgcatatgccggtggcgcgcgtggtgaacctgactaaggcacttgagggcttgaaggagcgtggatactacgttgtcggccttgacggtggcggcgataagctcgtcggcgagactggctttgaatccgatccgctcgttgtagtgctcggttcggaaggcagcggtttgggccgactggtgcgcgaaacctgcgacgcgattgccggcatcccgatcagctcgtctgttgagtcgctgaacgcttcagtggcggcgggtatcagcctgtacgcggtgtccaacgcacggcgcaaggctgcggcggagtgattgtcgcttgaggccgtaataggttgtacatacacggaagcccctctatttgaggggcttctttgtgtgatgggctcacctacagacagtccaccggattgtccgcttaatgactccacactgccgcatccggatcgtcatcggggttgtagccgtcgtcgtccgggtcgctgtaggtggattcgtcgtcaatgacgccggaatcggcctcttcgttaagttcggcgagtgccttggagtcaaggctgtagctcggcagagcgttgtcgatgtagctggtcacggcctcgcccatcggcacgtcgtggccggccttctccgccaggaaccagcgatggtcaagcacctcatggaagaactgagcaggctcgatctgggagcgatattcgcgcggaatcatacgcacggtcggctcgaacacctcacgcatccagtcggtggccacgatttccagatcctcgccctcacgccacgtggaggcacggtaggcgtcaaggtcgttgagcagacgacgggcctggttctcctgcacgtcaaggccggtgaggcgcagcagcttgcggttggcgtagccggcgtccaccacgcgcgggcggaccagcacacgcttgccgtcctcggcggtcttcatttccagctcgtccacgtcgaagcccagctcgttgagcttgttgacgcgctgctcgatcttccacatttcgtccgggttgaacttgtcggtgtcggtcagggcgctccacagcgagtggtagcggtcgactaggcggttgcccacctcgatctcatccacgtcgccgggcagtagcttgccggacgccaaatccataagttcgccgatgatgttggtgcgggccaagtcgatatcgtattcgcgctggccgtcggtgagctgggcttgcaggtcaccggtctcggcgtccaccaggaaggcggagaaagcgtcggcgtcgcgcaggaacaggacgttcgacagggacacatcgccccagtagaagccggccaggtgcaggcgcaccagcagcacggcgagggcgtcaatcagtcgttcggcggtgtccgggcgcaggttgcgggcgaacaacgcacggtacggcagcgagaacttcaagtgccgggtgaccagaatcgcctccagcggctccccttcacgggtatgacggccgatgaccacggcgatcggggtcacagttggcagttcgagcttctgcagtcgacgcaggatctcgtactctcgctcggccacctggcgcgtgatctccttcatggcgtacacctcgtcgcccacgtgcacgaatcgcacgacgtggcgggagatgcctcgcggcaggttggccagcaggtccttaggccaggtggccaagggcttgtgccagggcagcgtgaacatctttgggttcgagctggcggcggtgattttcagtgcttgcggttcggctgaattggcgtgttcgtcttcggctttgacagacgtggccttcagcgcacgcggatccatctggggcaattcgttcaactccatgtgttcgattttacgtgtcgttcgcgatgtgtgctcctttgccacgacttcggcgcgttatgtttacgggaaaacaccgtttggtctctccctcagaccgtctagaaggcaaaagaaaagccccgcagctatgcagggcttttccaacgaggtcataagagaggaagagaataacctcgtttaatggttgacgaagcgattagacctcgccaagtatctattagttcagacgcagctcagtcgacggagcgaacaggtgcatcttggccgggtcgatcttgatcttgacggtcgcgccaaccttcggcagcgcacgcggattcacacgaatcgtggtgagcttgttctggtcggacatgacctgggaagcctcagcggcggagccatcggtgatgatgttgccgtagatgtagccatcggagcccagatcctcgacgttgacgaccttcagggagaaggcgttcgggtcgtcagccggggccaggccagcgtcctcaggacggaagccgaccacgatctggccgttgtcttcggcggtgagcttgttgacggcctcagccggcaggtccacggtgtcctcaccgatcttcgccttgccgttgaccaccgggtgggtgttcaggttcatcgacggggagccgatgaagccggcgacgaagacgttggccgggcgatcgtacagctcggtcggggcgccgacctgctgcaggataccgagcttgatgacggcgatgcgatcgcccatcgtcagggcctcggtctgatcgtgggtcacgtacagggtggtgacacccagctggcgctgcagagcagcgatctgggtacgggtctggacacggagcttggcgtcgaggttggacagcggctcatccatgaggaagaccttcggctcacggacgattgcacgacccatggccacacgctgacgctgaccaccggacagagccttcggcttgcggtcgaggtactcggtcaggtcgagaatctcagcggccttctcgacacgcttgcgaatctcgtccttcggagtgccggcgatcttcagggcgaagcccatgttgtcggcaacggtcatgtgcgggtacagagcgtagttctggaacaccattgcgatgtcgcggtccttcggctgcatcgtggtgacatccttgccaccaatgaggatgcggcccttgttgacctcttccaggccggcgagcatacgaagggtcgtagacttaccacagccagaagggccaacgaggacgaggaactcgccatccttgatatcaagattcagatcatccacggagggcttatcgttgcccgggtagatacgagtgacgtggtcgaaaacgacttctgccataattactaatcctttcagaggcaggtacgtgcctcacgatccgttgtaaagggatttgttctttactgcgcttccgccctcgccaccgacgtacaactttgctttcggaaactgcaagcttcagcgtttacttttttccggttcagtgaaggttctcttcgttgagccgagaactactatacacggaccgtggaccaaggcaagtggcgtgtctgaaatgtagttaactttatgggcgtttctgggggtgttgtgtggttcggcccatgacacgcctgtttctcgaacgtgcgaaccggcacgcccgacgtagagcaggtctgctcttcccggactgatggattccatcagtcgccgactaatgcgacacagactcgaaggtgacgccgttgcgggcggctttgcgctcggccttgcgctcctcggcgtcttcgatgcgctggatgcgcagctggcgccagtcctcgcgcatgtcgcggaaacggtcggccagcgttacgtcatcgttctcggcatcgccatcagtactgctgccatcggccttaccgaacgtgccatcggccttaccgaacgtgccatcggccaccttggcgatgcccagcttgagcagtccgagcaactcacgcaacgtttccggtacgggctcatcgccctcatcggcggacttggtcaggccctcgatgcggcgacgaagcgcgtcggcgtcctcgggatcgatcttgagcccggcgatcagcgactggcgcatggtctcgtaatcgaggttggcaaaaaaattcagctgttgcagcgtcatgaagcccttgagctcggggaatcggtggacgatgtattcctcgcggtcgtcggcggcgcgggtccagtcgcgggtgagctgcggatcccagctggcggtaatcgacccctcgcgcatgcggtagtggtacagcgccttgggcagacggaccacgcgcgtggcctcgccgatcacgttgcagatacgggagagatcctcgattttgcgacccaccgggaaggagaatccggtgccctgataggtggaggcgggtgccaggaaggcccagaaatagccgtcaatctcagccttgacttgctttttgatgacctcgaccggggtcaggacctgcacctcggtgaagtcgttgtggcgatagttggacagcagcggcttgttgttctcggagatggtgtcgaactggaacatcacgaggtcggcgtcatactcgcgcatggcgttcaggcagtcctccaccaacgtgggtgccacggtgtcgtcggaatcggcgaagtatatgtacgcgccgatagcctcagcgataccggagttgcgggcgtcggacaggccgccgttgggcttgtgaatcacgcgtatgcgcgggtcgcgggcggcccaggcgtcgcacatggccgggcaattgtcgggcgagccgtcgtcgaccagcagaatctcgaggttgcgataggtctgcgcaaccacagacttcacgcattcatcaaggaatttctcgaccttatataccgggatgatgatgctgaccaacggctcctgttccatatctccagcgtagcgccgccgtgcgaacgcggcggcgctgcgggttcgcggaccgcgaaacccttagaagtcccagtcgtcgtcatcggtttcttcggctttgcccatcacataggaggagccggagccggagaagaagtcgtggttttcgtcggcgttcgggctcagggcggccaggatcgcggggttcacatcgcaaatctcagccgggaacaaagccgggtagccgaggttcatcagcgccttgttaccgttgtaccgcaggaacttctcgacgtcatcggtcaggcccacgcgatcgtacagcgactgggtgtactccacctcgttgtcgtacagctcgttgagcaggtcgtacgtgtagtcctgcagatccaggcgctcggcatcgctcagctgggcgatgcccttctggtacttgtagccgatgtagtagccgtggacggcctcatcgcggataatcagacgaatcacgtcggcggtgttcgtcagcttggcgtgcgcggagaagtacatcggcagatagaagccggagtagaagaggaacgattcgagcagggtggaggccaccttgcgcttgtacgggttgtcgccctcgtagtagtcgagcacgatttccgcctttttctgcaggaactcgttgttctcgctccagtcgaaggccgcgtcgatctgttcggtggagcacagggtggagaagatggacgagtagcttttggcgtgcacggattccatgaaggcgatgttggtgtacacggcctcctcgtgcggggtgagcgcgtccggaatcagggagacggcgccgaccgtaccctggatggtgtcaagcagggtcaggccggtgaacacgtgcatggtgagcgtgtgctcgtcctcggtcatcttctgccagctggggatgtcgttagagacggggactttttcaggcagccagaagttgccggtcaggcggtcccagacctcaaggtctttctcatcttcgaggcggttccagttgattgcggagacgcggtcgatgagtttcagcggtttgcgcggaatggaaatcggtgccatggggattcctttgcattactcgtcttgggagttgtcggcgggcttgttttcgaactcctccggcacggtcagccggagcagtgctctatagatggttcgtgacattgtgggttccttagagtggcctctggttgttcgatgtgtgcggagaccgccgtctgaggccgaaggcgtacgaaggtacgtcgagtgccgaagaaaggcggtatacgctccatcgaacgatcagagcatgcaggagacgcagccttggacctcagtgccttccagggcttgctggcggatgcggatgtagtagagggttttgatgcccttgcgccaggcgtagatctgagccttgttgaggtcgcgggtggtggcggtgtccgggaagaacagcgtcagcgacagtccctgatccacgtgctgggtggcctcggcgtacgtgtcgacgatggccttccagccaatctcgtaggcgtccttatagtactcaaggttgtcgttggtcatgtaggcggccgggtagtacacgcgcccgatcttgccttccttgcgaatctcgatcttggaggcgatcgggtgaatcgagctcgtggaatggttgatgtatgagatcgagccggtgggcggcacggcctgcaggttctggttgtaaatgccatccttcagaatcgcgtcgcgcagggcctcccaatcggccgcagtcggaatcgcgatgccgtactgctcgaacagcgcacggacccgttcggtgcgcggggtgagcgaacgacgaccatcggtgtacttgtcgaagtagttgccctggccggccgggtgggcgtagtcgctcgtagcgaagctggcgaacgcgcggccatgctccacggcgagcgcgtgcgaggcgcggtaggcgtggtaggcgaccgtcatgaagtacatgtcggtgaagtcgaggccttcttcggagccgtagtggatgccttcgcgggccaggaagccgtgcaggttcatctggccgagaccgatggcgtggccctcctcattggcgcggcgaatcgaaggcaccgcgttgatgctggtgtgctcggccaccgaggtgagtgcgcggatcgccgtctccaccgtgtggcccaagccgccatccatcgtcttagcgatgttgagcgaacccagattgcaggagatgtcgcggccgacatgcgcatacgtgaggtcctcgttgtatgcgctcggctcctgaacctgcaggatttccgagcacaggttggacatggtcacgcgaccttcgatcgggttcgcgcggttgaccgtgtcctcgaacacgatgtacgggtagccggattcgaactgcagttcggcgatggtggtgaagaacttacgggcgtcgatgtaggtcttcttgatgcggtcgtcggccaccatctcgtcataatgctcggtaacggagatgtcggcgaacggcttgccgtacacgcgctccacgtcgtacgggctgaacagggccatctgggccttctgtttggccagttcgaacgtgatgtccggaatcaccacgccaagagccagcgacttgatgcggatcttctcgtccgcgttctctcgcttggtatccaggaagcgcaggatatcagggtggtgggcgttgaggtacaccgcgcccgcgccctgacgtgcgccgagctggttggcataggagaaggagtcctccagcagcttcatgaccggaatcacgccgctggactggttctcgatgtgcttgatcggggcgccgagctcgcgcaggttgctcagcagcagggccacgccaccgccgcgcttggagagctggagggccgcgttgatgccgcgcgaaatcgactccatgttgtcttcgatgcgcaccaggaagcagctgaccggttcgccacgctgggccttgccgaggttcaggaaggtcggggtggcgggctggaagcggccggcaagcatttcgtcggcgtattcgatggcctgctgctcattgccggcggcgagctccagggccacagcggcgcaacgctgcgggaagtcctcaagatagaggcgaccatcgaacgtcttgagcgcgtaggacgtgtagaacttgaacgcaccaaggaaagtgccgaactcaaagccggcggattccacgtgctcgtagatgcggtcgaggaattcagcggagtactggttgaagaccgcagggttgtagtactggttgctgatcaggtattcgagacgctcggcggtggaggcgaaccgcttgctgttggtggccacgtgccctgtcacgtattcgcgttcggcggccttgtctttgtcgaactggatcttgccgtcggcgtcatagaggttgagcatcgcgttgagcgcgtggtaatcgtgcgccgggtcgtactgttccgctgcggtgtcggcagtattgtcgagcggcaggccggtggcggtgaggtcagtcattggaaatccttggaatatggcagaagtgtgtttactcagacagttgctcccctcagtcaacttcgttgacagctcccctcggagaggggagccaatacctcgagggggtcaagatttactgttcggtgaagaagcggacgaggccgtttcgcacggcggcagtgtcttccggggtgcccatgagttcgtaacggtagaggtagggcaccttgcatttggcggcgatgatgtctccggcggcacagtaggcctcaccgaaattggtgttgcctgaggcgatgacgccgcgaatccactcgcggttggctggatcgttgaggaagcgtttgacctgaatcggcactgctttcttgaccacgccgccgccataggtgggcaccatgatgacgtacggttcgcggacgtttagcgccgggtcggcggcccgcaacgggatgcggtagacgttgatgccttcgtcctgcaaacggcatccggccacgaaccgtgcggtgttttcggaggccgacgagaagtagaccaatgcgccgatcgtcttgccttcggccgcgaattcgggctggctcagactcacgcggacaccgtggcggcggcgcggttgtcggcggccacctgctgggcgacttcgcgaatcaggtcggggcggtagccggtccaggagttgtccggcgtgatgaccaccggagcctgctggaaaccggcggcctgcagctgctcaagggtggaggggttctgcgtcaggtccacggtttcaaacggcacacccagcttggtgagctggcgcttggtggcatcgcactgcgggcaatgcggcttggtgaacacggtgacggtcatggcgactccccttgatgtggttctgatgaacagtgaagcgaaggccatattacagcggtgtgatttgaaatcaaggcactatatgtagtggcgcgtgtcacataacaaacctagatatagggtttttcgttgatattccgccattcccatgcacccccgaaaatcggcgtgcagcgacccgcccaatcacatgtggcattgttcacatttgcgtttgaaccgctcttcgactgatcctcaaccgccctgcaaccgccatcttgagtttcgaggggctgttttgaccctttccggagatctatctccgtttcgaggggctggtactcaagtaagcgcatccccaaaatggcggaatgacggtggggcgaagccgtttatacccgtgttctagcgggccaccagcccctcgaaacgggagtaaacctctacggaaggccaaatcagcccctcgaagcggagaacggatacctcggcaccccgtgtggagccagaaggcccggccggatgtccaaacgagcatccggccgggccttaaaagtagttgttcagttatcagaatcgatgcggcgcgatactactccgcgtctttacggctccaacagatcttcgatgcggcagccaagcgtgcgggccaaagcgagcacggtggagacggcagctttgccaaggtctttgcggcgctgctcgtacatttggatggagcgcagggtaacgccggagcggcgggccagcccggattggctgagtccggcgcgcacgcggatcgtgtgcagccgggagtcgccctcggtgcgattatgggcggcccgctcgtcgtacacgtcgacgaatcggctttcgtcggcttcgtgcagagtcgggtgcagtcgcacgatatcgtcgagcgacagcacatcgagaatgtccgagaaccgcactcccctggcccattggcagtatgcgagtacccatccggcccagtattcgggtgttgagccggcgcgcagtgcggctggcggcatatcgagaatgcgcgcccaaccggtttgccgcatgatttcggccaccagctcctcgccggacatgccacacacgtatttgggcgtgcctcgcccgaaaagcgcggccgcctcggaggtggcgaagaagtccatgaataggccgaccggcaacccgcaatcgttcagcgcataatcgaaggcgccggccaagttggccatggcgtccggcaagtatgtctcatcataggcggggatcatcgttggtcactttctcgcggatgatgtcgcgcatgaacaggccgtcgagatcggcttctgcacttttgcggcggtaggcttcgcgagctgtgcggtcgcgctcgttacgcaatccgtggtaggtcgaagcgcgggcgatttcgcagccttggaaccgcagtgccgcgaatgcctgaggactggcgagtacgatctgcttgccgagctcgcccaaccgcatcgcctcagcgagttggtcgatggaaatcgcgttattgacaaaagcgcgggcgaacgagaaatacgaatcgtcggcacgatatccgacgatgacgtcagcctgactggcatccggcagaaacacttgtttcagatattcgatgccttgcgcggcgacggcggtggtcggctggaaacgacggttttcgaccagcatggccagccagttcaggatggtgtagggcggctgggacaggtccaggaagaggagcccgtccgtggtcaacgtgtaccgattcgcgaaaccgtcatccattcccgcgcacgcccattccttggccagctcgacgctgcgcgtgcaatagaatccgcggccataatcgttgttcggcttgaccagcccgtattcaggatgcttgatgacatgcgaagagccatgccacagttcgatcgatgcggtctccattggccggctccttctctctccttacatattcttgattatatcactgtggtgatagtcataagggaaatacgagatgaaaaataccgctgtatacgttcgtacacaacgtgaaatgtatacgaacgtatacaacactgatgtccggagtcatgctccgcagtggcgcagcggacgcgccactacaatcggaatatgggactgaagacgtggaagaagtggacggactggccgctgatggtgctgtccgtggtgtttctggtggtgtattcgtgggaaattctctcccgcacgcatatcgcgctgtgtgaaaccgtcatcaacgtgatctgggtggtgttcgtcgtcgattatgtggtctcgctgtggttggccgacgatcgctggcagtggttcaagcacaacctgttcacgctgctgaccatcgcgctgccgatgctccggcccttgcgactgttgcgtttgctgaccgtgctgcacgtgctgaaccgcacctccggcatggcggtgcgcgggcgcatcaccgtatacgcggtcggcgcggtgggaatgctcatgtacgtgggcgcgctggccgtgtattccgtggagcgcggggcgtccggatccacgatcaccgacttcggcacggcgttgtggtggtcgttcgtgaccgtgaccaccgtgggatatggcgacttctcgccggtcaccttccaaggcaagatcattgcggtggtgctgatgttcaccggcatcgcgttgatcggtattgtgacggccacgctggcctcgtggatcgtggatcaggtcaatctggagacggatcggcgcgaggacgctcgggagaaggaagtggccaaggaagccgcgcaagaggctattgcgacatcagccaatcccgaaatcgacctattgcgcgaggaagtgcgtgagctgaccgctacggtagccggtctgcgcaccgaacttgagcgacgttgattggcgaagcgggacaaacaacgattctgccaagaaggtccgcgtcagttgttgtcaccgcggattgcggcagaatcattgtcgccacggctgttttcttcagtcggctcaacccaacttttgataatttttatttttttgatatttttgataatttttattttaggttgattcagcgaggaggcggtccacatgaaggcaaaggaaaacccattcaagccaacggcaggaggggaaccgcccctgctcatcggccgaggcaaagttatccgcgatttcgagaaaggtctcgataacggagtcggtgccccagggcgcattatgctcgtcaccggcgctcgtggaaccggaaaaaccgtgatgctcactgtgttcggagaccgggccaaagcgcgcagatgggatgtcatcgaagaaacggcctctgccggactatgcgaacgccttgttgatgccttacgaatcgggcgaggggcccttgaccacctcgctatccgaccatcgttgacttttgctggagcgggcatcggcctcggagaagccgaactatccccgaagcgtatgcccgaaacgttgagaagtgccattgccggacggttggatgcgcttgagaagcgccatgctgggttgcttatcaccattgatgagactcaagcggctgagcgatccgacatgattgccatcgccactgccatacagcatcaaatcagggaacgacgcaatatcgccatcgtgttcgccggtctcccacagatgatttctgatttgttcaatgacgaagtcatcacgttcctacgtcgcgcgaaaacgaacatactcacagatattcctcttgatgaagtgcgcgatgctttcgccacaacattccgcgcctccggcatgtccatcaccgacgctcaattaagcactgcagccaatgtgacagccggatacccctatatgattcaactggttggctaccatatctgggatgccgcagacatgcgggactcggataccatcatcgacgctgatgttacggcaggtatcgaggaagcacgtattgaccttgataacgccgtgtgcatcccggagttgcaaggcttatccaaaaacgaccgtgagtatctcgaagccatggcagcgtcagatggtccctctcccaccgtgaatgttgcacagcgcatgggcaaaacgcctaactatgccgccacctaccgcaaacgcctccttgacgccttcgttatccgcgaaacagaacgaggcgaagtcgattttgccgtgcccttcctgcgcgaatacttgcgtcggaatcagtaatcggcacaatgcacagtatcgatatattccgttccatataatgacttttcgcattcagatacacaatggacggcctgttgagtagcactcagcaggccgtccattctatttagctattcagttatcggagacacacctcaggccttgaccggagcgtcagcgggagccgatgccgccgcggccagtttgcggcgcttgaggtacttcatgatggtcaggaccatgccgcggaagccccactcgccacgcaggacagtgttgagcagtccggagtgggaaccgccccactccataccgatgtagttgaaggcgctcatcacggcacccgcgccgccctgcttgacgctcatctcgaagggcttcaggtagatctcgcgaatcgactgctcgttggcccaggtggcgagctcgctcagtcggttggtctcctggtcgttcagcgcgaagtgcttcatgaaggcgtacacgcccttggcctgagcgccagcgacctgctgggaggccatcacgccgaacaggtagccgtcttcggagaagtattcgaaggtacgaccggcgaagtcgcggcattcgaatctgatatcgttatcgattcgatcagcggctcacgatactgcccttgcatcgctgtgccactgttgaatgtgcccggctggctcacctttgggtcaccgccgacacatccttgatgccgatggttatagagtcgcaaattcacgactggcgcacctgcccacgcacctatcctgtcatttcgagcgcataatttgctaccacatccggtcagggcaatcgaccttaatggcgtaaacggcacttctcaatacgtaaacggcatttattcttggctcccctctcagagaggggagccaagaaatatcaagctcggcctcccaggagagagccagaataatgcaccagcaaggcattaggatggagggcatgagcgatttgaacgcgttgaatcttgagtccggcgaagtggttggtgggtatacgctgatctcccggctcggctcaggagctatggggtcggtgtggcgggtgcgcgacgacggcggcaccacctatgccatgaagattctgcgcgactccctgaccgacgagtcagtggcaggctccggctctgcgtccacggccctgcacgaccccgacctcaagcccgatgtcacgccgcgcgagcgcctgcggcgcgaggccatggccttgaagaaggtcaatcatccgggtgtgtgcggcatcgtggatatggaactcgacgatacgttggcgttcatcgtcactgaactcatcgagggcaagaatcttaaggatgatgtggccgccaatggccggtatgtgggcgacgatctggaacgcttggcccgcaagctcatcgaagccaccaaagccgtacatgcggccggcatcgtccatcgcgacatcaaacccaccaatgtgatggtgtcggccgccggaccggtattggtcgatttcggtatcgcgatgggcgagggcgaaagtcacgtgacccgcaccggcctagtgatgggtacacccggattcatcgcacccgagattattgacggtgccgaatccgacgacgccaccgattggtggtcggtggcgtccgtgctcgcttttgccgcaaccggcgcgcctgtgttcggcaccaagccgatgatggcggtacttgagcgcgaggcctcgggcaacgcgaatctttccggactaccggccggcacattggctgccttccgttctgcactggacccggatcgcagggatcgttgcacgccggatcaattgctgaatgccatcgccttggatgcgttgaatcccaacgcttggcagggcgagcaggcgggaccgttcgccgcgggagccgtggctggacaaccggctgcgatcgttgccgaagccgcggaggcgatgcccccttttggcgcggccggcggcgttgaccgcaataatccccgaaccatctggcgcgcggccgaggaagccgctgaggctcccaccatggccgtgttctccggcaataagggcgataacggcgatggcgaaaccgtcgtattctcgccggctggcgccgctaccgccacgctgcccttagccgatatgccgccacgtccgccggccggtgcggagcaggccacgccgctggccgagcgcaccaccgtactccccacgccgcagccgtcatcattccccccgtccggcaccgcccagagcagctgggatcccgcaagcaaccagcccacagcggtggaccccgccattcgcccggcattgcagcgcatcatcgaccaaaccgcccaagcggcccccaccgaaaccatggtccaaaatcctcccatgcccaatccggtggacgtgaagcgaggggaatatctgcagcgcggcaccctgccattgatcctgctggcggcgccgctggcggcactggcggcaaatgctccgctcgtggccatcatcgcggccactgcgttgttgtggctactgctcaccctggcctataacaccgaaccccagcttgagcgcgagggcaaacgcggcggcgagcgcaaaaactccgattcgtggattcgcgtggcgacttttccctggcatctggtcaaagccctgctgctggccattccccgcatactgctgctagtcatcatctatatggcgggaaccgccgtggccaccgcggctctggcactgcccgttcacaccatctcctggtatttcaccgcggattggggtattccggtgccgttgctcaatgatgtgccgttctccgcttccgggctggcgctgggcggtttcatggccatcggctggctggtcactgtgttcgccccacagtcgatgatgattcggctggggggcggcgtactgcgcgggctcaaacacagtcgcccggcgggcgcgccatccaccgaagtgggtggggctccacctgctccagtggcgccggcgcccaagggcggcgggcgcggcaccgtgctgttcaccatatgggccatcatcaccgtggccttgtgcgcgatgccgattctgggcatgccgatcaactggatgccgttcgcctagagcggggcggaatctcacacatcagccatccgcacacatggccgttgtgtatccgatacgttcgttccgtcacacttttacagggaattcacctcagatcagctctgggcgcagtcctcctcaggcccggtcattatgatggggcccaaacattgaagcgattgcaaggggatagctatgtcagatccgaagcgtcaggccaagcgtgccacacgcgctgagcgccgagcgaccgaggaggccgcccagcaggcacgggccgagcaggcagccaaggagcgtaagcagcagaccatcatcggctgcattgtggtggccattattgtggtgctggtggccatcgctggattcgccgtatacaaggctatgcggccgtccaacaccagcagcagtagccagcaaagcaacatgaccgtggacgaggcctatagcaagctcaagaaagtcagtacccagccggctaacgccgacgacaaggccggcttcgtaatctccaacaaagggtatggccagaaagccgagggggctcccaccgtatccatctacatggaaccgctgtgccccggctgcgcctcggtgaaccgccaactcgacccgacgctcgtcaagctgatgaacgcaggccagctcaacatcgatttgcacttcctcaatttccagaacaacaagagctccgacaactactccaaccgcgtgttcaacggtgccatctacattgccgagcatgatgacgatcccgaccacctcatgagctacctctccaacatctacgctgaggatttccagccgggcgaattgtccaattacgagccggtaaacaacgccaagctggagaagcaggccgtcaaggccggcgtgagcgaggatgtggccgccgcggcgttcagcggcaagaacgaatacctcgactggctcaccgcctccaacaactacacgatcctgcgccccgaactgttcaacagctccggcgccttctccgcccccacactcaccatcaacggcgaatactgggatctgaagcagctcacgctggcggacacgaatatggtggacggcttcctcaagtccattgggctggatgctgaccaggtaggcgtggaaggcaaaatgccatccatcggtgccagcggaaagccgatttcggtcgcctcctgatgctgcgtggccgaataagttgacgccgcgacatatgcaataccgcctgcggctcggcttaaattgaccactcgggaagtaccggtatactagtcatttgttcgcaacgatttacgcgttaagaacaatcgcctctttagctcagatggccagagcggccgccttgtaagcggcaggtcgtcggttcgatcccgacaagaggctcgacgcgtagaaaagtggcgtattatatgatacgtagatttttctacgcatataattcttaccttgggtaagtactccaggagccttcccccaactatgggcttcctggaatgagggcggagcgtcccccaaccagctccgcgccttcaggggggcgggaacatccccttctctcccgccccctttttcttttcttttttgagctcagaacaatctgacgagcaggaatggtgacggtggccggtgaaaccgcagtacgggccggaacaaccgttacgatgggtggcgtaatcgttcatccagcaggaagagtatggcaatggcacggcgttggaccccgcagcggtttgttacactgcgtcgcatccgcgtaatcgcctgtatcgcggcgaccagtatcgcgctggctggatcattcgcgttcaccgcgcgtaaatccgtggccctgaacatcaacgggcaaaccacccaagtcaccacatatgcgatgacggctacccgtcttctggaggaacaaggggtggatatcaagacccacgatatcgtcactacctcgtccggcgaccaactcgccaatcatgccgtggtcaccgtacagtccgcctaccagaccaccatcaacatcgacggcaccgccgtgccgttctggaccgtggccaccagcgccgaccagctactgggatttttcgaggaaaaccagaacaacgccgcgaagatcaccgtcgacatcaagaacgtgtacaaccagctcaccggcggcctggtgatcaaccagtccgggccggtcaccgtcatcgccgacggcaaaagctcggtggcccccaatggcaagctgccggccgcctccatcctcgattccaagggcatcgtgctcaacaaggaggatcgcgtcagcgttgagaaagacagcgacgagaccattctgcgcgtacgccgcgtgacccacggcgaggagacgcgcacgtccgtgattccgttctccacccagaccatcatcgacccgaatctggctgaagggcaggccgatgtgcgccagcagggcgtcaacggcgagaagacgcaggtgtacgacgtcacctatgtggatggcgtggccgaatcggagacgctgaaatcggagaccgtcacctcgatggccatcgaccagatcatcgccgtaggcgccgccaagtctgataccgataaaggttccgataagaaatccgactccgccgataacggcaaggccgattccggttccaacaatcagcacgagtcgtccaacaacaatgccggcaacaccggcggcaacaactccggcaacaccagcaattccggcaacaccggcggcaacaactccggcaacaccggcaattccggtaacactggcaacaccggtaacaccggcaactccggcaacactggtaacaccggcggcggtacgaacaacaattccggctcttctggctccgattcaggcacaaccaccacgccctccggccgcctgtggcacgccaccgtagcccaggctcaggcctatgccgccggtgccgccgcgcagcgcgggtggacaggcaacgactgggattgtctggtcaaactatggacccgcgagtccagttggctgtggtatgccgaaaacgcaagctccggtgcctacggcattcctcagtcgctaccagcagacaaaatggctgcgttcggtgccaattaccgtgacgatgccgccgtacagatcgattggggtctgtggtacatcgcacaagcctacggcagcccgtccaaggcatggcaacattccgaacaagtcggttggtactgatcggttacgaagcccacaaggaacacacgcttatgaacgacaccattcccgccactggtcacctgttaggtgccgccgatatccgtcgtatcgcggccgatgccggcatcagccccaccaagaaattcgggcagaacttcgtcatcgaccccggcacggtccgtcgtatcgtacgcgaggcgggagtgaccgctgccgatcatgtcatggaagtcggccccggcctgggatcgttgacattggcgattttggaaaccggcgccaccatgaccgcagtcgaaatcgatccgccgctggccgaacgactgccgggcacagtcgccgaattcatgcccgaagccacgtcacgactcaccgtcgtcaatcgggatgccttaaccgtcaccccggagaacgtgcctgatttcagcgatgacgcatcgtttacgctggtcgccaatctgccgtacaacgtggccacgccgattctgctcacgctgttggagcgtttcgacaacctcggctcgttcttggtgatggtgcaaaaagaggtggccgacagactcgccgccaagcccggttccaagatctacggcacgccgagcgtgaagctcgcctggtatggcaccgccgaacgggtgggcaccatcggccgcaatgtgttctggccggctcccaatgtggattccgcgctcgtcaaattcacccggtatcaggccgatgacccggctgccccgggaactgcgaacagcacagacgacggcacacaacgggaactcgtatttcgtctgatcgatgcggcattcggtcagcgtcgcaagaccctgcacgcggcattgaagaccattgcgccctccgaggcattctccatcgccggcatcgatccgacccgtcgaggagagacgctcaccatcgccgaattcaccgctctggccaaggccatcgaatcgtgtggagatggagatgaggcacaatgagtccggtaatctcacatccacgctcagccgctgcccgacatcagtccgatgagctctcccccatcaccattacggtggattgcccggcgaaaaccaatctcaccttggaagtgggacctgctcacgacgaatggggcggacgccacgaactggacaccatctactgcgcaatcggcgtatacgacaccgtcaccgcaaccgccaagcaacccggagcaggattctctctggagctcgaaggcgcttatttgggcgacttggcctcctcacgcagcgacatgcgccgcaaccatgcggtactggccctcttcgccatggcccaggcggccgagcgcgagccggatgtggcgttgaccatcaccaagcgcattcccgtgggtgccggactaggcggcggttcagccgacgccgcggcgaccatgctggcggtcaatcgtctctgggagctgaactggcccatagagcgcctgcgcaccattgctgccacgttgggcgcggacatgccgttctgcctgaccggtggccttgcatacggcaccggtttcggcgaacgcatcacggatatcgcccccggcagccgcgatgagctggcgctgatagaacagggattcagcggcgaagtattggtcggcgcataccagtcgcaactcagcactcctgaggtctaccacacctttgacatcgtgggagccgcagaaggcgaccgcaatcatctgcaggctgcggcaatcagcctgcatccccgcagcgggcaggccatcgacgccgccacgcaggcgggtgccagccatgcattcgtctccggatccggcccctcagtggtcgctttcgccgccgacgaggcagcggcacaacgcattatcgaggtgtggcgcgatacagctgtggtcgatcgtattattcgagccaaatctcccgaacaccccaatatcagcgtcagacagtgacgctaaggtagcaaccagccacccgacccatgaaagaagtccaccgatgacgtatcaggttgatgaacgtgaagcccgcaaggcgtacgtgcgccgccgccagaccatcgtcttttccatcagcggcgcggtattggcagtagtgctggtcatagccctactgttcaatttccacgttttcggcctcggcgaagtggagactccggccagccagccgaattacggcaacgcggcgccgtgcgcggtcaaggacagcagcggcaaagcgcaatacgtgtccaacgcttcggtcggcattcgcgtgatgaacggcacctctcacggccaattcgccaaggccgtgggtgaagctttggccaatcgtggattcagcgtgcagaaaatcgataactattccagcaccgacgttgaacgcaccaccatctacttcggcaagaacgccattaatcaggcgtatacgctgatcggcaatttcaccgacgccaccatgatcatgacggctcgcgaggatcagctcatcgatgtggtcatcggcgccacgttcaacgatctgcaggacaccaactccttcccgcaatccggtaagaccatcaccaatatcgagggttgcaaggccgccgatagcatgaccaagctgcccgccgacaccaaacacgacgcatacacggcgcagtaaggcgcatacagcttcatcttcgcgaaaaaccgtacgctgacacgtattcagcgtacggttttttggtatcggactagtatcggactactgaatctcggcgtaccagcgcttgagttcttcgacggccacatcgtggtccaccggaccgttatccaagcggtattccagcatgtgcttgtaggcgcggccgatcatcgggccgggctccaggcccagcaactccataatttcgttgccgtccagatccgggcggatcgcgtcgaagtcctctttcttcttgagttcgcggacgcgctcctccatctcatccatggcctgggagaagatcatcgccttgcgtttgttttgtgtggtggcatccgcacgcgtgagcctgttcagccgctcatagaggtgcccggcatccttgacataccggcgtacggccgaatcggtccacggctcgtccacatagccgtggaagcgcaggtgcatattcaccagttccgagacgtcctcgaccagatggtggtcaaaacgcagcgccttcaaacgcttgcgggtcattttggcacccaccgcgtcatggtggtggaagctcaccttgccgcccgactcgaaccggcgggtcttcggcttgccgatatcgtgcatcacggcggccaagcgcagcgtcaggtcgggggcgggcaccgggccgtccgggccggtttccagggcgatagcacgttcgagcacaatcatcgtgtgctcgaagacgtccttgtggcggtggtgttcgtcgatctgcaattgcagggccggaatttccgggaagacgatgtccgcaagaccggattcgaccaacgcctcaaggccggcgcgcggacggtcggagagcagcagtttggtcagttcgtcgcgcacacgctcggcggatacgatgtcgatgcggtcgcgcatcgaggtaatcgcctcggccgcgtccggcgcgatacggaagcccagctgggccacgaatcgcacggcgcgcatcatacgcaacggatcgtcgtcaaaggactgtcgcggatccaccggcgtgcgcaacacgcccttggacagatcactggcaccaccgaacgggtccacgaattgcaggtcgggcacgcgcagagccatcgcgttgacggtgaagtcgcggcgggacaggtcgccctcaagcgtgtcgccataattgacctcgggcttacgcgagtccggatcgtacgtgtcagagcgataggtggtgacctccaccttgacctcggtgccgtccgggcggcggcgcatggcacccagcgtgccgaacttgcgccccatgtcccagaagccgtcatgcccccaccggcgcagtatcggctcgaactgctcaggccgtgcggatgagcagaagtccaaatcgtggctctttctatggagcagcaaatccctgaccgggccgccgaccaatgccagctcgtaaccctgttcggcgaacagtcgaccaagttcgatggcttcaggccatacttcgaaatccaatgggcaccttcccgcgtgcgacgtttttctgccctaccagcataccgttaccccacctgcacacggggttgagtaaggtggagaatatgattacgcccgccgaccttgcccgcatgctggggcaaacaccagattcggcggatagccatacccaagaccacctgctgtatacgtccgaaactccgcatcattccgccgattcgggcgattcttccgatgtcggcggcaccgcgagccactccaccaatcaggccgttcatcaagacgaagtagacgcagtaccgactgcgcaacattccggtgtgcctggcacacccgcaacgcccgccacacccgaaccatccgaatccgaaatatcggacgccgccagcgacatgcccgcaccgaagccgatgatgcccacaccggccaccgtcttcggcatgcatgccaccgtcaccatcgccactaccagcggcactatcgaggggcaggctgatggtatcgccggcgaggccggtgccgagacgattgccgaggtcgagccgattatcgccacggcacaaacgtccgtaaccatcgtcacgaacgatcccgcggcgaccgctcacgcggccgtagatgctgccgttgcggtcgccaaggccgccgccgcgcacaccacagcgataccgactccgcgcgacgtgctgatgccgcctgcggcacgtaccgcaccggccgcaacgccggtcaccatgccggtctcagcgccgtctgcagcaccagtgaggcccgcaacgtcagcgcatcccacgccggccacggtcttcggccggcacccgtccggagatgttgcctcgccggaaccggcagtgccggtagaaccggtgacgccatccggcccgactccggccatgatgccgcaacgccgtacgtcggacggtccgaccacattcgcttcactggatgcccaggaactgccggtcgtacgcgaatattcggcaggcggtctgattttcgatgaccagaaccgcgtggccattatcgcccgtcattcccgctccggccatctcgaatggtgcttgccgaaggggcatatcgaaaaaggcgagaccccgcagcagaccgctgtgcgcgaagtgcatgaagagaccggcatcctgggcgaggtgatcgattccatcgccaccatcgactactggttcaccggtaccacgcagcgcgtgcacaagctggtccatcacttcgcgctcaaacagaccggcggtgaactgacggtggaaggagacccggatcatgaggcggaagacgccatctgggtgcgttttgaagatttggatgacgtgttgagctatcccaacgaacgcaaaatcgcgtggctctacgccaggaagaagaacaggcaggcaaacgagtgaacctacccggagtcttacgacattgcacacgtctggcacacgcactggcggccagcgtcgccgttgtggcgatgctggccgctccattgaccgtctacgcgaacgatacgacggacacgactgattcatccgatacgacggacgcaacgggcaatcagaccgagaatcagcccaagcagagcattgccatcacgcaaagcacccccatcgtcacctccaaatcgggctatcgtgtcaccgcggtcatcagcaatacggacagcacggccacgtcaagcggcacactgcacctgaccaccaatgcgttgttcacctttgtctcgcgcaccgatattcagaattgggccgagaacaacgcccccatcccaacccccaacgagttgggttccgttgacgtgccatcgattcccgccggcggcactgccaccgtcaccatcgaggtgaacgccaatcagcagacccttgcctccatagggagttggggaccgaaaccgctgatgctgtcgtatatcgttggcaatcagatactcgccgatttgccgagttttctgacccgatcttcggatgggctcaacaccgcgacaacaccggccatgaacctgaccgtggccatgccctacaccgccagcggctggcaggtcgataataaggccatcagcaatcgcattgccgaaaccaccacttcctcgacatcaacatcgtccaagtccaacagcacggacaaggccgacaagtccgataacgccgacgccagcaacgcggccaaagccactgatacgcaagccatatccttatccgaacaggatgccgataccgcgcgatcccttgggcagacattcgccaagcaccgctcgctgcaagtgatcgcggatcctctgtattggcgtcagtccgcagtgcaaccgtccattgccggcatcatgcagcccgccgacttcgacatcaccgcctataccgcactggacgataccgcggcctacgaaaaggccggcatcaccactgagcagtggaacgccaagcaggcggccgcatggtatgccgacggaggcgactccgaaacaccctccgcgtacgcatggcagggcaacaactgttggacgttggatgcgctgaccgcagcacgcgagcagggctatgacacggtgattgccggtgcctctttcgatgccgaccagactgaagccgtacacacaggcacctacgtggtgcatacgcctgccggcgatgtcaccgtgctgaaggagcaatcgaccttgggcacgctgtccaagggccaagccaccagcacggacgcgcaggccgagtccagcgatgccggtcggttggcccgactggtcgctcagagcgcgttctaccagatggaacagccctatacatcccgatacctgcttatgacgttctcccgcaccacggaggccagctggatagatcaggtgatgagcgccttcgagcaggcgtcttggttgaatctgacggacctgaagaccatggccaaggccgatccgtacaatgtcagcgattcggtcaatcccgacaaggccgatgatgccaacaccgccaatacccggtcggcattgagacagttggccgacagccggcatgacatcatgcgcatggccacctccatattgaggaacgagattgattccgacgaggtctcgtcgttggacccgcaggccctggcccggcaggacgccaatgacaccgcctcgcatagcaacgatccgacgcaatggattggctctttactggtgctgcatgacgatatggcgctgcggtccatgtctggctccccccagccgacagccacgcgaaaagccatggtcaaagccacgaaaacactggccagcgatcttctgaacggcgtacgcatcaacccatcggaatcaatatccgtgttcagcgaatccgcgaaaatgccaatcaccgtcagcaatgaccttccctacgccgtcagcgtgcaggtcaactcactgactgactccatgcagatcgtcacctcgcgaaccgctgacatcgatattccctcgcatagcgacgctcaggtgaccttcaccatccgcgtttccacttccggctcatcgacggcccatgtgtcgttgaccgaccgggaaggcaacagcttcggcaacacgcaggacaccgcgatcaccagtgtgatgcgcatcagtgatgccagcggcttcattatcatcggcttcgccgtgctactgggcattatcggcctgtggcggcagttccatcggaagaaggaccccgacgaatgagttcaagcgtaggtcgtaattccctgatcatggccacgggaaccgctgcttcccgtgtgaccggtcagctccgcacgattcttctcgctgcggccatcggcaccaccggattggcggccaacgcctatcaggccggttccatgattccccaatccgtgttcacgctggtgtccggcggcatcttcaacgccgtgctggtgccccagatcgtgcgcacgttgaaagaaaaagacgcccaagaacgactgaatcgcctgattacgttggccatcggcatcctattggccatgaccgtggtgatggcggcggccagccctctgcttgcccgcctgtacgtgggtagcgacgatcaccagatgatagccctgaccacctcgttcaccctgtggtgcatgcctcaggtgttcttctacggcctgtatacggtattgggtcagatcctggccgccaaagaccatttcctcacgtatgcgtggagctcaaccggtgccaacattattagttgcgccggttttactggctttattctgctgttcagcaaggccaatgaacagcccctcgaattctggaccgccgacaaaatcgcgcttaccgcaggcacctggactttgggcgtggccttccaagcgctgatactgttcctgccgctggcccgtatcgggttcaagtacaaacccagcttcgggcttggcggctttggactcaggtctatgggtcccgtggcgttaggctctttgggcgtggtgatcaccagtgagatctgcggcattatccttacccgtatcgccacatccgcaccgcagcgcgcccacgaactgacgggtgccagcctgttcagcgtggcaggcaacgcgacctatcagaatgcgtacacactgttcatcctgccctattcactcatcgccgtatcggtatccacggctatgttccccaaaatctcccgttccatcgcagctgcgaatctggatgaggcacggcacgacctagtcagcgcactgaataatgtgggcctgctcatcatgttcttcgccgccgccatggtcgtgttccccgaaccgatcatccgtgcattgcttccgtccgtctcgatggacgagactatgttgatctcctatgcgcttatcgccttgtctatgggcattccattggggtcggcgttcctgctgatccagcgcacgttctacgcctttgaggacggccttcaccccttcctgtccgcggtgatgcagtatggattcacctcaatattcatgatcatcggcatgatggtacttcctcctgagcattgggtactcggcatcgcctgctcggtgaccctcggtggattactggcgttgccgctgacgttgatgatgttgcgccgcaagttcgaaggcaatcttggcggtcgggagatcacgaggacatatgccaaggccattgtggcggcactggcttccggagttgtggtctggctgatcaaacgaccggtagtcgcactgctcggcgcggatattcgaccagtaggcgggcacatgagctggtggtctgcgctggtcatctgcgtggtgctcaccattgtgctggccgtagtatatgtggctgtgttgtgggtggtacacaccccggaactcatcagcgcctatcactcgatactggcccgtctacacaagactccggccagtgaggacgttgctgtgacagcccagccggaaaaaagtcgacgctacgtaaatcaatcctgagacggagcccgtcaaggatagccccgcacgtagaatatctaagaccaatctcgaacaccaatcacacggagccgaacgcactatgaaaccgcaactcggagacacgattctcaaccgatataccttggtatcatcgttgcgtgaggagcctggcattcaggcatggaaagccaacgaccgtgtgctggcaaaggattgccagctgttcatcattaccgatcgcagcgctttcgccgcaatcgataagctcgctggtcgcatcgccgccactcgccctgatcgtgtgattcccatactgaaataccgtatggaatccgacgtacttctcattgtcatgccggtggatagcggccaatgcctgactgactacatggtagataccgccaagccgctcagctacagcgccatccggtcgattatcggagaatgcgccgacgtgctgcgcgaggtcattgcggatactcccagcggcatcgtcatcacaaccgacaccgttcgagtgactacctccggtgtgcaaattgccgatgcaccatgtgccacgatgctggccgatacgtccgctaccgatctgcgtacggacggtcctgaacggtatgcgattcgccagcttgcggcattactctataccctgctgacacgcacgccaagccaagcgacacccacattcaatctgcgtgccttgccgcaagacacccctggcgaattccgcgtgatttgcaagcgtggattggccttgagcgagcccgacgatcatacgttgccaatggctgcccttgtagaactcgacgccttgttgggtaattggaagccgctctctgaactgagcgatgctgatattgctttgccgagcgtggaaagcgattgctcgattaccaaggcgatactgaagcctgccaacgagactgatatcgtgcctattcccagcacgttgattaacagcagcagtcttccggaattgtctattaccccttccctgccggttcagacggccgccgtccccgctccgcacgcgatgtcaccggttcctctgcctgatgggtccagtactgctgacggtaaccagtctcagtctgatgcccgccgtctgtttgacttcaacctttctgacgcctgggagcacgaaaatctttccggtgaaggcaccggtgactggtacagcgaaatgaatccggcccccatcggcggtccgggtgataatactcggttgacagtgcctattgttaccggcggtattcccgatgccaccgtgggagagacaaccagtcgtattcccgtgttcgacgccagcggccgtgctgtggctcctggtgaggaatcgctgcgtgccttggaagaggagcaggcccgcattgccgaagtaagcgccattcctccgagcttcacaccgaaggatgtgccggatgacgaggttgacagcaagctgcccgatgaacatctgttcggcaaactgtcgaccaaggtcgttgccatcattgtggctctgatattggtagtggcagcggctgtttgggcagtgcatgcgttccgatcctccggagacaatcctgccgatgcttccagcaactccagtgaaggtgactggcctgatatcaatgctgacgctgtgccatttggtggcagcgagaacgcgacgaacggtggcaccactgacgattcttcaaaatcgagtgatgccactcagagcgaatccaaggactcggcatcagacaagtccaagaagtccgagactgctgattcgtcgtccaagaagaccaaggccaagaagtccggcgataaggattccagcgctgttccgcaaccgagccatgagaacaacacggcgtttacgatttccagcgccaacttcctgtcgaatcctggcggccaatccgggtacgcatactacatgcaccttgaccagccgcaggatgcgtaccgcatggttatcaccatccgcacatccggtggtaagggctatattcgcgcaaataccactggggaccccactcaaggcaagcaggtggccgaattcacctttgctgaaggtggtactactgaggtgaagttcaccaaagccgtcaagacgcaggatctgctgctgtgggtgccatcggatagcctgccgcagaaccagctgtacatcgaaaaggtggaggtcttctaatcggcatctatgccgataactgacccaagaaggggcggtaccgttcgcatacattcgacggtaccgccccttcttcgcatctggctgaatgacacggaatatcgtatgggggtgtgacaatgtttcacgtgaaacataacgtcatcattatcggttctggtcccgctggctacacggccgccatctatcttggccgcgcaggtctcaatcctgttatggtcactggtgcgttgtcgccaggtggacagttggtcaacaccactgaggtggagaacttccccggattcccggaaggtattcttggcccggatcttatggatcgcatgaaggaacaggccaagcgcttcggtacaacctatatcgcagacgatgtctcttccatcgaggcgtgtgagagtgattcggtcaagccgacctatcgtgtaacactctccgatgactcccaattggaggcatcgtcgcttatcatcgccacagggtcgtcattccgtaagcttggggtgcccggcgaacaggagctgtccggacatggcgtctcgtactgcgccacctgcgatggcttcttcttcaggaacaagcctatcgtggtcgtaggcggtggcgattcggcttttgaagaggcattattcctgacccggttcggttcttcggtcaccttgattcaccgacgcgatagcttccgcgcctcgcagatcatggtggaccgagccaaagccaatccgaccatcactctgatgaccaacacagtggtgacctccattaccggcacctcctcccccacacagaacaccggtgcacctattgccattcctggcttgacgctcaaacgaccggctgtagcaccggccagtgtcagcagcatcgccgtacgtaatgtggtgaccggagaagaaagcacgctggacaccaacgccgtattcgtggctatcggtcatacaccagccactgattttgcggccggtgttgtggaccgtgacgatgatggatatgtcgtggtgcagggtgccagcacggtgaccagtgcgccaggcatctttgctgcaggcgattgcgtggatcgtacttatcgtcaagcgatcagcgcagcgggcatgggctgccgtgcagcgctggatacgcaggcctatcttacggactgatggtggcggactgatggtggcttgctgttctggctgctgcctgtgacataggagcaacgctaggtcagtgttacagcatgccgcccttggatagtacgtatcggtcaaaggcatagaaagacccctcaggcgacggagaatcacgatgtgtgattgtccctccagcctgaggggttttctattgcgacaggggctacagcgcgggcatacgcccctgccaggaatcacgcagaggctataacgtcttgcgcatacaacgcactgcacagcaataatgccggcgacaacacgaatgttcttatcgtgttacacccatttggaatcggcatcgccttggctcggcaccagcagctgcaggatgcgatccatatcctctggtgacgaaaagacgatttcgatgcgaccatgcttggtgctgcccttaatcgacaccttggtatcgaaatgattttccaaactctgctggatggcggaaccaacccaaggattggtcttagacgtcttaggcttcttcggctgctcccccgacgcaatcttcatggcgacgatttcttcggtgctgcgtacagaaagaccttccgcaataatacgagaagccagcttgtccatttcctccggatcgctcaggcccaatagcgcacgcgcatgaccggacgatagcacaccggcagccactctcttttgcacagaagccggcaggttcagcagtcgcaaggtattggcgatttgcgggcgagacttggacaccgacttggacagttgtacttgtgtcaacccgaactcttcaatcatctgctggtaggcagccgcctcttccagcggattcaaggccacacggtgcaagttttccagcaatgcatcgcggagcatatcatcatccgcagtggttttgacgatggcgggaatcgtctccaacccagccaactgagaagcacgccaacggcgttcacccataatgagctcatacgggctgtccaaatgaccggcaaacggattcgtgctggattccgtctcgtcgtgcttggcggctttggccgcagcaatctggcttgccggacgcttgcgcacgactatcggttgcagcacaccaacttccttaatggaagcagacagctcattcaactcatcctcgtcgaagatggtacgaggctgatgtgcattgggcccgatatcagacagtttgagttcagccagataaccaccggctaccggcttgagctcgtccttcttatctgtgtcagcggtctttgccgccgatgcagtcaaagatgtttcacgtgaaacatctttgacagtgacggatgtacgatgtgccgtctgagacgcagacgacttgccgccctgctgaggtgcggcgaccttaccggtttgaggtttctccgtaccgaaaaacaggtcgctaggatgagtaatggtgtccaatgcgggcatggatgcgcgtttaccggcggctttcttgactgccttgctggacgatatcgtctgaggcacggcaggttttgattcctgctgggcagtagccttcttggcgggggttatgtcagcagtggcctccggagtagacgaatcctccgcaatcattgcgggctgctccgccaccggctcctcccctggcaatgtggggaacaaagcgccaaggcccttaccaagtcgtgattttgatgccattacttgttcctcctcgcatcaatggtgtcaaggacttgttgcgaacgctgtgcgatttccaaagctgcttcaccatacgatatggcacctatgccacgaggatcataggcaatcaccgattgggagaaactcggcgcttcggagatcttgactgaacgcgggatggtggtattcagcacaatgctgggatagtgtcccttaacctcgttatatacttcacggctcaataacgttcggcgatcgaacatcgtgacgagcatggtggacaccagcagtacgggattgaaatgctcttgcaccaaaccaatcgtgttaatcagctggccaagaccctccaatgcgtaatactcagcctggataggaatcagcatctcggtcactgcacacatggcgttgatgaccaagaggcccaagctgggcgggcaatcaatgaacacgtaatcatagtgtttatctgattgacgtaggtagaggtctagggcctccttcagcaacgtgtttcggttgggcagatcagccacttccaactcagcaccgctgagatcgattgatgcaggcacaacatcaagtgtgggaaaatcaggacagaccgtgataacatcacccagatcggaacgcccctcgataacgtcatagaccgagggctctcccgatgcatgagatacacccaacgccgtagaggcattgccctgcgggtccatatcgatgaccaacacctgcgcgcccttgttcgccagcgccgcagcggtgtttaccgtggatgtggttttacccactccccccttctggttggccacggcgatacgacgagtccgttgaggctttgggaaatcggttttcttgagtacatcgtagcgtgagctttcatcagccatttggctaccaagcactgaaccgtgaccatcgaatattcgctgaagcgtttcggaagccgattctataggttccgactgatgatccttggtggccatcgctcctccttgcacagacgtaagttccagtgttctcattcgtatggacatgatgctcgttatccacaattgcgatatgcaatgtggataagtgtggataagtgtgaatgacgttgagtgttagattatgtattcacagacgaaaaacattgaaaaatcaatgttttcatcattatgcacatcgtcccgtaaaaatgtggataacttttacgcacatatggaaatgtggataactcaatcagtactccactcatcgcttatccacaatcaccacgtgggtaggctcaagatccggcccgacagccgcctcaacgacacgtggacgacgaccaccgaattttgcaatctccttgccagccttgtcgatttcagcctgagcagaccgtcccttcagtgcgatcaactgtcctgacggtttcagcaacggcaacgtccagccagagagtttggtcataggagcaaccgcacgacacgtgacaacagcgaacggatgaatttcccgcttccgtacctgctggatgacggcatcggagcgtccacgaataatctcaacgttctgcagttgcatcaggccaacacattcatgcaaccattcgattcgccgctccatcggttcaatcagcgtgaagtcatgatccggcaaacacgcggcagccaccaatccaggaaaaccaccaccactgccgacgtcggcaactgttttgaagcgaataccattcgtcgcattccgaacgtacggcacaatcgcagcggaattcagaatatgccgttcccaaatgatatcgacgtcacgggggccgatcaatccacgaggttcaccctcttcggcaatcttggcatggaaacgctccaacttcagcaacgcatcacccaagacctcagcaagtacaggtgacccctgcagctgatccgtcatagccatctccctcaccatgtttcacgtgaaacaatcaacatggagaatggcgccgctcattacgacgccattctccatgcggtcactttagtttgttcaaagacgacatccgtcgaacgtccctgtcatctcaaaaaaactcgccgagcaattactcctgatcaagctcgtcgtcttcggcggtatcctcgactctattcttgagatacaccgtcacgtaacgatgaggctcctcaccgtgcgagcgagacttcagcccctcttcccgaaccacatcgtgaacgactttacgttcgaaggaattcatcggcttcaagtcatacggctcgccggaatccttcactgcgtcaatggcatccaaggcgatatcacggaggtgctgacgcttgcgcttcaggaaaccgtcgacatccacaatcagatgagaacgctcgccggtcttctgctgtacagccagacgagtcaattgctgcagagcatcaacgacttcaccattacggccaataagatgtttgatgtcagtatcgtcatcagcaacgatttgcacggtggggcggtcattacgcacgcccatctcaatgtcgccctcatagtcggcgatatccagtaggccttcaaggtaatccgcggcgatgtcagcctcttcgttgagctggtcgatcgacttcacgtcatcctgtgccatacgctactccttcatgtcgtgtttgaattccaagtctaagccctgctcccccgaacagagaaagtaatgtcggtgcgtgttgaatgtttcacgtgaaacatcgaactcgcaccgacatagtcgtcacttctttttgcgcttacgcacgggctgttgacgctgatagccctgagtggccttacgctcggcctcttccttggccttggccaatgcttcttcttccagagagggcaggccggcctttgcgcggcgagcattctcattacgatgatcgcgcttctccttgtccgccgcagccggagagccaggggtcgggaatgcgtacacctgccacaatgtgcggcagaggttgcacacgttgttggtcagccagtagaccagcacggcgaacggcatggcgacaccggagaagatgtacatcaccgggaagagccacagcatagccttctgcatggtctcggtctgcttgttcatcgaagcagctgccatgttgcgcttcatgctgaagtactgcataaaccacaggcagaaacacatcaggaacacgaagataccgatgaccgccttgccactagcggcagcactggtgaagttatcggtcacgctgacaatgccgaacacatcggtttgggtgaattgcttggcggttgctacgtcgaacgcgcccaacgcatcgcgtttaccgttggcaatgtatggaatggccgacagcgtatagaacatggacatgaacaccgggccctgaatgagcataggcaagcaggagccagccggattgacgtcattgtcttgatacagtttcatggtttcacggctcatggcctccctggaagcctgatccgtcttgcctttgtacttgttctgaatacgctgcatcttcggcgccaatgcctgcatcttgcgcatcgacttcatctgcttgtagaacagcgggaagatacaagcctgcaccaccagcaccaggatgataatggcaagcacccatgagacaccaatcgggctcacgcccagcatcacgaagaagtcatgcacgatcttcatgatccaggtctgcaaccactcaacgggagtcaggattttatatagaaatccccaaaacccgctatcaagcagaaattcatttgagttcatcgttgggcctctctttgggttgtggccaatggtgtcagtcgaggctcttcatgagccttcgaccacgaaaacctgtaaaaaacggaataccgttgtggaacatcgtcgattcccccacgactccacggccggcaacgcagtaatctcagcacggcgagcactccccctttgaacgcgccataccgttccaatgcctcaatggcataattcgagcacgttggataatacttgcaacaaggcggtgtgtttgccgagatgtgctgttgataccagcgcaccccaccaatcatcaccgccttgaaagaagctgtcatgcctcagccaccttatgcgccaccgtggcaaaagccttcgcgatctgctgatctagcgaagcgaacgatgcggtcgctgcactgggcttggcgcgcaaaacgatatcgcaatgcgcgggcagcagatcctcatgggctctggccaatacacgaaacctacgcttcaccgtattacgggtgaccgcatgtcctaccgatttggagacagctaatcccaaacggcgatgcaccgtccggtcgtcatcatcatgatggtcgtcgggcaccaaatagtgcacgacgatatccttgccacctgctttgcgccggcgtttcagcacggtgacgaaatcacgatggctttgaagcctctccacctcgactatgcctgtggcactgatcggaatgatcaggcggagagggtcttgcggcccttggcacggcgacggttgatcaccgcacggccagaacgggtgcgcatgcgcaggcggaagccgtgcttcatgtggcgacgacggttgttcggctggaacgtcctcttcataatccattgctcctaggtctattcggcaacgcttcgcgctgccctcacgtgagtcaagctataccaaagtactctcacccctaccctcaagtcaaaacggacggagtattttcacatttcgacacgttgcgagacacgccccaaatctcttataatcggcggaataccaaccattcacggccaaaagttatccacaaattacatgtttgttattcacaatccagttatttcaacacgcgacacggtggataacttgtctaaaccagagtaaatattatctgttgtacgtatttcgccacagcgacagaaggggccacc

SEQ ID NO: 2 - DNA, 23837 bp, Bifidobacterium longum
atgtcatctctgagcagtaacggtcagccgtctacacgcagcagacaggccaatagcggtgaccgaaccaccgctcagctcagtgatatccgccaaaagcagctcagccacgtgctgtactggcgattcttcgtcaatctcgccctcatgcttatcgacgccgccatgtacatcatcgccggagctacggtgctcaatctgcgccatgaggcaacgccgctctattcgagcagattcaatttcacgattgactccaccgtttaccttattattatggcctgcttctgggtgtggtcgctctatgttgccggcatttatcaccgccatgttatgggtgacggttaccagctcaacgtgctgctggtcaaaggcatggtcgtgtgctgggtggtgcagtgcgcgttcaactacttcttcaatctgggtctgaccctcacgtcgctctgcttggtggtgattgccggatggttgctcaccatggtggaacgcattgccagccgtgcattcattacgcgtagtcgtcgcaagggcgcctacgcttatggcacggtgatcatcggttccccgcacggcattggtcgcacgctacaattcctcggtcagcgtcggcaactcaactaccgcccggtggcagtatgcccgattcatctcaatcccgataccggattgattgaacagagcgccgaccatgagacactccgtgaggagatgcaaaagaacaagggctgccagctgcccgtactcgagtacagcgatcataatcttgctgaacagattattgacatgaacgcgcagaccgttatggtggctgacgagctgcgtcgctattcggataattacgatatcttctccgtgcgcatggaatcgttcggtctggagattgccatgctggcttccgccgctgacacttctaaccatgagattcaggttcgatccatccaaggcaccacggttatcacgcagcgtcttgcgcaatacacgccagcccgtcgtttgaccaaacgcttgtttgatttggtgatttcttcactggcgattatctgttcgctgattatcaccattccggtggcgatcgccatcaaagtcacggacggcggaccggtgttctacaagcagacccgtatgggcctgcgcggcaagccgttccagatgtacaagttccgctcgatggtagtgaacgccgacgcgctcaagaaggagctcgcaaaagaaaccggtcagaccgaccgcttcatcttcaagatgaagaacgatccacgcatcaccaaggtggggcacttcattcgccgcttctccattgacgagttgccccagttcctcaacgtatggatgggcgatatgtccgtagtggggccgcgcccgccgctgcctgaggaatatgcccgttacaaccgtctgtacgccacccgcatgctggtcaagcccggcatcaccggtccgtggcaagtgtccggccgctccgatctgtccgccgaggaaagcgaggcccttgatgtggcttacgtgcagaactggtcgattatgggagacatcgtgctgctgttccgcacggtgggtgcagtgctgagccataagggagcgtactgattccttcccgtttcgccgtcacagttttgccgcgcccttgccacaccgcccttgaacgtgattacagaaagataagtcgatatatctatgactgattcgaacataccagaaatacctcagccgccggcaccctccgagcggtcgaaaaacgcggatgatcgccaagtgatacagccgtatgttgaccccgaggtacttgctgaagacgtccgagcggcagaacggcgtaagcaccgccggcgtatgagccatgaacatatcaggcggatcaagcgcaaaaagcgcattcggatggtgctgattgtaatcggcgcactgctgttgattattgcagcgctcgcggcgtggctcggcctttccgcgctcaaagcgaaaaatgaagtggaagcagcgattcaggccgcaagccgcatccaatcacaagttcaagccggcgacaccgacaaagcgcaagccagcattgaagcattctcccagcatatcgacgctacgtatgcgcagaccaagcagccggtatggaaactggccacattggtgccctattacggttctgacgtgaaggccgcgcgagacatggtgcacattttggaagacgtgtcgaacaacgcattgccgaagcttgccaaggcggcacaggccttggatttcaacagcatcggtatcaaagacggcacgattcagctgggggatatggccagcgtgactcaggatcttgccgccgccaatggagtagtggcggatgccagcgtagacatgggcaagattggtgatacgcatattccgcagattaccgaggcggtgcagcaggggcgtagcaagttcaaggagcttgccagcctgacggatacggccagtcggctgacggatgtgctgcccaagatgttcgacttggatagcagtgatggaggtggtagcggcagaggcccgcgaacctacctggtgctggcacagaacaatgctgagctgcgtgccacgggaggcattccaactgcgtgggccacgctcaccgtcgatacaggcaaaatcagcatgagcacgttcggcgatccgcctcggaatggtctgttcagccaggatgaagccgcgagcgtactgacggcggaagaacgcaatctcttctccaccaagatggccacggactacccggacatcaatttcactcccgatttcccccgcgtcgctgatatcgcgagtcagatctggcatcgagccggtcatgacgatgtggatggcgtcatcagcgtggacccggtgttcctgcagcggttattgaaggttgccggccccgtgacgctctccgatggcacggtgatgagcggcgacaatgccgagcagcggattctgaaccagatttatattgataccgatacgcaggcggagcaaaccgacttcttcacgatggcggccagtgagatcttcacgcatgtgctcaagaatgtggacggcaagaatcagcagctggtgcaaacgttccaggagtccgtatccgacggccatctgtatgtatggagtgctcatgaggatgagcagcggcgtatcttgggtacgaccatcgccggcgaattgcagtcgaaaccggctcattcggttacgggtgtgtacttcaacgatgccactatgggcaagatggactggtacctgaagcgtgaagtgaccagtacatatgacaaaacctatcccagtggcgccaagcaatacaccgttcacatcaaactgacgaatacggccgatgccgccgaggtgaatgccgctccggatctgttgcgcggctatgaccataacggcaacccccgtacgggggagatcgaaacggtgctgtacgtctacgcccccgatgaagggcgcattgtggattggacccaggatttcgatcagttcgctgtgcacgatggactgacggtgggtgtgaaaaccgtgacattgcggccgggggaaagtttcgagaccacggtgcatgtgctggccagtcccgcggccgatgaaaatgaaatgattttgagacagacccccttggttgattaaaggggcaacccctatacattaaggtggaaccgtgaataaggaagaacggagcatagctgtggatgaagctgaacaggtgcaggacggtaatggagtcaccattctcgatttattcaatgcggtaagaaagcatgtgattaccgcagtggtcacgctggtcattgtgatggtggcaatctgcgcgtacacctttacccgcactccgcaatacaccgcaacttccgaactcttggccacttatcgcagttcagcggctgcgtcgggcgcatccagcaatgcaagcgagctgagctctggcgccaattacatcaatagccagattcaaacgtatccgcagttggtaaaaaccgagtctgtattgcagccggttattgatgatttgggtcttgacaccacggtaaaggaattggctgagggcgttaccgcttccaacccggatggcaccatgctggtggatatttcggttaatgatccagacccgaagcaggcgtccagcattgccaattcggttgccgaaaacctgagaaaacaggttacttccacgatttacagcgatgagggcgataagatcatctctcccgtcaacctaactgtggtgcagcaggcgtacgctccggcttcccccagttcacctaacgtcaagctcaatttggcggcaggtcttgcggtcggtgtcattctcggcatcgtggttgcctttatcaaggatttgctggacacccgtgttcgccgcgattctgatgttaccgctgttatcgatgctcccgtactggggtcgctgagccgcaatgaggcttatgccggtacgtcgccggtgattatctcccgcccggcctcccgcgaggcagaagagattcgacgcctgcgcaccaatgtgatgttcgtgctgcccgatgagccgttatccaatgtaattgtggtgacttccaccggcccgtccgaaggcaagaccacgctgagcgtgaacctggcgactgcattcgccgaaaacggcagcaaggtactgctgatcgacgccgatgtgcgcaacccctcggtgagcaaggccctaggcattgagggtgcagtgggcttgacccatctgattaccaaccgtgtatcgtcgcatgatgcgattcaacgctactggaagccgaacttccacgtgcttcctgctggaaaacaaaccatgaaccccagcattctgctgaattcccgcgctatgaaggcactggttgagcaggtttccggagcctatgactatgtgattatcgataccgcccccatgcaggtggccaatgatgccgccgtattcgccaaggaagggccagaactgctgctggtggccggcttgggagtgacggaaaagaaactgctccggcagaccgggcacgaactgagcacactgagcatcgatcccgtgggcttggccatgaattacggcgagacggagaagccccagaagggtggctattactactacggcgacgagtccgacgacaacggcaagaagcgccaaatccagcacaaaaagagcgagaaaacgaagaaggactgaggccatgaggatcgcgttcatcggccacaaacgcattccgtctcgcgaaggtggcattgagattgttgtggacgaactggctacacgtatggttgcacgcggggagcaggtcgtggtgtacaaccgcaaaggccacaacgtggccggcgaggagttcgacaaccagtcgagcaccagcgacaagccgtatatgtaccggggagtgaaggtcattcccgtcacgaccatcgacgccaagggactggccgccctcacgtcctctttcttcgccacgttgaaggcgatcaaggcccgtccggatgtgatccactaccatgcggagggcccgtgcgtgccgcttcgtctggcgcattggttcggcatccgcaccgtcgccacgattcacggcctcgactggcagcgcgcgaaatggggacgtttcgcctccacgtatctcaagctgggcgagcgcacggccgcgaaatgcgcggacgaggtgatcgtgctgagccgtggtgtgcagcagtatttcaaagacacatacgggcgggagacacgtttcattcccaacggcattgcgccggtagaatccgtttctcctgacgtgattgctgacaagtggagtctggagaaggattcctacattctgttcttgggacgcatcgtaccggaaaagggcgtgcattacctcatcgaagcgttcaagcgattagacactgacaagaagctcgtgatcgcgggcggcgcatcggattccgccgaatactacgagtcgattaagcaggccgctaccggagatcagcgcattattctgaccgggtttattgaaggacgtgaactcgaagaactgtatagcaacgcatacatatatgtattgcccagtgatttggaaggtatgccaatgagcctattggaggcattggcttacggctgctgctgcctgacctccaatatcgctgaatgtgctgatgtgctgtgtgatgagtccggaatgatgcatggagtcacgttccgacatggcgatgtgaacgatttggccgacaaactcggtgagttgctcgtagacgtgggtaaggtacgaaaaatcaagaccggcgcggccggctatatcactggccgctatagctgggacaaggttgttcaagcgaccctcaagctctaccgaggagcagataaatgaggattttactggtcaacaaatatttctaccgcaaaggcggtgctgaaacatatttcttcgcgcttgcggagggattgaaagcactcggccatgaggttgcgttcttctccatgcagcacccaaacaatgagccgagttattggagcaagtatttcgtatccgaaaaggactacgtcggcaagatttccgcgttcaaaaaagtgaaggaagcggcgacgttggtgtattccttcgaagcgaagcgcaagtttgaggcgctgctcgaagaattccagccagacattattcatataaataatgtgcatcgccagctcactttgtcgattctggatgcgccttatttgaagaagcaccgtgttccggtggtgtatacagcgcacgactatattctgctgtgcccggcttacacgatggtggacggttccggcaaggtttgcgacgattgccttgactgtcacttcttccatgcggtgaagaaaacttgtgtgaaaggatcgaaagcgaagagtggtctggcgttccttgaagcggaattcctgaagaaccatcattcctacgacaagatcgacaaaatcatcgcccccagtgaattcatgaagcacaagctggatgagggtggatatgccggcagaaccgtggccatgcagaacttcctgaccaccagccaaatggacatggcgcataaggtagccaacacgaataagttcaataccgttgagccgtatttcttgttctttggtcgactttccaaagaaaaaggcatccttacattggtgagggcgttcctgcgggctgcaggcttgatgaatagtggggttgcaggcagcaaactcctcccagccaattggaccttgcatatcgtcggcgatggtcctgagcgccaggctatcgaaaatctcatcaaatcagccggccctgaagctgaacgccgtatcaaactccttggctacaagaccggagaggatcttcagcgcgaggttggcaatgctcgcttcagcgtgctgtgctccgaatggcgggagaacatgccttattcaggtttggaatccctggcagcgcagactccaataatcggcgcgaatatcggaggaattcccgagcttgtggtggaagggaaaaccggattcaggtttgaatccgggcagttagatgatttggcaaaccatctattgcaagcgtcagcactcaatggtgatgaatatgcagtcatgcaacaggaatgcggcgactatatcaatcgcagagctcaacaaagcctttatatccgttctcttggggaactatacatgcgctgtttgcagattccaacccagcaaagggatgtcgaggaggagaaatgaagaacacaattgatttgcataatgccgctgtactggtcactggcgctgcgggattcatcggctcgaatcttgcaaagcaactgcttgattctattgaagggattcatgttatcggtttcgataatgtaaatgattattacgatgtgcgtcttaaggaatatcgccttaaccagctctctcattatgaagggttcactttcatcaaagctgatttggcagataaagacgcagtaaatgatgtattcgagcaataccgacctaccgttgtggtgaatcttgccgctcaagctggtgtgcgatattccatcacgcatcctgatgcttatattcagtcgaatctgattggtttttataacattcttgaggcttgtcgccatcatccggtggatcatcttgtgtatgcatctagctcctccgtatatgggtccaataagaaggttccatattccacggatgacaaggtagataatccagtgagcctatacgctgctacgaaaaagtctgatgagctgttggcacatgcctactcaaagctgtatgacattccttctacgggcctgcgtttctttaccgtgtatggacctgccggacgccctgatatggcgtatttcggtttcaccaataagcttcgcgcaggagaaacaatcaagattttcaactatggcaattgccgacgtgactttacctatgttgatgacattgttgagggcattctgcgcgtgatgcaaggtgcgccttcgaagcagacaggagaagatggtctgccggttccgccttatgcggtgtacaacattggtaacgggcatccggaaaacctgctcgaattcgtcactattctgcaggaggagcttctacgagccaaagtgcttcctgcagattacgacttcgaatctcataaagagctggtccccatgcaaccaggcgatgtgccggtcacgtatgcggatactgcggccttagaacgcgattttggctatagaccttcaactccgctgcgtgaaggcttgcgtcgatttgccgagtggtacaagaccttctacctcgatgactctgataaatagggcattcgattcgctattccagtcattcacgtagttcataacatattttacaagaagggatgaaaaaagagatgaaggattttgattcattgaagattgccgttgctggtaccggttacgttggcttgagcttggctacgcttttggcgcagcatcatcaggttaccgcggtggatattgttcctgcgaaggtcgacatgatcaacgcccgtaagtccccgatccaggacgattacatcgagaagtactttgcggagaaggagttggacctcactgccacgctggatggtgaaagcgcataccgcgacgccgatttcgtgatcatcgcgactcccaccaactacgacagcacgaagaactttttcgacacctctgcggtggaggccgtcatcaacctggtgatgaaggtgaatccgggcgcgatcatggttatcaagtccaccatcccggtcggttacaccaagtcgattcgtgagaagaccggttccaggaacatcatcttcagcccggagttcctgcgcgaatccaaggcactgtacgacaacctgtacccgagccgcatcgtggtcggcaccgacccggaggaccggcatctcgtcgaggcggccgagacgttcgccaagctgctgcagcagggggccatcgaggagaacatccacacgctgctcatgggcttcaccgaggccgaggccgtgaagctgttcgccaacacgtatctggcactgcgcgtctcctacttcaacgagctcgacacctacgccgagtcgaagggcctgaacacgcgcgagatcatcgacggcgtgtgcctcgacccgcgcatcggcacgcattacaacaacccgagcttcggttacggcggctactgcctgccgaaggacacgaagcagctgctcgccaactaccaggacgtgccggagaacctcatccaggcgatcgtggattcgaacaccacccgtaaagacttcatcgccgaccgcgtactcgagcttgctggtgcctatggccccaacagcgaatgggatgccagcaaggaacatgagaccgtggttggtgtgtatcgcttgaccatgaagtccaactccgacaacttccgccagagctccattcagggtgtgatgaagcgcatcaaggccaagggtgcgacggttatcatctatgaacccacgctcgaaaacggctctaccttctttggctccgaagtggtcaacgaccttgatgagttcaagaagcgctcgcactccattgtcgcgaaccgttatgactcttgcctcgatgacgtaaaggacaaggtctacacccgcgacctgttccgcagggactaaacagcacatataccaatataagcaaggacgtatcgatatgggtgagagtatatgtttcattatgccaactatggacggtggcggtgccgaacgagtggtctctattctctctggcgaattcgctcgtagtggatgtgatgtgacgttgttcttaactaacagcactcataccgcgtatgctttggacaagcgcgtccatgtcgatacatcctgcgcggaaagcaacccgaattcccttgatcagattaaagctattcgggcgaagatgagagcgatgccgaatacggtatttatttccttcatggatagtcaaaatttgttcactctaatagcgggaattggtatgcggaaccgcataattatctcccagcgtaatgatccacaccgtgcttttggaaagcgtcggctggttagggctattcatccgtggctatacgctcttgcggactgcgtggtattccaaacacaggatgcacttgagtattaccccaaatatgcggctggtaagtaccgtgtgattcttaatcctctcaataatagcatgctgccacgctatgaaggtgaacgatccaagcgagtggttaccgtttgtcgtttgaatgagcagaagaatttgccgctcgccattgatgcgtttgcagaattccgcacacggttctgcgactataccttcgagatttacggcgaaggcgcactggaaaatgatctaaagcgttatgcagtttcccgaggggttggcgatagcgttcatttctgcggcttccggaaggatgttcatgcctgcattttcgatgccgccatgtttgtcatttcctcggattttgagggactctcgaattcaatgattgaagctattgcgttgggaattccgacgattgctacggactgcccaatcggtggggcccgcatggtcattgacaatggcgtaaatggatatcttgttccggttcggaacaaggagcgcatggttacggctatgtgcagtattgcaggcgatactggtgtgcaggaacgctttagcaaagctggcgtgcggttgcgtgaacgtttgtcggttgactctatttcgaagcagtggctttcggccattaaagagaaataagacatcaagaatatcaaggagaaaatcatgaagattttggttaccggtgctaatggatatttagggcgcggtgtggttgatgagttgcttaagcgtggaaacgaggtaatcgccacagacttcgcctgtgaccatgtgaattctgcggctcattgcgtgcccggagacatcttctcgattgaagatccctatacgtacttcggcgagcccgatgtggtgttgcatctggcttggcgtgatggttttgtacacaattcgaatgcgcactttgaggatttgcctaagcatgttgcattcctgaaaaaactgtgcgaatccggaatccagcaagtggcgtgcatgggatcgatgcatgaaatcggattccatgaaggcagcatcaacgctcacaccccatgctggccgatgagcatgtatggaatcgccaaggatgcgctccgtaacgcattgcagaccatagcgttgcagaacaaagtaaagttccagtggcttcgtggatattacatcgtcagcgatacgcaatatggcagctccattttctcaaaaatcgttgcggcggagatcgaaggtaagaaagagttcccgttcaccacaggtcagaaccagtatgattttctagattatcccgatttctgtcatcaagttgccgcggcggtgaatcaggatgaagtgttggggattatcaatatctgttccggtaagcccgaaaaacttgctgatagggtggaacggtttattgccgagaatgggttctccatcaaattgaaatatggtgcattccctgatcggccctatgactccaaagccgcgtggggcgatgctttgaagattacccgaatcctcgatacggaacattgattttccattttttcgcaaaggattgaggataacaatgggtactttgctcgagcaggataagtatcgatacgccgttgagaaaatgcctagattccagcggttatttcgttgttgccaagagtgcaggttcaagcctatgcagttggtgtatcgactgctgtttcgctggtgccgtcagaggaatttcatcgagttaagccatcaaacggttatcggtggtggcctgtatatcggacatccttattgcatcaccatcaatcctcaagccgttattgggcggaatgtcaatatccatcgaggggttgttattggccaggagaatcgtggaaagagaaaaggtgctctaacgcttggtgatgacatttggattggaatcaatgcgtcaatagtgggaggagtgaaggtcgggaacgacgtaatgattgctcctggggcctttgtgaatcgcgacgtgccaagtcactcggtagttattggcaatccttgcattatcaagcataaggatcatgccaccgagggatatatcaatcataaaagtcagtgacgtggtattgcaaaaaagcagggaatgaaatgggagctcacaatagcattagacgctatcttcaccgcattggtgaggaaatacgatctacggcggaaatagcgaaattgacttcatggccggctgcagtggaaacgcttattgctaaggcggatatccaaattatgtgccgtaatgggtatgcggaaccgccgaatgcgcgtcgtcgtctgattcgtaagcatgaaacactgcttaagtatttcgagaaacgatatggagatttcgcttctggctatcgctataaggtaaatcttccagccgtaccggaggaactcaaaggttgcatctggttatgctggtggcaagggcttgaccatgctccgcgtatcgtccaacgctgtgtagaatcgattcgcgaatatgcgggagatcgacgtgtgattgtgattaccgaggacaattatcgtgattatgtgaccttccctgactggatgatgcgcaaatatcatgaaggcactattgctcgcacacatttgtcggacttgctgcgtttatcgttgctggctcagtatggcggattgtggttggacgcgacgttctattgcgctggcgatattgaagactgttttggccagccattgttctctatcaagcgccccgagtatttgcatgcaagtgtggcgcagggatattttgcaaattactcttttggatgtgatgccgaccatcgttggatatttgccgtgatacgtgatttcttgcttgaatattggcgtacaaatgattttatggtcgactacttgttcttggattatttaatcgtactagtgcaacgacattgcactgcggttaaggaggcgtttgcagcaatcacccccaataatccacaatgcgatgacctgttcaagtgtttaggtgatgtctttaatgagcgtcattgggagtcattaattgccgatacatcattgttcaaattgacatggaagcaagagtttcccaccgaaatcaatggtgtcgaaacttattatggaagattgctcaacggcaatttgcgtcgaaattagttttttccagaggtgttgatgattcgcataacgaagaccaaaacactccagtacgcgtggctgtaccttatgttactgattccgggcagctgcgcgatgtcacgctatctgaataccacattggtgtatggcgtgattattgctatatatgccctgcttgcgttgttgagcgcaaaatataggaatgtttatgtgctgtcgttttgccttttgcttgcattggcaacgattgttatccgattgaaaacaggaggtgtggggcccctaagttttctttccaacgcagcgatgctggttgtcacctatatcgcaatgactattgatcggagaatgtttcttacccgattcgtaagaattgtttgtttctttggcatcatcagtgtgctattttgggcggcgttttgcattaacccttcgctggtgaatgcatggcctgcaacatcattctggacgcagaacttggggacgggtcaatgggccactgtgcttcatggaaaaggactctggctttactcgtatcttgaaatacacgcaacccgtaattgtggtttctacactgaacctggcgtgtatcagattgtactcaatgctgttttattcgtcctgttattttggaaaaagaaattatattttgataacgagaagcaatatcgtacggcgaccgtcattgtcttgctcacactgattacttgccagtcgacgaccggttatctttctatgatggtcatcttgttgtgcttcttctttatgcgtggcagagagcgaggcatacgtacgctgaaacaaaagcttgcagtgctagtggtcgccattacggcggtgctgatcactgattatttgcttcgcggggaagagagtctcctttatgttcaagtgctgaacaagctatttggtggaggcattggcggtggtgtcaatttagaggatagcacgggacaatatcgttggattacagtgatggctagtttgaaggctctttccatggacccgttcggtatcggttttgacgcattctatgcgatacgagactcatttgacccagctgcagttgccgctagcattgcgacctatgccgcagtgtatggaatgattttctggctgacgatgatgattatgattttctatccaatgattcgacgggaaccaaagaaaatactcattgccgtatttgcttttatgtttatcaattccacggttagcgagacgtatttgttctatccgggtctcatgatgttcccgatttatctcagctcctatttcacacataagcagtccagtgtcgttggacatgcgattgctacatgtaatcctcgccattcgctaatggtttccaatctgatgaatgctaaagaggtgatgtaatggaacggactctgctgcttgttcccagcggtagcttctattatttcaatagtatgaaacttcctaatgtggtggttttccctgtgttccgcgaagttcatggcgcgtccgaaatggtttggaaagcaatgaggaagctgaggcttgctgccagctcgctgttctatactgattggtacaaggatttgcagtcgttttccaagatcattgtttttgattttacggtatggctggatccggcgttattgcgcaacattaatagacataaaaatcctgacgcgaaatgttatctatattcctggaatattgttcgcgacaagcaggttgtccttggtcatcttacggcgtgcaggaagtatggtttctcatattattcgtatgacgaaaatgactgcaagcaatatggattccgcttcaacaccatcatgtatgacgagaacttgcgtctcccggaacgtgctctgacgtcagatatcctgtttcttggttttctcaaggatcgcaaggcaaaaatgcttgctttgcatcaaatcatctccgatgctggcatgaaaccggaattcgtaattgttgaaaacggtaatcagcatgaagatttgccattcaccattaggcactcatatgttaattatgcggattatctcgatatggtttcgcaaagcaaggcgattttggatatcacgcagcaaggtcagaacggattctctatgcgcgtgatggaatccattttcctcaacaagaaactcgtttcgactaacatggctctattgtcagcgaatttttatgatcccaataatattctggtcattgatttgcagaaccctgatgaagaagagcttaccgtgttcctgcgttccgagtttcacccatattctcaagagacaagacactactattccgtcggctcatggatcaatcgtttccaacaatgatggtgcagacgaataatggcaaaacacattaaaaaacatttttggaataagcggccatccgagggtatgaaatcggcggtagcatacacattcgcatcgctgttttctaaaggtttggcctttgttactgtgccaatttttacccgaatcatgtcaacttctgagatgggcacagtcaatctgtacaattcttggcagtcgatactgacggttgtggcgacgctctcgttgacttacggcggatatatggtcgcgttgaaggaatatgagcatgagcgcgataggtacgaatcttcagtgctgacgctcacgacgttcacatcaatcgtattctttgccgtatattccgttgctcccaatttttggagtcgcatacttggcctagacaaatcgctgttgctgctgatgctagttggtttcctattgctgccggctacggagttctggctggcaagacagcgttacgagtataagtacaaggcagcaacactggtgacgattggctccgcaattgtggcatcagcactttccattgtcgctgtattgtatatgcgaggaagcggaaaagcggccgaaggacgattgttcgcgaattatgccgtgctatatgctgttgctcttgtgctatgggtatacatcatggtgcgagggcgcaagttcatttccatgcggtattggaaattctcacttgctctgagtgtgcctcttattgcgaatcagttcgccacgcagattctgaataattccggtcgcgtgatgattggttggttcgttgataattccgctgtgggcatttatggcacactttcctcggtgagtaccgtttccgcaatcgtatggtcggcaattaattcttcgtttatcccattcctctatcggaatattgatgattccgaaggcaagaaaagagttcggagcctcgcttcgattctgctgctcacctatgctgcggtatgcgtattgatgactttcctagctcctgaggtggtcaagataatcgcaactgatgaatatatggcagcgatttacatcatgccgccaatttctgcagccattttccagaacgctatttccaatatgtatgcaaacgtgttgttgtatcacaaaaaatcttcatacataatgattgcctctatttgtggcgcagtactgaatattgtactgaatgcagtactgattcctctatttggataccaggcagcggcctattcgatgttgattgcattcgtattcttgtcgtatgtgcaaatgcgtgtgtccaaaaaactgcacttcactatcacgggaaccaaggaaaccgtatatgatgacaaagtcattatcggtatacaatggctggtaattgtgctttccgccattgcgattcctctatatcacttcacgattattcgttatatagcagcatttgtcctgatggttgcctccttgttcctatacaaaaagagcaaaatatctgtctgatatagaaaggaaccgcattgtttgagaaattaatgaatcatttccgtaatgctgagaaaaatgctgctcattaccgaaagctgggtttaaagctgggggggggcttcgagattctcaatggctgggattttggaagtgaaccgtggttgattgagatcggcgataatgtcaggattacatctggtgttagatttgtgactcatgacggtggcgtgtgggtattgcgtcataagtatcctgagttatccgatatcgatctctttgggaaaattcgaatcggcaataacgtgcatattggttttaatgccattattatgccgggggtaacaatcggagataattgcattatcggatgcggcactattgttacgcatgatattcctgcaaattccatcgtagtgggtgtgccgggtagggtgatcgagtccgttggtgaatatgcggctaaacatgatgatgattttatgcatactaaaaagatggctactgatgagaaaaaagctttcgtacttggccatctaagatgatgtgaatttttttaatgagattgttcttggaactggccgaagcaatatagcattatgcttcggccaaggttctagatgcttactttcgaataaacattcctgaacgttccatctctgtaagggattgttcgtaacgactgttgtcggtttcttgtcccagcacccattcgcaaaactcggtcaaaccttcctgcagggaaatcgacggagtgaaatcaagcagctttcgtgccttttgggtatcagcgacattatgtgcgatgtctccgatacggaaatcaccggtaacgttcagattgctggtactgccatagattcgtttcaatgtctcagctatttcgatgacacttgttccgattccgctgcccaggttgatgatttctccgttcgatgcggccgtattgatagatttgatgaccgcggaagcaacatcctttacgtggatgaagtcgcggctttccttgccgtcttcaaagatattgatgtctttattgtccaaaagcaatgaggagaagatggaaagaatgccagtgtaaggattcttcaatgattggcctgctccgtacacattttggaaacggaagatggtgtaatcaatatccatcgcagggcacattgtctgaatcatcatctcttgtgaaagcttggtgaacgcataaagagaatttggggtggttttgctgtcttcggtggtgggcattaaggtcaaggcggtattgcacttgtcgcaatgcatagtgaaatcgccttgcatcatatctttagttttgcgtccacgggggtagactacgccacagtttgggcattgatactcgccttcgccatacacagaacgcgatgacgacaggatgactttgcgtatagtgttgctttcccccttgagcgatagtgcttgaaaaatatttgacaaacccatgacattgacctcgttgtactggttgatcatgtacatggattgcccggtaccggtttctgccgcaagatgcaaaacaacatctaccccttcaagggctttctggactgttgtgaaatcacgcacgtctccacggatgaaatcacaacaatcttttatggattggaaaagatatgacttttcaggattgttgccatgaatttgtttggtcaatgcatctagaacgcgaatttcgtattcatcatgagcgctcagttgttttacgatctcgctaccaataaaacctgcgccgcctgttaccagaatcttcgctgtcatatgtcttgaaccgttcttttgtagaaacttgccctagaaggagagtatgctttcagtgtagttcaaactatctcatttgatattaagcaatataacccctctaccaatctttgggaatctatcagaacaaacaacgaggtcgatagagctgcttcgaaaacgatgtgaattcgattggttttgtcgtaagcctttatgcccatcaagagaattcaacagactgttcccttacgtatattggattggcaacggtgtgttggactgtttctagagggtttttccttgttgtgtgaactccacggggctcaggtacccgagggtcgagtggagccgttggtggttgtaccaccacacgtaccggttgacgtccgagcgtggttgctccacgttcgtgtagacgttcctgtggatgagttccttcctgacgagccggttggtggattcgaccaccgcgctgtcgtacgggttgcccggcctggaaagggaacgcgtgacgccgaacacgtcgagcacgcgttcgacgcgttccccggcgaacccgccgccgcggtccgtgtggaacacctcgatctcatccagcgggaagcgcagcgcggcgaacgcggccaacacgagatcggcgtcgtgcccgacgccgaccgaatggccggcgatctgccggttggccaggtcgccgggcaggcagacgtacgcccacgaactgccgaccctcacgtaggccgggtcggaggccagatgggtgcgcggcgcatagccattgaactcgcgggcgaggatgtcgggagccgggtcgtcgtccggcctggccgggcgtggcctataggcggccttggaacaggagccggccatgccgttccccttcatgatccggttgacgcggcggcgggacagcgtcacgccctcgtgccccagggcgtgcctgatcttcctggccccgtacaccttgccgctgtccctccacacgcgctccacatccttctcgtaagggtcggcgcgctcggcctcggggtgttcgagcacccagtagcaggtcgacttggcaacgcccaggatcccgcactgcgccgataccgggcagcggccggcgtcggaccgtatcacgcctgctttcgtgcgaataccggcgccgcttgttctgaaacatcgacctccatctccagctgcctgtcgcgtttccgcaattcgatcagctcgttctcctcgggagtgcggttgtcggccgctttcgtggagccgctgttacgtatcccctgcacccaacgccgcagcgtggaacgcgggatgccgtactccgccctgatctgcgacgacggcttgccgttcccgttacgactgcacgatctgcctcttgaactcctcctcgtaatgacggggacgattcggatcggccatgatgatcaactccttcgttgtcatgtcccgcatgaaccagtccgatacattgtagccaatccagtcgtcgctcacatggaagacatccacacgctcacacggcccactttctattgaatagacacactccaaggaaggattcaccgacaacatgaaacgtctggccgaagaggacgatgccgtccgactcgtctcgttcgatgatgaagcctatgttcggtttaccgtaacccgaggagggtgtttccgcggggtgcccccctccttgtaggatatgggggtatggctgatgaagttttctctccgaagaacgttattgtgaccggtggctgtggttttatcggttcaaatttcgtgcattacgtgtatgaccatcatcctgatgtgcatgtgacggtcctggatgcgttgacgtatgcgggcaacctggagaacatcaggggcatcctgggcgaccgcgtggagttcgtgcacggcaacatctgcgacgcggaactgctcgacaagttggttcctggtcatgatgcgatcgtgcattacgcggcggagtcgcataacgacaactcgatcgcgaatccggagccgttcctgaagaccaacgtggagggcacgttccgcctgttggaggcggcccgcaagtacgatgtgcgctaccatcacgtgagcacggacgaggtgtacggcgacctggccctggacgatccggccaagttcacggaggagaccccgtatcatccctcgagcccgtacagctcgacgaaggcgagctcggacctgctggtgcgtgcctggcaccgcacgttcggcatccgcgccacgatctcgaactgctcgaacaactacggcccgtaccagcatgtggagaagttcattccccgtcagatcacgaacatcctcgaggggctgaagccgaagctgtacggcaacggggagaacgtgcgtgactggatccacacggacgaccattcgacgggcgtgtgggcgatcctgacgaagggccgtatcggcgagacgtacctgatcggcgcggacggcgaacgcaacaacatcaccgtgctgcgtgacatcctgaccgtgatgggcaagtcacccgatgatttcgattgggtgaaggaccgtccgggtcatgaccgccgttacgcgatcgattcgacgaagctcaggaccgaactgggttgggagccgacgcatacggacttccagaagggcctggagcgcacgatcgagtggtatacggagaaccgcgcgtggtgggagcccgcgaaggccgccaccgaggccaagtacaagcagcagggacagtgatcgggtatggcgtttgatttcgagaaggagctgaaggtcacggagacgaacatcccggggcttttggtgttcgatctgccggttcatggcgataaccgcggctggttcaaggagaactggcagcgtgcgaagatgatgggtctgggtctgccggatttcggcccggtgcagaacaacatcagcttcaacgcgacgaagggcgtgacgcgcggcatccacgcggagccatgggacaagtacatcagcatcgcgaccggtgagatattcggcgcgtgggtcgatttgcgtccgggcgagagcttcggccaggtgtacacgacccgtttggacccgtccaaggcaatctacgtgcctcgcggcgtgggcaacagcttccaggccttgcaggacgggaccgtgtacacgtatctggtgaacgcgcactggagtctggaacagaagaagacgtacacgttcgtgaacctcgcggacccggagctgggcatcgagtggccgattccgttggaggagtccgaacgctccgaggcggacctgcatcacccgatgctcaaggacgccaagccgatggagccgaagcgcacgctggtgacgggctgcaacggccagttgggccgtgcggtccgcgcgtacgcggaggcgcatggtctgcgtggtttcgaatacacggacatcaacgagttcgacttctccgatccggccgcgtacgacgagtacgattggagcctgtacggcacgatcatcaacgccgaggaactatccgcggacaagtgcgaaatcggggagaaccatgctcgggcatggaccatcaacgcccaagggcccgcgctgttgtctcgtgcggcgaaggatcatcacgtcacattggtgcatgcgagcaccgataaggtttacggagccgattcggaagccaaagcgatcgccccggagagcgtctacgggcagacgaaggctgcgggcgacatcgcggtggcgaatgcgccggaacactacatcctgcgacgctcggaatccgccgattcccggaacatcgtggacacgctgttccagctgctcgattctcacgccgaatacggcgtctatgccgtcggtgactgactggacagcccggaaacatcaggaccaaggaaggacaagcgtatgaagggcatcattctcgccggaggttccggcacccgcctttacccgctgaccaccgtcacgtcgaagcagttgctgccggtgtatgacaagccgatgatctactatccgctcagcgtgctcatgcttgcgggcatccgtgacatcctgatcatctccacgccgaaggacctgccgaacttcgaaaagctcctcggcgacggttcgcattacggcgtgcatttttcctataaggtgcagcccagcccggatggtttggcgcaggcattcctcttgggagaggagttcatcgacggcgagccgtgcgcgctcgtgctgggcgacaacatcttctacggtaacggtctgggcgccacattgcgcaaggccgtcgctaaggccgaaggcggcgagggcgcaagtgtgttcggctactatgtcgacgatccggaacgctatggtgtggtcgagttcgacgagcataaaaaggccgtctccatcgaggagaagccgaaggagccgaagtcgcattacgcggtgacgggtctgtacttctatgacgagcgtgtggtcgagttcgccaagcgggtcaggccgtcggctcgtggcgaactggagatcacggacctgaacaagatgtatttggaggacggctccctgaacgtgcgaacgctgggtcgtggttacgcatggctggatacgggtaccatggattccctgtacgaggcgggcgagttcgtgcgcaccgtgcagcgcgcccagggcctgcccatcgccatcgtggaggaaatcgcctacgaaaatgggtggatttccaaggaggagctcctcgaatcggccgaacgttacggcaagagcccctacggcaagcatctcaaggatgtggccgaaggcaaagtcgtgattgttcctaacgactgatcgactcggacg

SEQ ID NO: 3 - DNA, 25674 bp, Bifidobacterium longum
atggcatgttcttacatttctgcgtctttgcccggacccgttcgccgccacaaagacagagcgcagaacaacgcaaccaccaatataagcccccgcactcaggcaaacctcaggttacgattggtagatatgagcaattccgaacaggccctcgactcaaccaacgaagcagtcaacaaagcatccaacgaagcaaccaacccatcattcgcgccgcaacacattctggtcaccggtggcgcagggttcatcggcgcaaacttcgtgcactgggtggcgcgcaaccatccgcaggcccacatgactgttctggatgcgctcacgtatgccggcaaacgcgagaatctcgatggcgtgccggccgcgaacctgacctttgtgcatggcaatatttgcgatgccgagcttgtggaatccctgttttctgggctgaaccaacgctctgcagccgcagtacccccgattgacgccattgtgcacttcgccgccgaatcgcataacgataattcgattctcgacgcctccccattcctcaatacgaacgtgaccggcacgtacgtgttgctcgaggccgcccgccgccacgatattcgattccaccacatcagcaccgacgaagtgtatggcgatctggctctggacgaacagcgcaaattcaccgagctcagcccttacaaaccgtccagcccatattcggcgtccaaagccgccagcgaccacttggtgcgcgcctggcaccgcacgcacggactcaaaaccaccatcagcaattgcagcaataactacggcccctatcagcacgtggagaagttcattccccgccagatcacgaacattcttgccggcattcgcccgaaactctacgggcaaggtctggctgtgcgcgactggatcagcgtggaagatcactgcagtgccatctggactattctcacccgaggccgcatcggggaaacctacctcgtgggagccaatggcgaatacaacaacattgatgtgctgcacatgattctgaagctcatgggtcgtgacgccaatgacttcgaccatgtgaacgaccgccccggtggcgataagcgctatgccatcgacgccaccaaacttcagaccgagctcggctgggtgccaaagtacaccgatttcaaggaaggtctggccgcgaccatcgactggtaccgtgcgcacgaaagctggtggatgccggataaggccgggactgaggaaaagtaccggaagcagggtcattgataggccgttgacaggccgccgataggtcactgacagcgcaatcaatgaataccgattgcgagatttggtggcgaaaatatatcttatgttgtacaataatcatatatttcaattataaattgattattatgacttttaaagaacggtaatgcgatgattcgtttacaaagacttgttctagacaacatgaggaacatatcgcacggcgtcttggattttgacgatctgcccgctggcggcagcgtaacgggtatctatggacagaatggatcaggcaagaccaccgttatcgatgccatcgggatactgcgcgcgctgctatccgggaatatgctgccggacaccgccggcgatgccattagcgtcagcaccggtcttgcaaccttgacggcgacgctcctcatcggaggaaaacagaagcccagctaccttgaatacaaggtgtccctgcgtagagcgaacccggattcgacgcgagcgcgcgtcgtttccgagtcggttcgcatcggcgacgatctctcacgcctaggcagggaggcgttggggcatcggatggaggattctgagaccgatggtttcgtgtcaactccggtatatgtgtggcgctccatcgaggcggtcacctcggtgaaaaccgtggtctcacgcaccgctgatcgtgcgtacatggaggggcgctcattcctgttctcgcggtgtgccgcgcttgaagaccgacccgatgccgagttcctcatcgactgggtggtctcccgcgtgcgggaagcgaatggtgtgtccgccagatcactgacatacatcaacgaacgtttcgatgagttcgtacgcctacgcaagaccttatgcgattacgcgaccaatgatgtcttcgtatccactacccgtcgtggctcctatgccgcatatgcgttcatccccatcatggaggaggattccgcaggtcgcaacacagagtttctgttcgacctgttgcaaccgaacccgctgaccccgggccaggcgaaacgacttggacagaccgtggagtccttcgaccgcatcctgcccaccctcgtgcctggtctgcatgtcctgctgaagatcggaaccgcgccttccggcaaagatggcgaggaccgggtcaccgcggagctgttctcgcgtcgtggcgatatcacggtcccattccgctgtgagagcgaaggcatcatacgcatcaccgcgctgcttggctatctcaagcacgcgtataacgacgagaacgcgctggttgccgtggatgagttcgactccggcgtgttcgagttgctgctcggtgacatgctgtaccagttggcggacgggtgcgcagggcagctggtgttcaccgcccataacctgcgtgcgttggaagtgctgccgaacggctgcattcgcactacagtgaccgatcccaataaccggttcgcgatcatcccccgcaagtcctccacgaacaaccagcgccgacggtacctgacggccagcgagctcggctggagcggccccgacatctatgattcgcccataccacgcatgttcggcaacagtctctatgccgccggccatcccgatgaggacgatgacatcgacgacgatctggcagcactcaacacctccggaacgaaggtgaaccgtggctaaacgcaagatcgtcctgctggtcgtagaaggagcaagcgacgccagcctgctcgtgccggcattctcgtcgttaatcgagaaccgcctattccaagggcaggaattccactgcgacgtgttgactgcgccaaaccaccgtgaggagttccggcgtcgtaacgggttctatccagcggacaatcctgtccagacggtgcgcgaactcgtggagtactacctcagagaccacgaccgcacctggggccagctcggccatgtcatccagatctgcgacctagacggggcgttcacatctgacgatcgagtgcgggaagacccattggtggatggaacgcaatattcaacgaccgacatcatcacgccaaaccgcactatcctgattgcggatcgcacgaccaagcgaaacggcgtggatgccttgctgaaactcgatgggttcaggaagaagaacggccgcgccacgctcatggtcccgtaccgcctgttctacgtcagccgcaacctcgaacacgcatttcgcggtaggattgacaatctagacgcacagcacaagcagagcagcgccatcaaactagcagaccgctttacccgcaacccgaacctgttctctacaacccttcaatctcttcggcgaatacacggcaatccgacaacgtgggaggaatcttggcaatatgccatgcaagacctccactcactcgaacgcggtagcaacctcgcattcgtggagccatacttggcaggcgaactgcggtaaatccatcagaatagtttcagaaccatagctggtccgagcccagctagacaccaaagttggaaaacgtagcccagtgcaccttattctggttataaaacgtaagaacagggctcaaatttggttggaaaacgtaaattatggcgctattgctgttttcgtgggtggggtttctccgttgagttgttgagggagtaagagaagagcgctttccgggtaggatgttttcgaccaagataaacaaacaaccgcaaagcgcctgatgaacagcatattcaaccaacttctcaacgtccccgggttctaggtaaaagtgcaacgcctgtctatggttggaagtgttcaagtccacaaccgaagagaaagcgttgcactcgatatgaaagcctattcccacctgtcggcacaggaacgcatccggatcgacgagctgaggaaccgcgaggggctcggcgtgtgccagatcgcgttgaggatcggccgcgacaagtccaccgtcagccgcgagccgggacgcggcccgtggttcgcgtccgacgagaacgagtcctaccggccctacaggccgaaacggctgaaggctgtatttcgtcaaattgaggtggacgtgttcggcacttaatccgaacaccgtcggcgttcaacttgaacaccgacggcggttggttccttgttttgttgtttgtctggtttatttcatgagggagtgtctgttccggtaggattcgccgtggaagcggaggatactgccgtggtggacgatgcggtcgatgaccgcggcggccatgtccccgtcgccgaacacgtcgccccatctgccggactcgaggttcgaggtgaagatgacgctgcgggtctcgtagctgtccgcgatgacctggaacagaagcctggccccgtcgatgtcgatgggcaggtagccgagctcgtcgatgatgaccagcccggccctgcctatcgacttgagctcggcgtccaatctgttgtcgtccttggccttcctcaagcgcatgaccaggctggaggcggtgaagaacctcacgggtatcatgcgttggcatgcgagcatgccgatcgcgatggccaggtgggtcttgccgcagccgacgtcgccgtagaacacgaggtcctcggcccggtcgacgaattccaggctttccagctgttcgcggccccggtcggcggggaacgaggccatgccccggtcgtatccctccagggtcttgctctgggggaacccggcctgtttgagcagccgccgccgtttggattcggcccggctcgcgttctccttctcgaacaggttggccaggaagccgagctggccgggcgtggcgtccgccagggccttctcgagcacgctgtgtgtcaacggcaggttgcgggcgaggcccatgacctgttccggcgtggccttgtcaagaacgcggccgccgcgctgccgcggtttttgctggctcattcggcctccttcatgtatttgtcgtaacgcttcaaatcctgcccgccttcggttcccgcaccctcgaggatgcgtttggcacatgtgccgatcgccgcgcggtcgacggtccgtcccgcgttgatgacggtttccaccgctttgaccgtggcggcgaacccgcagtcggcggcaacggctcggatgtcgtcgagcagattggagcgcgtgcgtgcgtccatgcggtcgagcagggctcgcacggtttcggggaaatcgttcctgatcgggctttcgccccatatgcggggctttcgcgcgatgatcgcgagcaggctcgccggatccacctgggttttcgccgaatggccccaaatcctctccggcgtggtgatcgtttcgccgccggggccccgcggttcgatctcgaagacgcgcaccccggcctgcaggcgcatggaacgccatttcggtccggccggataccggttcgcgtcgatcgcggcggcgccggtcttgtcggttttcacgctcctccagtcgcacgggtcgaaccgcacgccaggcaatggaagcatgtggtccttctccgcctcgaacagttcgatcaccggaacatcatgccggcagtggtccgatccggcgacgcgtccgcactcgtcaagccacacgcgcgtcagcgtttggaagctctcggccgacggcatcggcaccatcaggttgcgcctgacgaagccgacggcgttctccacactgcccttcccgtggccggaatacgggtcgcggaaccgcggcccgaacccgtaatgcgcgcggaacagggagaacaagcgggtccgggcggccgtgccgtccggcctgcgatggcccacaccggtggcgttgtcgaacaccaccaccctaggcgccatgcccatgcgctcgaagatccacagcaaaccctggcacacgcactccgaggtctcgccgggaagggcgaccacccagcgcatgttcgaatacgggaacgacaccaccaggaaatgcaccacgcgttcgactccggcgaccacggccctggcctggccgaaatcgacctgcgcgcttcccggcgcccactccaactcggcgaagccgtccgactccacgcgatgctcccgcctccaacgcttgacccagcgccgcaccgacgaatacgagcccgtgaacccgcactccgccacgagccgctcgtacacgcgcgtcgcggtgtggcgctgcttgacgggcatgcgcagatccgcggccggccacccgtccacgacggccgaataccccgcgtcgaccagcgacctgcccgcatgccccgagccaaggggcttgggagagcaatccccgtggttggcgtacttgaccacggtcgtgcgcgatacgccgagtttccgcgatatctccctgtggctcaagccctggcggtcgagctgcctgatacgccgtcggacacacaccggtgtcgtcatttcctttcctcccgagaaccatcagtttggttgacaggcactcgggaatccatcaaggaaccggacgatgccggtgttctcattccaccggcgccatcaccgccgataccgtccaaattgaacgctcagagtgttcaggaacaagtgccgacagtgaacacctttattcgatcacacacacgtgtcgccctcccccacccaagaagcatccctcatcggcgcggcatcggtgtcgggacaacaaaaaaactccttccttgtgcaaggaaggagccaatgggggaaacggctatctgcgtctcaacatggcgaaactgttggactcgacgatgaacgccttgcggtcgttcttggccatgacgtcaaggacgacacccgtcacgaacagcagcagcccggcgatgacaagcatgaccgctccgatcagcgtggggaatcgggccaccatgccggtgttccagaagtccaccgtcaccgtgccgcacagcacgacgccaaggacgccgaggacacagccgatgccgccgaagaacgggagcggcttgtattcgcggatcatgcggaaaatggtgcccatcaccttgatgccgtcgcccacggtgtcaagcttgctgacggatccggcaggacggtcgcggtactgaattggcatctcgaacagacgcaggttgttgttcaacgagtggatggtcatttcggtttcgacctcgaagccgcgcgacaacacggggtaggttttgacgaaggtgaatgagaaggcacggtagccggtcatgatgtcggtgacgttcgcatggaacaggccgttgatcgaaccgcgcaccagacggttaccgaagttgtggaacgggcgcttgttctcttggaagtaggtggagctcaagcggtcgccgattaccatgtcgtatccttcggcgatcttctcgaccatggcgggtgccgcgtcggctgggtaggtgtcatcgccgtcggccatgacgtacacatcggcgtcgatgtcttcgaacatggctcggatcacgttgcctttgccttggcgtggctccttgcggacgatggccccttccgccgccgcgatctcggcggtgcggtcggaggagttgttgtcgtacacgtagatgtccgcctgcggcagcgcgattttaaaatcacgcacgaccttgccgatggtgacttcttcgttgtagcaaggaagaagtaccgcaacggaaacgttcgaattctcaggcatgcactccactatatctcttgtactggtctgcatggggaatggattataggtgatgctgcatacttgaagcaaatggatttatcgattcacattaattatcacgagtgtagcgtgacgaagtgttcgtcttgaatgccgaatcgcttttgaaataatcgttatagttgatctccatgttcgattggccagcggctataaaaagttcgcccacgcatgcatcatgtactgttttcatcacagtggtagctatggcaaattccatggtgtattgggcaagtgaccctttgattctaggcaacttgattgaattttttcctgctttatcgattgttgaagaactggcgtacttatgttttccttctcgtaaagtaacggaaatcgttttccccgatgaggatttctgagctgagccgcttaaggtggtggttttgttctgttgcagaaccatgctgtccattacatagctcggtaaaggaagggtggcgtttccgttttcttgtggtgttttcttgtggtgttttcttgctttcctgagcgtacgcaggaaaacagaatgaatgacagtgtcaatgagaaagttcttctaaacatctgaacaaatcatgaaggtggaacagcgctatggcgcgagtatagcggtttccaaacttgtttttcatgtctcggacttccgattcgtagataaagatgctgtgttctccagattagatatgagagcggacgcctgcggatgagtttccgcttctgtcggagatactttagcgttgatatgctaagggcgtgcaagttggagaaggaaaggacgatcagtgacggcaagacaaacagatatgtggcaaggctctgtcgacaggcgggaaagcagatgtcacggtactcactatgtatttgtggacgtgctgaacattgtttcctgctttgccgtggtatgtctgcatacgtctttaggtgtgttctctctgcaacatacttttctatgggcattccaagagctcatgcaggcgatgtttattttcgccgtgcctattttcttcatggtcagcggaatgaatcttttggactaccggaagaaatattctacgaaagtgtttttcaaaaaacgattcgtacgagtgggacgtgcgttgattctgggcagcatcgcttgctatttattgttcggtttgctccccggcctgttttatggagcgcaatcaatcgccgatggtttcggtcctgtcgatttttgcaagagattcctcaccaactccatcatcgatatttattggttcctgtattccatcatttatttgtacttattgactccattgctttcaaaaatcgtccatgaccgtcgtttgttggaatatgccattgcgctgacgttgttctgttcaatcctgattcctgcagcaaaagccattggaattaacgagaaatatttcagcccattgttgagctggccgctatttgcttccagtgccctgctgtatttcctgctgggatattatttagaaaactacggcttgccgttgcattggaatgcgcctgcatgggccgcaactttcctcggatctgtgacgttgatgttcctcggcggtttatgttggaacggtttcttccagaattcgatgggagtggaataccagaattatcttgtcggcatttcctctccgttatgtgtgatatccgcggtatcactgttcatgctctgcaaagcgctggagccatcccttcagcgtggatctgacagaatgaagtcgataattcgcaaagtgtccagcgtctcgctcggtgtatatatgttccacctactgctggtgaaccttacgcttggtgggcctttcgagcgcatcctgacgtttgggcaataccacccattcattaaggccattgcggtctatctgcttactggcattgccgtatatgccggcaagtggtgcatctcaaaggtgaaacgagccctactatcgaagtgagtcagcgtaggactcgcgtccggagagacgatttaggattcttcaggcttaaatgcttcagcgtaagtgatagaaacagtggaatgatatacagcataggcaacacatagcgtgttgcctccgtgtgcgtggaaatcggtccagcaaatagaacaagcattgtgatgaacattggcagattaagcatcaacagattaagtttgttcttcttggatctcagtatgagaaacatgatggcacaaggaagtattgtagcccaaaaggctttttgccatatgatattgaatataggcgtcgctgataatgtgtctgcgtagaatcgtccaatcgcattaccagctttggtgttatctgtccaaggaatatattgttcgatgttttgataatgatgtttggaattgttgattggaagcatcatgctgagatctcgttcttctcctgatgcgacattgaatgagaaccatgcgacggagagtccaccccatcctgctatcatgtcgccgggatgtttaaccagctgtttcatccatgtcgtgattaaggcatggacatctttagaagataattcctgtccttttatcggatcagctttataccaacagtaagcaccttggagttgatcaatatccatatggtaagtttgttggattttgtcgatttcggctgcgctcaaatcatccttatggtcatgcaccacattggcgacttgttgcatgggcacagcaagaatctcgttactttcccctggggcaatgtgcaatgctggcaaaataaaagtcggcacgattataccaacaaccaaataaggaacgctacctaaaacaatagtagctattttacaggaccaatgtttgacaacgaagcatgccaaaagaagcagagccagaacaatgatatacatgcctgttttttttgttaaggatacggccaatacatctaagataaagaaaacattaaatgaaacggattttaaaatttccccctgtgttctccaaagttcacagaatgcgatagagaagaatacgaaaaatggcgtattgaaagtatctttcgcaagagacatcgacatcatggggatgatggggaaaagggtaagaaatgcagcgataaagaaacggcatttccaaggtgtattgtatttgcctgtatagcagactgtacaagcgatggccaatgtggacagtagcgactgcacgagcactagcaggtacaatccatagatagcgttattgaacaatgctttgccaatatgtgcgaatccgacatacaaatacgtcatcatgaagggatgatgatcggtgaacggcactgaagggtcataatattccatcagctgccaggaagtatcgtaccagtagacgcccgggaaataagctacaaaatacggaatccagaatgccgttacgagacaccataacgtgataatggatcgaggagaccagtccattgtgagtttgcggaacgcttcaaacggtttactcagtgattcgttatggtgatttatgcgcggaactatttttgtcgcagcgaaaaacagtaatgtgaacagggcaatataaaagagagtgttcacataaagcagcgcatttcgagtgtcgattttgccctcatgctggccaataaaagaacacatgccgaacaacgtacccagaagaatggggacgagataagcaaagttatgttcggtaattctaaaactttttgtggcctgtttcaatgcgattattcccttcctcgaaccgcgcgaccgatggccttcgccatggcacgacggcgggaacctattggcatgagtggatcgacaatcttgcgaattgggttatcctctccaacggcgcgttcgtgctttggacgaagcgcttcttcagggattttcggttcgttcgccttgaccacgcgcttgagcagacgctcatagaacggggtttcacgtgcgtatttccaatagatggaggcgaaatcgcaatctggatcggtccatggcttttgaaaaccagcgtaatggatgatcttcggattgttacgcgacttcatgtatgcatcgtagatgtcgtttggcgcctgtacgaagaggttgccgacacgtccgccacaatcgtgcaccacgttccattcccatggcagatacagcacgttaccttcgcagtgcgcgttgagcacatcctggtcgttgtagatgaactcgtcattcgatgcgtaagcgagccattgctcgatggtgtaatgctcacgcatcgccttggtattgagcaccagcacgccagcctggaagtaatcgtaggggttctgcatcttcagcacggtcttcgcgtaattcatacgcttaccatgctttacgttcaaattgccaaggaaatcgatatcgcgcactgcgccaagtagcttgccctgcaaatcgatgttgtagagctttgcgatatcaccattgatgatgatatcggaatcaaggtacagcaccttgtcatagaacggcaggagcttttgaatcaggaaacgatagtatgtttccacgctgatatgggcgttgttggtggaaagctcatatccggcaagttcgcggtccacgttggtgaatcgcagattcatgttcgggaactgtttgaagaacccgcgcatacgttcctgcttgtcccaagagatgttgcgctgcagtacggtgacatcgtagaaatagctcggatcagcgttcttcatggctgagtacacggtagtggttagctgcggcacgtaattgtcgtccgctgcgaacaccactggaatgatcggcttatcagtgacgtcaagtggtttgagctgctcggctggttccggattggtgaagtgcacgcactgcagctccttgaatttccaattggatccgatgcgcttgtggtgcatgagatagatattcagcaggcgttcggaaagatgtcccggcgtacgcagtgcttccttgctgtacgtgctataactggtttccttgtcgaattcctcaaggattgggaacatccattcacaataatcgaagaagatttccttcttcatgatgaacatattgcagaagcacgccttgttgccattgaagaaatcctgcgcatcctccttataatcaggatacatggcgcacagaatctgataacagctcttcaaatcgtcatcgtgcagcaggggagaggcctcccacagagcgcgtgggcttccatacttgttgatgatttcgtccagattgccgaacggtgtggtgatgacgtcatactgtttaaccacgcgggcgatgttctcatcgtccagaccgtactccttctcagccttggtgtcgatataatcatccatgatttcgccgaacgcgttttcttcatgcacggtttcggaaaaatcgaaatagcggcgataatggcagaatccgtagtagtcggcatcaacgttcttccaagcccagtattgcgtggtcagttcgcaatagcgtggattgcgatcggagatgttctctccgtcggcatcgctccaataataggggaaacgggtggggttttttgccgatccaacatgaacgggctggaaaatgtcactggaaaaggtcgaaaccagcttatgcgcggaaacgaagattttaacggtctgcttcttttgacgcttatgcaaatcttgggtttccttgaattcctggatatgacgcgatgcggcatctttcatctgagtataggaaaccggtagcacatgaacatcctgggttaattcttctgccagagcggcccaatccagaaaagccgacgttgatggattgagatattcgattgaagcgtatgcgccatctcgcgcaaatctcattaacgcagttgcggtttccacctctccgataatcggggcgacggattttgccgcttcgattttgtcattatcagatactcggtctttccattcattcatcaatgtgaaggtaagtcgttccttcagtcgagtagctgattccttcaccaataccgactctgtggagtcagcaaaatgcttggcttcttcccagcaagacttgatctggctcgccgacatgaggaatttatcaggggagagcatgttgtccgtggtcacgcctcggccgatgttgtacacatatcctcgaatgtcggtattggtcacttccaagttggacatgctggcaagcacaagaaactcatagctgtcttccgctcgttcaagacgtgaacccgtcattgcatcgaaggccttacgacatatgctgcctcggaaggccttatgggtcacatgccagtctcttccatattcatttgttgaaatgaaaacttcggaaagcaattgtttctgattggaggcagacgaatttgcatttgcccaagtctcaaaatcacgagcggcatggctgctcatgccattctgttctttgcaaagcagaccgaagcgcaaaatatcaggcgtatatttttggatttccgactgaattttatcgagtgtcccctccgcgaaagcatcatcggaatccaggaagaggatgtattctcctgtgctcagagcggttccacttttcctggcgagatggagtccctcgttgttctctttatcgagaagacggattctactatcctgtgaagcgaagcgagaggccacgtcgtgagaattgtctgtacttgcatcattgaccacaatggcttcccattgagtgtaatcttgggcgagcaggctgctcagacactctggcaggtattccgcgcagttatagcaaggaatgatgatgctgaaaaaaggattatgaccggacatctattatttctttcttcggatagtggggaaaagagatttgatttgcgataggatacggatgattttcgtagaatgcggcgtctccttcggtacgggaagacgtgtctgcaaatctgcaaagtgtctgagcgcttgttcccggtacttgttgtactgcggagatgaatcgttgccggcgattgtttctgcagtctccttccactgcacgtatcgggattttttatcaaaggcgtctcccgcatcccaatgggaataagcgtcatctcgtgtgagacgcatcaattccgttgcgatctccatgtgagtgaagtttgcctgcatcgcgggaagaacagacaatttatcttcgtcggatagccgtacataccagtcgccaaacagcatctccaacaatcgtcggcggagttccacggcacaaggaagaagatcgaaatcggtgaagccgtttgcgtattcagaagctgtgcttatcagagttccataattcgaagagagcgaaatgaatttctgcttggacattggtttgaaagtggtgatacctcggcctaggtaatagcgatatccgattagctcattatggaaggtttccgtattcgcgaggctggcaataacgagccattcgtagctatcctgtcctctgccgagacgagagctggacatacggctgaaagcttctttgagaagttcggtccgatacagacgttgcaggatacgccagtcttgacggtgatcttcggaatcggtgaaagaagagaaggcgatttccggaccatgcagtgtgggtaaatctcgattgctgagccgaagaatatcggagcatgctgattcaggcatatcctctccgaaaagttcggtaccgaaatggagaacatcgaatgattgttgcgaagcgaacgtccttaaagagggcaatgcgttatttgcgagctcatcatccgcatccaggaaaagggcgtatttcccccgcgcacattccacgccgctttttctcgcgagatgggttccctcattttggcttttgttgatgattatgattcggtcgtcttcttcggacagctgactggcaatatgaaatgcgtcatctggactcgcgtcgatgacgatgattgcttcccaatcctcaaaagattgtttttgcaaagactgaatgcactttcgaagataaccaccattgttgtaggaagggatgatgattgagaaaaaaggactcgaagaattttctgccgattgtttattcgtcattttcttctccatgctgtgctggtatgggcgtggaaggcaacaattacattccacgccccatagattaagaatgcaatggataatttcagccgactacgccttcgcatttgatcgaaagaacatcgttgttgagcagtgcgtaatctccattcctggaatcgcgaatcgcgaagatgcaggcgtcatctccattcgcgaaggcgatggctttaggcttcttcggattgtcgggatcatcgacacgcaatgacgccacaatctggaaatcaccattgttgaagatgttgacaggcagcgcgaatcgtaccttgtggtggcctggattatggaacttatacagattggggccagggtcgaaggtcatacctcctcgtttcttatcaatcaaggtcatggtgaaatagaaatcgacatcctgatcaaagaagtactcgatgtcgaattcgaaaacatcatctttgccgcaaaccggcttggaggccgcaagaaccttaagccatgcttcattatcttgcttttcggccttatcggtatccggggaatcagtctgcttgagattttcaagcgtgtaacggtctgcgacatcgttcttgtcgccgctggcgatgatctcgccgtccttgatgaggatggccttattacagtacttcttcacagcatccatggaatgagtgacaagaatgaccgttttagttgggtctttcttgatttcagcaaagaagttgtcgcatttacgctggaacgcctcatctccaacagcgagcacttcgtcaagcaccaaaatgtcgccttgggctttaatcgctacagagaaagcaagacgaacctgcataccggaggaatagttcttgagcttctggtccatgaagtcctcaagctcagcgaactccacgatgtcatcatacatcgcgtcaatctgcgtacgagtgaatccaagcagagcgccgttcaagtacacattctcacggccggtcagttccgggttgaagccgacgccaagttcgatgaatggcaccagtttgcccttgacagtgaccgagccttgctccggggtatagatctgggagatgatcttcagtaatgtggacttgccggaaccgttacggccaacaataccgaaaaagtcgccttggcgtacttcgaaattgatgtcgcggagcacatgctgctcggtgtagcctttgatgcccttcgtccagtttaagaacgccatcttcaggccggtcgcctgctcagtgggcagacggaacattttggccacatggtcgaccttgagcactaccgggcgctcgtccttggcttcttcctgtgtcttttcagtcaatgcaatttcagccatgatcagagcacctccgcgaacttggagctgtatttacggaacacatgaatgcccagccacagaatgaacgcggacagcacgtacggcagaaggcatagcagtttgttatcgaccatgctccacacggtcggcacatattctggggaaagcaggttatggcgaatatccatgattacctgagtggaaggattcagcataagcaatttagccgcccaagagaaatctgggttgttagccaccatcgaaatcggatagatgataggtgtggcatagaacatggcttgcagcacgacttcccaaatatgcgccacatcacggaagtatacgaacagcgaggcgagcagcaatgccacgcccagccctagacagtacaactggattatgctgaacggtacgagcagcacgcgccaagtgtagtgtgcatgggcgaagaaaccgaacaaaatcaccacgcacaagttaatacctaatgaaatcatggaacccatcgtggtggaggccacgatgatgtaattcgggaaatgcactttgcgtagcaaatcaccgcgtcccacgatggattgcatgcccatgctggtggactcggagaagaagctccacaaacaggtaccgcacagcagcgaaatcgggaaggtcggggtgccgtcggagaacttcaggaatttcacgaacaccacgtacatcaccgcgaacagcatcaacggcttcaatacggaccacaccatacctaggaacgaaccttggtagcgcagctggaaatcggtcttcaccagttccttgaacaccaccatcgcgtagtggtacctcttcttgaggctctcaaaaaagtctttcacaagcattccatcctactagtgcgaagcgtttggacgcaaaatcatgtggcagtgcggttgatgcgctctccttcgacagtactctcatatattctagtgaggaaaggacgtttgtcttagtaaggcggaatatctcacatggttctcacagcggaacagcaccattcgaacatccgaatcttcgtgtcggcacataagcaggccacgtttcccaagggggagagcattcttccgatgcaggtaggcgccgctcacgccacaacccgtttcccgaacaccttgcatgacgatgaaggcgagaacatctctgccgaaaatccgcggtattgcgagctgaccgcgcaatactgggcttggaagaacgaagatgccgattattacggtttctgccactatcgtagatatttcgatttcacggataccccacataaggaaaacgattacggcgaaatcattgactcatatattgacagtcgcacgattgccgaatatggcatcaacgacaaggcgatcgcacatgcagtggacggatgggacatcatcaccacaccattgaacgatgttcgtcgtatcggcggattttcaaaccttaaacagcattgggacgccgacgaacatctgcggctgaatgacttacgccatatgtacgacattctgtgcgagcggcatcccgattacaagatggatgccgatgccgtactcaacggccgcaccgcagcattctgcaatatgttcatcatgaggaaagaaatcttcttcgaatacaacgagtggctattcccattgctggacgaattcgcaatgaccaccgacttcagcaagatggacatgcaggccacgcgcaccgtcggccatctctccgaacggcttttgaacatctttatcgcacacaagcagcgcaccggcgcagactggaaaatcaaacgactgcaatgcgtgcattttctgcatccagagccgaacgcgatactggaaccggtagggcaggagcgtggacgtgtggtgccggtggtgttcgccgcggacaacaattacgtcccgatgctcaccaccaccatctattcaatgctgaagaacgcttccacgaatcgtatgtatgacgtgatcgtactagaacgaaacataaccgacgagaacaagcgctacatgcggcagttctttgcaaggttctcaaatgccctgattcgtttcttcgacgtgaaccgctatctcgccggattcaatctcactaccagcaatgcgcacatcagcattgaaacatattatcgtttcatcattcaagaagcattgccattctactcgaagctgctgtatctggattgtgacctggtggtcaatggcgatatcaccgaactattcgataccaaactcggaagcaacgctatcgctgcagtaccagatattgatttcattggaaatctcaacatgaagaacggtgagcgtgctgaatacgttcataagcagttgcacatgcgtgacgcatatggctacttccaagccggtgtattggtaatgaatctcgaccgcatgcgcaagattcacacagtgcacgaatggttagaaatcgcttccagaccgggatacatatacaatgatcaagacattcttaacgtagagtgtgaaggtcttgtcacatatttggattattcgtggaacgtgatgcacaattgtgcaggccgcattgctggagtgttcgatttcgcacctgcctccatgtacaaggcgtatatgcaatcacgtaatatgccaaaaattgtacactacgcgggctttgataaaccatgggaaaatccatggtgcgatttcgcaccgctgtactggagctatgcgtgtgaaacgccattcgcggcacaaatggttgccacaatgagcggcgtggaacgccctgccccaccagaacaccacgaacgcgcaattgccgaagacagccctatgcgcaagtatgcggacgtgctggctccggtcggctccaaacaacgagaactgctgaaagtgatagcgcgcaaggcgcagggcaaacggtgagacagacagacagataagtcaccggttgttgacggaggcttcgtgtcctcgtcaacaaccgaccatggtttcacagggaagaattagtccctgcgaaacagatcgcgggtgtagaccttgtcgctcacgtccagcaaatcgtcattccaacggttggctacgatggcagacgagcgggtcttgaaatcagcgagatcatgggtaacctcactgccatggaaattagattcgcgcaatgtgggctcgtagatgagtacagggatgccgttcgctttgaactgcttcataacgtcttggatggcggactgacggaaattatcggaaccggacttcatggtcaatcggtagataccgatgatagggttctgaacattcctgacaagttccatcacctcagaggctacgaattccttgcgggtacgatttgcgtctacaatggcctcgatgaggttctgcggaacctgactgtaattggctaacagctgtttggtatccttcggtaggcagtatccgccatagccgaagctggggttattatagccgtcaccgatgcggggatcgaggcaaacaccatcgatgattgcacgcgtgttgagtccacggctttccgcataagtatccagttcattgaaatacgccacacgtaacgctagatatgtgttggcaaatagtttgatggcctcagcctcggtgacgcccaccaccaatgtgggaattccggtgctgccatcatgattaacgcgagacgtctcagcggaatcagcgccttcaacgagcagggacgcgaatcgacgtgccgcttcgacagactcagtatcattctgcggggcgccgacgacgatgcggcttggatgcagattgtcgtataacgcgtgtccttcacgtaaaaattcgggggaaaagagaatacgatcatccggaaggttcttacgtaactgttgcgtatatccaaccggtatggtggatttgatgacaatccaagcattcggcgcatatcgtctgaccgatgtaatcgccgcttcgacactggacgtatcgaagtaatttttcttttcgtcatagtttgtcggcgtggcgatcaccgcgaaatcagcatctctatatgcctcctgcggatctagcgtggcatgaaagtcaagtattctttcgccaagagtgcttttttccaagaaatcagtaattacagaatcgacaataggacttttcccattgtttaactgctcgactttctcgggaatgatgtcgagtgcatgaacttcattgtgctgagcgagcagcaaagcgacagacaatccaacgtagccagtccctgcaaccgcaatcttcatagtgtcagcctttccttacgcaatcctaagatattgtagacgcaggtcactgcaacgaatcaacgtagccagcatcttccaaatcgcacatgccgacgttcatcctgtacgggcgaaccggtaaccaatgcacatttcttgatgggtcttgcagaacgacgagcgaatacggctaaggagcatcccgaaaacgtaattatcgcgtcattcgtgaaaatcaaaacacgtcagcttccaaggacagaagaggcacgaaaagctcgcacggacgcaagatggcgtccgcacccggacccgaacccccagccgttggcatgcgacggtatgctggaatggtgaacagcatggcgtgcggcggcgtattcgagccgcgtaatatcctggtgaccggcggatgcggcttcactggcgcgaacttcgtgcgatacgtggcgcggaaccatccgcacgtgcacatcaccgtgctcgacaagctgacgtacgccggcaatccggagaacatcgccggcctgccaccgtcgcaggtcgatcttgtcgtaggggacatctgcgacgtcgcgctgttggagcgtatcgtgcccggtcacgacgccatcatccacttcgccgaggaatcgcacaaagataattccatcgccaattcggaaccgttcatccgcacgaacgtggaaggcacgatgcggctgttggaggccgcccggaaacacgacgtgcgcttccaccacatcagcaccggcgagaacgtgcgggacaggcccgggcacgacaggcgatacgcgatcgacgcatccaaactgcgcgccgaactgggctggtcgccgatgcacaccgacttcgccggcggactgcgcaacgtcatcgattggtatgcggaacaccgcgattggtgggtgccggccaaggaggccaccgaggcccgctaccgcgcgcaagggcagtgaaacgacggctgctacaggcggcccttccgcggcagagcgacgttgcgcagcagacgctgcacgggcttaagcaccacggtatcggcaatcaccgcaaatagcagcgccgccagcaacgtagcgccaaacatcagcacgctgatacccgcatacgaccatccgtccgtaggcacgggaatcctcgggccaatcagcaccttggacagtggcgagtgcaccaaataaatcgtgtaggaatatccagccagccagataatcgccttacgcacccgcgccgacgtaatgtgcacgtcgtaccggaagaacaggaacgtcgccattaccaccatcgcgaacgcaaccgtgaccgtgcgaccaacctgcatctgctggccggcgaacagatatggcgtggcgactgtccaggccagggcgaatggtgccaacgcatacacgccgcgccgtatacgcgcggacggcggatagtattccaacacgaatcccaacaggtagtagatcagcagtccacgccaagggaatgactgcaggaacgtcaacggatatccgacaagatcgcatatatgctcggcagcggctacggctgcggccagcccgaccagcaaccaggctcccgatcggcctatcgtacgcatcatcgcggccaggaacggcgttgccagcacaaacccggcaagcatgaacacgaaccaatagacggaatcgtcatacccggagaacagatcgaacaacgttccagacacagcgccgccaaccgaacgatgatcaatcaccaggtaggcaacgaatcccatgccacccgcatacagcagatacggcacaatcagcgagacaaagcgtttgtagtagtagcgcgcgtacggcgcgaggctaccgggatcggcttggcccgcaccgccgcctgcccgggcatcagagccagagcccggcagacggcccgctgagtgggtgctcaccggccggtcggcatcgaatgtcaggttgaaccggcccgataccataatgaacagcggattgcagaccatgaacagcgcgaacagcacggatcgcgtcacttccgcgctgccggcgagggtcatcttgacgggcatgtagttgttgatcacgtggacgccgatgaccagacacatcgccaccacgcgcagcagatcgtagttcacgtcgcgcggcttgccggcgacgccggaaacggaatcgggcatggtcatcacatggatcccgccagggacttcagatcgaccgggcagctgatctggctcttcaacttgtccaaggcgtccaggccggccgagggatcggaggacgcgtccttatgcgcgtcgttcttgccgccgtccgcgccgccgttcgcaccatcggcaccgttcgcaccatcggcgccgttcgtatccgccgtgcactcatcggtcacattaccgttggagcccgtctcgacgccatccgcattcaccaccggcgtggttaccacgttcagtggatgtgtggcatcgctgctgacccgaacggtataagcaatcgtcaattcttttccgggctcgatccactgctggttgaacataatgtactgacggtcatacaggctcgcggtgttggtaccccatgaatctatatcagcctgcacagcggtgatctcgccaccgtacggagcggtaagcaccacgcggtacaacatgccgccgagcactggattctccgagccgccattaacgaaatcaggcaacgattcggccttagccttagtcagcgtgttcttcatggtgaaggtgaccgtgtattcgtcaccgagctgatcttccgtaaactgacccagatgcgtgttacgcacggctgtcgtgatgcgcttatccagcacgccagaatacagggcgttctggctggctgaggcgtcgccgcaggtttttgtgaccgtggtggaggtcttcagataccaatcctgcttgccttgctgcagctccgaaagatagatgccggcttcgggcacctgactgtcagcagacaactcgccactggccttatcgtcgataagtccggtggcaatcagcgcctcctgctcatccggatcagccatccatagcttgaaatgaccgctagcgctggtatctctaattgccttcaacagcggggatgcggtagaggcattcgcgttgccaagcacatggttcataattgcttgagccgcttcggaaacgaagttgttctgctgctcgaagtccgggtaatccgtgtacaggtctgaagcgaagaacggcaccgtggtggtgctatccagcactcggccgtccgaaagcttgacctcgcctgtggctcccagcaatgcctggagaaatacgggatcgagtgacaatacacccgctacgttctcgtcttcgttgcctttctgatacagccacatgtatttgttcatctgtgccacacgctggaattcggggtcgatggtcgtggtggccgggtactggtcaaaagtgccaccaaatacctggcgctccttcagcaccgtatcatccattggctcctcaggaatgtcccaaccagaagtggtggcgaaatcaccgatggtaatcgtgcccttatctgccgtgattgcggcgatggtgcctaccatgccgcccgccgaacgtagctcggccgggttctgcaccatcaccaaatacgtgcgcttgccgtcctcgccaagcagttgcggtagcaagttaatgaggccatcgtattcgccgagcatcgaatccacggtcttgagcgcagccttttcggtttcgagcacggtggccaccttggcgacgctcggagtcggcaccttgttgagcttggtgagctgctgcgagatatccttatgcgcctgcttgacgatatccggcatatccatcagggcgctgacgtccaccgagccattcttcagggagaagccctgcaatcgtttggacaggttcagcagatcagtgaacggaccgttgaccagcgtatccacggaagccagcatttcgcgggcggcggtgatgtcgcttccgaatcgcgaatggtcgcggaagaagtcccactgtgggccgttcagctccgcattgagatcattggtggcattgaccagctcttgggagatgtccgacagactcttatcgctgccacagccaagtgccgaattggccagactttcggcggatgtcagcacacgctgcgcatccgcggccattctcgagacggatgccgcgtagagcgtgcccacacaggtgacgctggccagcaacgtcagcagcagtacaaccaccactcgcgcccatatcggtgtacggctgaccagcgaacggccgttgccacccacgtgctggggagtcttcaggtttacgggacccgtctgctgatttgcagcgctattcgtagatgcggagcgattggatttcccgttaccggcatggcggcttctcctacgccccacagccttatggctcgaatgccctgaagtgaatcgcat

SEQ ID NO: 4 - DNA, 19 bp, Bifidobacterium longum
ccatgagcggtttcacgaa

SEQ ID NO: 5 - DNA, 20 bp, Bifidobacterium longum
ttggacggtgcctgtgatta

SEQ ID NO: 6 - DNA, 12 bp, Bifidobacterium longum
cgggcaatcaac

SEQ ID NO: 7 - DNA, 25 bp, Bifidobacterium longum
acttgacgtaccgttttgagatttc

SEQ ID NO: 8 - DNA, 23 bp, Bifidobacterium longum
ctaagcatggcaaggctgatagt

SEQ ID NO: 9 - DNA, 14 bp, Bifidobacterium longum
tgcgaccaacacgc

SEQ ID NO: 10 - DNA, 25 bp, Bifidobacterium longum
gggtccaataagaaggttccatatt

SEQ ID NO: 11 - DNA, 20 bp, Bifidobacterium longum
gcatgtgccaacagctcatc

SEQ ID NO: 12 - DNA, 35 bp, Bifidobacterium longum
cggatgacaaggtagataatccagtgagcctatac

SEQ ID NO: 13 - DNA, 20 bp, Bifidobacterium longum
tatgttgccggcatttatca

SEQ ID NO: 14 - DNA, 20 bp, Bifidobacterium longum
tgcgcgttcatgtcaataat

SEQ ID NO: 15 - DNA, 20 bp, Bifidobacterium longum
ggcgtagcaagttcaaggag

SEQ ID NO: 16 - DNA, 20 bp, Bifidobacterium longum
aataaccgctgcaggaacac

SEQ ID NO: 17 - DNA, 20 bp, Bifidobacterium longum
gtgcaggacggtaatggagt

SEQ ID NO: 18 - DNA, 20 bp, Bifidobacterium longum
gcttcgggtctggatcatta

SEQ ID NO: 19 - DNA, 20 bp, Bifidobacterium longum
tgctgacaagtggagtctgg

SEQ ID NO: 20 - DNA, 20 bp, Bifidobacterium longum
ccacgtctacgagcaactca

SEQ ID NO: 21 - DNA, 20 bp, Bifidobacterium longum
gaaagcgaagagtggtctgg

SEQ ID NO: 22 - DNA, 20 bp, Bifidobacterium longum
ccggctgatttgatgagatt

SEQ ID NO: 23 - DNA, 18 bp, Bifidobacterium longum
tgccgctgtactggtcac

SEQ ID NO: 24 - DNA, 18 bp, Bifidobacterium longum
gcatgtgccaacagctca

SEQ ID NO: 25 - DNA, 20 bp, Bifidobacterium longum
ccaacacgtatctggcactg

SEQ ID NO: 26 - DNA, 20 bp, Bifidobacterium longum
tcggagccaaagaaggtaga

SEQ ID NO: 27 - DNA, 20 bp, Bifidobacterium longum
ataccgcgtatgctttggac

SEQ ID NO: 28 - DNA, 20 bp, Bifidobacterium longum
aaacggtaaccactcgcttg

SEQ ID NO: 29 - DNA, 20 bp, Bifidobacterium longum
atgggatcgatgcatgaaat

SEQ ID NO: 30 - DNA, 20 bp, Bifidobacterium longum
ttctcggcaataaaccgttc

SEQ ID NO: 31 - DNA, 20 bp, Bifidobacterium longum
ccagcggttatttcgttgtt

SEQ ID NO: 32 - DNA, 20 bp, Bifidobacterium longum
ggtggcatgatccttatgct

SEQ ID NO: 33 - DNA, 20 bp, Bifidobacterium longum
gctatcttcaccgcattggt

SEQ ID NO: 34 - DNA, 20 bp, Bifidobacterium longum
ccagtcagggaaggtcacat

SEQ ID NO: 35 - DNA, 20 bp, Bifidobacterium longum
tgaaatacacgcaacccgta

SEQ ID NO: 36 - DNA, 20 bp, Bifidobacterium longum
aatgcgtcaaaaccgatacc

SEQ ID NO: 37 - DNA, 20 bp, Bifidobacterium longum
ggaaagcaatgaggaagctg

SEQ ID NO: 38 - DNA, 20 bp, Bifidobacterium longum
gatttgatgcaaagcaagca

SEQ ID NO: 39 - DNA, 20 bp, Bifidobacterium longum
gtgagtaccgtttccgcaat

SEQ ID NO: 40 - DNA, 20 bp, Bifidobacterium longum
ttccttggttcccgtgatag

SEQ ID NO: 41 - DNA, 20 bp, Bifidobacterium longum
gctgggattttggaagtgaa

SEQ ID NO: 42 - DNA, 20 bp, Bifidobacterium longum
tgttacccccggcataataa

SEQ ID NO: 43 - DNA, 20 bp, Bifidobacterium longum
accggtaacgttcagattgc

SEQ ID NO: 44 - DNA, 20 bp, Bifidobacterium longum
gcaataccgccttgacctta

SEQ ID NO: 45 - DNA, 20 bp, Bifidobacterium longum
ttgtaccaccacacgtaccg

SEQ ID NO: 46 - DNA, 19 bp, Bifidobacterium longum
cgcgagttcaatggctatg

SEQ ID NO: 47 - DNA, 20 bp, Bifidobacterium longum
acatcgacctccatctccag

SEQ ID NO: 48 - DNA, 20 bp, Bifidobacterium longum
atacgtaacagcggctccac

SEQ ID NO: 49 - DNA, 20 bp, Bifidobacterium longum
aagtacgatgtgcgctacca

SEQ ID NO: 50 - DNA, 20 bp, Bifidobacterium longum
catcacggtcaggatgtcac

SEQ ID NO: 51 - DNA, 20 bp, Bifidobacterium longum
cgaatacacggacatcaacg

SEQ ID NO: 52 - DNA, 20 bp, Bifidobacterium longum
gagaatcgagcagctggaac

SEQ ID NO: 53 - DNA, 20 bp, Bifidobacterium longum
tgggagaggagttcatcgac

SEQ ID NO: 54 - DNA, 20 bp, Bifidobacterium longum
gtatccagccatgcgtaacc

SEQ ID NO: 55 - DNA, 20 bp, Bifidobacterium longum
acggactcaaaaccaccatc

SEQ ID NO: 56 - DNA, 20 bp, Bifidobacterium longum
accctgcttccggtactttt

SEQ ID NO: 57 - DNA, 20 bp, Bifidobacterium longum
gcctacgcaagaccttatgc

SEQ ID NO: 58 - DNA, 20 bp, Bifidobacterium longum
cgttatacgcgtgcttgaga

SEQ ID NO: 59 - DNA, 20 bp, Bifidobacterium longum
tggaacgcaatattcaacga

SEQ ID NO: 60 - DNA, 20 bp, Bifidobacterium longum
ccaagtatggctccacgaat

SEQ ID NO: 61 - DNA, 20 bp, Bifidobacterium longum
acgcctgtctatggttggaa

SEQ ID NO: 62 - DNA, 20 bp, Bifidobacterium longum
cggtaggactcgttctcgtc

SEQ ID NO: 63 - DNA, 20 bp, Bifidobacterium longum
tcgaggttcgaggtgaagat

SEQ ID NO: 64 - DNA, 20 bp, Bifidobacterium longum
cctgttcgagaaggagaacg

SEQ ID NO: 65 - DNA, 20 bp, Bifidobacterium longum
atggaagcatgtggtccttc

SEQ ID NO: 66 - DNA, 20 bp, Bifidobacterium longum
atttcctggtggtgtcgttc

SEQ ID NO: 67 - DNA, 20 bp, Bifidobacterium longum
atggcgaaactgttggactc

SEQ ID NO: 68 - DNA, 20 bp, Bifidobacterium longum
gctaccgtgccttctcattc

SEQ ID NO: 69 - DNA, 20 bp, Bifidobacterium longum
gccgaatcgcttttgaaata

SEQ ID NO: 70 - DNA, 20 bp, Bifidobacterium longum
aaatcctcatcggggaaaac

SEQ ID NO: 71 - DNA, 20 bp, Bifidobacterium longum
gtttattttcgccgtgccta

SEQ ID NO: 72 - DNA, 20 bp, Bifidobacterium longum
aattccaatggcttttgctg

SEQ ID NO: 73 - DNA, 20 bp, Bifidobacterium longum
atgtgcgaatccgacataca

SEQ ID NO: 74 - DNA, 20 bp, Bifidobacterium longum
tgcttatctcgtccccattc

SEQ ID NO: 75 - DNA, 20 bp, Bifidobacterium longum
gcaaaatgcttggcttcttc

SEQ ID NO: 76 - DNA, 20 bp, Bifidobacterium longum
ctggattccgatgatgcttt

SEQ ID NO: 77 - DNA, 20 bp, Bifidobacterium longum
ctgcacgtatcgggattttt

SEQ ID NO: 78 - DNA, 20 bp, Bifidobacterium longum
ctcggcagaggacaggatag

SEQ ID NO: 79 - DNA, 20 bp, Bifidobacterium longum
gatcatcgacacgcaatgac

SEQ ID NO: 80 - DNA, 20 bp, Bifidobacterium longum
taaggccatcctcatcaagg

SEQ ID NO: 81 - DNA, 20 bp, Bifidobacterium longum
tctggggaaagcaggttatg

SEQ ID NO: 82 - DNA, 20 bp, Bifidobacterium longum
ctgtgcggtacctgtttgtg

SEQ ID NO: 83 - DNA, 20 bp, Bifidobacterium longum
aattacgtcccgatgctcac

SEQ ID NO: 84 - DNA, 20 bp, Bifidobacterium longum
caatacaccggcttggaagt

SEQ ID NO: 85 - DNA, 20 bp, Bifidobacterium longum
tgtagaccttgtcgctcacg

SEQ ID NO: 86 - DNA, 20 bp, Bifidobacterium longum
gcatcggtgacggctataat

SEQ ID NO: 87 - DNA, 20 bp, Bifidobacterium longum
gtgctcgacaagctgacgta

SEQ ID NO: 88 - DNA, 19 bp, Bifidobacterium longum
gtgttccgcataccaatcg

SEQ ID NO: 89 - DNA, 20 bp, Bifidobacterium longum
ggcgagtgcaccaaataaat

SEQ ID NO: 90 - DNA, 20 bp, Bifidobacterium longum
cgattccgtctattggttcg

SEQ ID NO: 91 - DNA, 20 bp, Bifidobacterium longum
ataagtccggtggcaatcag

SEQ ID NO: 92 - DNA, 20 bp, Bifidobacterium longum
caatggatgatacggtgctg

SEQ ID NO: 93 - DNA, 1584 bp, Bifidobacterium longum
atgtcatctctgagcagtaacggtcagccgtctacacgcagcagacaggccaatagcggtgaccgaaccaccgctcagctcagtgatatccgccaaaagcagctcagccacgtgctgtactggcgattcttcgtcaatctcgccctcatgcttatcgacgccgccatgtacatcatcgccggagctacggtgctcaatctgcgccatgaggcaacgccgctctattcgagcagattcaatttcacgattgactccaccgtttaccttattattatggcctgcttctgggtgtggtcgctctatgttgccggcatttatcaccgccatgttatgggtgacggttaccagctcaacgtgctgctggtcaaaggcatggtcgtgtgctgggtggtgcagtgcgcgttcaactacttcttcaatctgggtctgaccctcacgtcgctctgcttggtggtgattgccggatggttgctcaccatggtggaacgcattgccagccgtgcattcattacgcgtagtcgtcgcaagggcgcctacgcttatggcacggtgatcatcggttccccgcacggcattggtcgcacgctacaattcctcggtcagcgtcggcaactcaactaccgcccggtggcagtatgcccgattcatctcaatcccgataccggattgattgaacagagcgccgaccatgagacactccgtgaggagatgcaaaagaacaagggctgccagctgcccgtactcgagtacagcgatcataatcttgctgaacagattattgacatgaacgcgcagaccgttatggtggctgacgagctgcgtcgctattcggataattacgatatcttctccgtgcgcatggaatcgttcggtctggagattgccatgctggcttccgccgctgacacttctaaccatgagattcaggttcgatccatccaaggcaccacggttatcacgcagcgtcttgcgcaatacacgccagcccgtcgtttgaccaaacgcttgtttgatttggtgatttcttcactggcgattatctgttcgctgattatcaccattccggtggcgatcgccatcaaagtcacggacggcggaccggtgttctacaagcagacccgtatgggcctgcgcggcaagccgttccagatgtacaagttccgctcgatggtagtgaacgccgacgcgctcaagaaggagctcgcaaaagaaaccggtcagaccgaccgcttcatcttcaagatgaagaacgatccacgcatcaccaaggtggggcacttcattcgccgcttctccattgacgagttgccccagttcctcaacgtatggatgggcgatatgtccgtagtggggccgcgcccgccgctgcctgaggaatatgcccgttacaaccgtctgtacgccacccgcatgctggtcaagcccggcatcaccggtccgtggcaagtgtccggccgctccgatctgtccgccgaggaaagcgaggcccttgatgtggcttacgtgcagaactggtcgattatgggagacatcgtgctgctgttccgcacggtgggtgcagtgctgagccataagggagcgtac

SEQ ID NO: 94 - DNA, 1728 bp, Bifidobacterium longum
atggtgctgattgtaatcggcgcactgctgttgattattgcagcgctcgcggcgtggctcggcctttccgcgctcaaagcgaaaaatgaagtggaagcagcgattcaggccgcaagccgcatccaatcacaagttcaagccggcgacaccgacaaagcgcaagccagcattgaagcattctcccagcatatcgacgctacgtatgcgcagaccaagcagccggtatggaaactggccacattggtgccctattacggttctgacgtgaaggccgcgcgagacatggtgcacattttggaagacgtgtcgaacaacgcattgccgaagcttgccaaggcggcacaggccttggatttcaacagcatcggtatcaaagacggcacgattcagctgggggatatggccagcgtgactcaggatcttgccgccgccaatggagtagtggcggatgccagcgtagacatgggcaagattggtgatacgcatattccgcagattaccgaggcggtgcagcaggggcgtagcaagttcaaggagcttgccagcctgacggatacggccagtcggctgacggatgtgctgcccaagatgttcgacttggatagcagtgatggaggtggtagcggcagaggcccgcgaacctacctggtgctggcacagaacaatgctgagctgcgtgccacgggaggcattccaactgcgtgggccacgctcaccgtcgatacaggcaaaatcagcatgagcacgttcggcgatccgcctcggaatggtctgttcagccaggatgaagccgcgagcgtactgacggcggaagaacgcaatctcttctccaccaagatggccacggactacccggacatcaatttcactcccgatttcccccgcgtcgctgatatcgcgagtcagatctggcatcgagccggtcatgacgatgtggatggcgtcatcagcgtggacccggtgttcctgcagcggttattgaaggttgccggccccgtgacgctctccgatggcacggtgatgagcggcgacaatgccgagcagcggattctgaaccagatttatattgataccgatacgcaggcggagcaaaccgacttcttcacgatggcggccagtgagatcttcacgcatgtgctcaagaatgtggacggcaagaatcagcagctggtgcaaacgttccaggagtccgtatccgacggccatctgtatgtatggagtgctcatgaggatgagcagcggcgtatcttgggtacgaccatcgccggcgaattgcagtcgaaaccggctcattcggttacgggtgtgtacttcaacgatgccactatgggcaagatggactggtacctgaagcgtgaagtgaccagtacatatgacaaaacctatcccagtggcgccaagcaatacaccgttcacatcaaactgacgaatacggccgatgccgccgaggtgaatgccgctccggatctgttgcgcggctatgaccataacggcaacccccgtacgggggagatcgaaacggtgctgtacgtctacgcccccgatgaagggcgcattgtggattggacccaggatttcgatcagttcgctgtgcacgatggactgacggtgggtgtgaaaaccgtgacattgcggccgggggaaagtttcgagaccacggtgcatgtgctggccagtcccgcggccgatgaaaatgaaatgattttgagacagacccccttggttgat

SEQ ID NO: 95 - DNA, 1503 bp, Bifidobacterium longum
gtgaataaggaagaacggagcatagctgtggatgaagctgaacaggtgcaggacggtaatggagtcaccattctcgatttattcaatgcggtaagaaagcatgtgattaccgcagtggtcacgctggtcattgtgatggtggcaatctgcgcgtacacctttacccgcactccgcaatacaccgcaacttccgaactcttggccacttatcgcagttcagcggctgcgtcgggcgcatccagcaatgcaagcgagctgagctctggcgccaattacatcaatagccagattcaaacgtatccgcagttggtaaaaaccgagtctgtattgcagccggttattgatgatttgggtcttgacaccacggtaaaggaattggctgagggcgttaccgcttccaacccggatggcaccatgctggtggatatttcggttaatgatccagacccgaagcaggcgtccagcattgccaattcggttgccgaaaacctgagaaaacaggttacttccacgatttacagcgatgagggcgataagatcatctctcccgtcaacctaactgtggtgcagcaggcgtacgctccggcttcccccagttcacctaacgtcaagctcaatttggcggcaggtcttgcggtcggtgtcattctcggcatcgtggttgcctttatcaaggatttgctggacacccgtgttcgccgcgattctgatgttaccgctgttatcgatgctcccgtactggggtcgctgagccgcaatgaggcttatgccggtacgtcgccggtgattatctcccgcccggcctcccgcgaggcagaagagattcgacgcctgcgcaccaatgtgatgttcgtgctgcccgatgagccgttatccaatgtaattgtggtgacttccaccggcccgtccgaaggcaagaccacgctgagcgtgaacctggcgactgcattcgccgaaaacggcagcaaggtactgctgatcgacgccgatgtgcgcaacccctcggtgagcaaggccctaggcattgagggtgcagtgggcttgacccatctgattaccaaccgtgtatcgtcgcatgatgcgattcaacgctactggaagccgaacttccacgtgcttcctgctggaaaacaaaccatgaaccccagcattctgctgaattcccgcgctatgaaggcactggttgagcaggtttccggagcctatgactatgtgattatcgataccgcccccatgcaggtggccaatgatgccgccgtattcgccaaggaagggccagaactgctgctggtggccggcttgggagtgacggaaaagaaactgctccggcagaccgggcacgaactgagcacactgagcatcgatcccgtgggcttggccatgaattacggcgagacggagaagccccagaagggtggctattactactacggcgacgagtccgacgacaacggcaagaagcgccaaatccagcacaaaaagagcgagaaaacgaagaaggac

SEQ ID NO: 96 - DNA, 966 bp, Bifidobacterium longum
atgtaccggggagtgaaggtcattcccgtcacgaccatcgacgccaagggactggccgccctcacgtcctctttcttcgccacgttgaaggcgatcaaggcccgtccggatgtgatccactaccatgcggagggcccgtgcgtgccgcttcgtctggcgcattggttcggcatccgcaccgtcgccacgattcacggcctcgactggcagcgcgcgaaatggggacgtttcgcctccacgtatctcaagctgggcgagcgcacggccgcgaaatgcgcggacgaggtgatcgtgctgagccgtggtgtgcagcagtatttcaaagacacatacgggcgggagacacgtttcattcccaacggcattgcgccggtagaatccgtttctcctgacgtgattgctgacaagtggagtctggagaaggattcctacattctgttcttgggacgcatcgtaccggaaaagggcgtgcattacctcatcgaagcgttcaagcgattagacactgacaagaagctcgtgatcgcgggcggcgcatcggattccgccgaatactacgagtcgattaagcaggccgctaccggagatcagcgcattattctgaccgggtttattgaaggacgtgaactcgaagaactgtatagcaacgcatacatatatgtattgcccagtgatttggaaggtatgccaatgagcctattggaggcattggcttacggctgctgctgcctgacctccaatatcgctgaatgtgctgatgtgctgtgtgatgagtccggaatgatgcatggagtcacgttccgacatggcgatgtgaacgatttggccgacaaactcggtgagttgctcgtagacgtgggtaaggtacgaaaaatcaagaccggcgcggccggctatatcactggccgctatagctgggacaaggttgttcaagcgaccctcaagctctaccgaggagcagataaa

SEQ ID NO: 97 - DNA, 1341 bp, Bifidobacterium longum
atgaggattttactggtcaacaaatatttctaccgcaaaggcggtgctgaaacatatttcttcgcgcttgcggagggattgaaagcactcggccatgaggttgcgttcttctccatgcagcacccaaacaatgagccgagttattggagcaagtatttcgtatccgaaaaggactacgtcggcaagatttccgcgttcaaaaaagtgaaggaagcggcgacgttggtgtattccttcgaagcgaagcgcaagtttgaggcgctgctcgaagaattccagccagacattattcatataaataatgtgcatcgccagctcactttgtcgattctggatgcgccttatttgaagaagcaccgtgttccggtggtgtatacagcgcacgactatattctgctgtgcccggcttacacgatggtggacggttccggcaaggtttgcgacgattgccttgactgtcacttcttccatgcggtgaagaaaacttgtgtgaaaggatcgaaagcgaagagtggtctggcgttccttgaagcggaattcctgaagaaccatcattcctacgacaagatcgacaaaatcatcgcccccagtgaattcatgaagcacaagctggatgagggtggatatgccggcagaaccgtggccatgcagaacttcctgaccaccagccaaatggacatggcgcataaggtagccaacacgaataagttcaataccgttgagccgtatttcttgttctttggtcgactttccaaagaaaaaggcatccttacattggtgagggcgttcctgcgggctgcaggcttgatgaatagtggggttgcaggcagcaaactcctcccagccaattggaccttgcatatcgtcggcgatggtcctgagcgccaggctatcgaaaatctcatcaaatcagccggccctgaagctgaacgccgtatcaaactccttggctacaagaccggagaggatcttcagcgcgaggttggcaatgctcgcttcagcgtgctgtgctccgaatggcgggagaacatgccttattcaggtttggaatccctggcagcgcagactccaataatcggcgcgaatatcggaggaattcccgagcttgtggtggaagggaaaaccggattcaggtttgaatccgggcagttagatgatttggcaaaccatctattgcaagcgtcagcactcaatggtgatgaatatgcagtcatgcaacaggaatgcggcgactatatcaatcgcagagctcaacaaagcctttatatccgttctcttggggaactatacatgcgctgtttgcagattccaacccagcaaagggatgtcgaggaggagaaa

SEQ ID NO: 98 - DNA, 1062 bp, Bifidobacterium longum
atgaagaacacaattgatttgcataatgccgctgtactggtcactggcgctgcgggattcatcggctcgaatcttgcaaagcaactgcttgattctattgaagggattcatgttatcggtttcgataatgtaaatgattattacgatgtgcgtcttaaggaatatcgccttaaccagctctctcattatgaagggttcactttcatcaaagctgatttggcagataaagacgcagtaaatgatgtattcgagcaataccgacctaccgttgtggtgaatcttgccgctcaagctggtgtgcgatattccatcacgcatcctgatgcttatattcagtcgaatctgattggtttttataacattcttgaggcttgtcgccatcatccggtggatcatcttgtgtatgcatctagctcctccgtatatgggtccaataagaaggttccatattccacggatgacaaggtagataatccagtgagcctatacgctgctacgaaaaagtctgatgagctgttggcacatgcctactcaaagctgtatgacattccttctacgggcctgcgtttctttaccgtgtatggacctgccggacgccctgatatggcgtatttcggtttcaccaataagcttcgcgcaggagaaacaatcaagattttcaactatggcaattgccgacgtgactttacctatgttgatgacattgttgagggcattctgcgcgtgatgcaaggtgcgccttcgaagcagacaggagaagatggtctgccggttccgccttatgcggtgtacaacattggtaacgggcatccggaaaacctgctcgaattcgtcactattctgcaggaggagcttctacgagccaaagtgcttcctgcagattacgacttcgaatctcataaagagctggtccccatgcaaccaggcgatgtgccggtcacgtatgcggatactgcggccttagaacgcgattttggctatagaccttcaactccgctgcgtgaaggcttgcgtcgatttgccgagtggtacaagaccttctacctcgatgactctgataaa

SEQ ID NO: 99 - DNA, 1248 bp, Bifidobacterium longum
atgaaggattttgattcattgaagattgccgttgctggtaccggttacgttggcttgagcttggctacgcttttggcgcagcatcatcaggttaccgcggtggatattgttcctgcgaaggtcgacatgatcaacgcccgtaagtccccgatccaggacgattacatcgagaagtactttgcggagaaggagttggacctcactgccacgctggatggtgaaagcgcataccgcgacgccgatttcgtgatcatcgcgactcccaccaactacgacagcacgaagaactttttcgacacctctgcggtggaggccgtcatcaacctggtgatgaaggtgaatccgggcgcgatcatggttatcaagtccaccatcccggtcggttacaccaagtcgattcgtgagaagaccggttccaggaacatcatcttcagcccggagttcctgcgcgaatccaaggcactgtacgacaacctgtacccgagccgcatcgtggtcggcaccgacccggaggaccggcatctcgtcgaggcggccgagacgttcgccaagctgctgcagcagggggccatcgaggagaacatccacacgctgctcatgggcttcaccgaggccgaggccgtgaagctgttcgccaacacgtatctggcactgcgcgtctcctacttcaacgagctcgacacctacgccgagtcgaagggcctgaacacgcgcgagatcatcgacggcgtgtgcctcgacccgcgcatcggcacgcattacaacaacccgagcttcggttacggcggctactgcctgccgaaggacacgaagcagctgctcgccaactaccaggacgtgccggagaacctcatccaggcgatcgtggattcgaacaccacccgtaaagacttcatcgccgaccgcgtactcgagcttgctggtgcctatggccccaacagcgaatgggatgccagcaaggaacatgagaccgtggttggtgtgtatcgcttgaccatgaagtccaactccgacaacttccgccagagctccattcagggtgtgatgaagcgcatcaaggccaagggtgcgacggttatcatctatgaacccacgctcgaaaacggctctaccttctttggctccgaagtggtcaacgaccttgatgagttcaagaagcgctcgcactccattgtcgcgaaccgttatgactcttgcctcgatgacgtaaaggacaaggtctacacccgcgacctgttccgcagggac

SEQ ID NO: 100 - DNA, 1062 bp, Bifidobacterium longum
atgggtgagagtatatgtttcattatgccaactatggacggtggcggtgccgaacgagtggtctctattctctctggcgaattcgctcgtagtggatgtgatgtgacgttgttcttaactaacagcactcataccgcgtatgctttggacaagcgcgtccatgtcgatacatcctgcgcggaaagcaacccgaattcccttgatcagattaaagctattcgggcgaagatgagagcgatgccgaatacggtatttatttccttcatggatagtcaaaatttgttcactctaatagcgggaattggtatgcggaaccgcataattatctcccagcgtaatgatccacaccgtgcttttggaaagcgtcggctggttagggctattcatccgtggctatacgctcttgcggactgcgtggtattccaaacacaggatgcacttgagtattaccccaaatatgcggctggtaagtaccgtgtgattcttaatcctctcaataatagcatgctgccacgctatgaaggtgaacgatccaagcgagtggttaccgtttgtcgtttgaatgagcagaagaatttgccgctcgccattgatgcgtttgcagaattccgcacacggttctgcgactataccttcgagatttacggcgaaggcgcactggaaaatgatctaaagcgttatgcagtttcccgaggggttggcgatagcgttcatttctgcggcttccggaaggatgttcatgcctgcattttcgatgccgccatgtttgtcatttcctcggattttgagggactctcgaattcaatgattgaagctattgcgttgggaattccgacgattgctacggactgcccaatcggtggggcccgcatggtcattgacaatggcgtaaatggatatcttgttccggttcggaacaaggagcgcatggttacggctatgtgcagtattgcaggcgatactggtgtgcaggaacgctttagcaaagctggcgtgcggttgcgtgaacgtttgtcggttgactctatttcgaagcagtggctttcggccattaaagagaaa

SEQ ID NO: 101 - DNA, 828 bp, Bifidobacterium longum
atgaagattttggttaccggtgctaatggatatttagggcgcggtgtggttgatgagttgcttaagcgtggaaacgaggtaatcgccacagacttcgcctgtgaccatgtgaattctgcggctcattgcgtgcccggagacatcttctcgattgaagatccctatacgtacttcggcgagcccgatgtggtgttgcatctggcttggcgtgatggttttgtacacaattcgaatgcgcactttgaggatttgcctaagcatgttgcattcctgaaaaaactgtgcgaatccggaatccagcaagtggcgtgcatgggatcgatgcatgaaatcggattccatgaaggcagcatcaacgctcacaccccatgctggccgatgagcatgtatggaatcgccaaggatgcgctccgtaacgcattgcagaccatagcgttgcagaacaaagtaaagttccagtggcttcgtggatattacatcgtcagcgatacgcaatatggcagctccattttctcaaaaatcgttgcggcggagatcgaaggtaagaaagagttcccgttcaccacaggtcagaaccagtatgattttctagattatcccgatttctgtcatcaagttgccgcggcggtgaatcaggatgaagtgttggggattatcaatatctgttccggtaagcccgaaaaacttgctgatagggtggaacggtttattgccgagaatgggttctccatcaaattgaaatatggtgcattccctgatcggccctatgactccaaagccgcgtggggcgatgctttgaagattacccgaatcctcgatacggaacat

SEQ ID NO: 102 - DNA, 507 bp, Bifidobacterium longum
atgggtactttgctcgagcaggataagtatcgatacgccgttgagaaaatgcctagattccagcggttatttcgttgttgccaagagtgcaggttcaagcctatgcagttggtgtatcgactgctgtttcgctggtgccgtcagaggaatttcatcgagttaagccatcaaacggttatcggtggtggcctgtatatcggacatccttattgcatcaccatcaatcctcaagccgttattgggcggaatgtcaatatccatcgaggggttgttattggccaggagaatcgtggaaagagaaaaggtgctctaacgcttggtgatgacatttggattggaatcaatgcgtcaatagtgggaggagtgaaggtcgggaacgacgtaatgattgctcctggggcctttgtgaatcgcgacgtgccaagtcactcggtagttattggcaatccttgcattatcaagcataaggatcatgccaccgagggatatatcaatcataaaagtcag

SEQ ID NO: 103 - DNA, 1014 bp, Bifidobacterium longum
atgggagctcacaatagcattagacgctatcttcaccgcattggtgaggaaatacgatctacggcggaaatagcgaaattgacttcatggccggctgcagtggaaacgcttattgctaaggcggatatccaaattatgtgccgtaatgggtatgcggaaccgccgaatgcgcgtcgtcgtctgattcgtaagcatgaaacactgcttaagtatttcgagaaacgatatggagatttcgcttctggctatcgctataaggtaaatcttccagccgtaccggaggaactcaaaggttgcatctggttatgctggtggcaagggcttgaccatgctccgcgtatcgtccaacgctgtgtagaatcgattcgcgaatatgcgggagatcgacgtgtgattgtgattaccgaggacaattatcgtgattatgtgaccttccctgactggatgatgcgcaaatatcatgaaggcactattgctcgcacacatttgtcggacttgctgcgtttatcgttgctggctcagtatggcggattgtggttggacgcgacgttctattgcgctggcgatattgaagactgttttggccagccattgttctctatcaagcgccccgagtatttgcatgcaagtgtggcgcagggatattttgcaaattactcttttggatgtgatgccgaccatcgttggatatttgccgtgatacgtgatttcttgcttgaatattggcgtacaaatgattttatggtcgactacttgttcttggattatttaatcgtactagtgcaacgacattgcactgcggttaaggaggcgtttgcagcaatcacccccaataatccacaatgcgatgacctgttcaagtgtttaggtgatgtctttaatgagcgtcattgggagtcattaattgccgatacatcattgttcaaattgacatggaagcaagagtttcccaccgaaatcaatggtgtcgaaacttattatggaagattgctcaacggcaatttgcgtcgaaat

SEQ ID NO: 104 - DNA, 1341 bp, Bifidobacterium longum
atgattcgcataacgaagaccaaaacactccagtacgcgtggctgtaccttatgttactgattccgggcagctgcgcgatgtcacgctatctgaataccacattggtgtatggcgtgattattgctatatatgccctgcttgcgttgttgagcgcaaaatataggaatgtttatgtgctgtcgttttgccttttgcttgcattggcaacgattgttatccgattgaaaacaggaggtgtggggcccctaagttttctttccaacgcagcgatgctggttgtcacctatatcgcaatgactattgatcggagaatgtttcttacccgattcgtaagaattgtttgtttctttggcatcatcagtgtgctattttgggcggcgttttgcattaacccttcgctggtgaatgcatggcctgcaacatcattctggacgcagaacttggggacgggtcaatgggccactgtgcttcatggaaaaggactctggctttactcgtatcttgaaatacacgcaacccgtaattgtggtttctacactgaacctggcgtgtatcagattgtactcaatgctgttttattcgtcctgttattttggaaaaagaaattatattttgataacgagaagcaatatcgtacggcgaccgtcattgtcttgctcacactgattacttgccagtcgacgaccggttatctttctatgatggtcatcttgttgtgcttcttctttatgcgtggcagagagcgaggcatacgtacgctgaaacaaaagcttgcagtgctagtggtcgccattacggcggtgctgatcactgattatttgcttcgcggggaagagagtctcctttatgttcaagtgctgaacaagctatttggtggaggcattggcggtggtgtcaatttagaggatagcacgggacaatatcgttggattacagtgatggctagtttgaaggctctttccatggacccgttcggtatcggttttgacgcattctatgcgatacgagactcatttgacccagctgcagttgccgctagcattgcgacctatgccgcagtgtatggaatgattttctggctgacgatgatgattatgattttctatccaatgattcgacgggaaccaaagaaaatactcattgccgtatttgcttttatgtttatcaattccacggttagcgagacgtatttgttctatccgggtctcatgatgttcccgatttatctcagctcctatttcacacataagcagtccagtgtcgttggacatgcgattgctacatgtaatcctcgccattcgctaatggtttccaatctgatgaatgctaaagaggtgatg

SEQ ID NO: 105 - DNA, 930 bp, Bifidobacterium longum
atggaacggactctgctgcttgttcccagcggtagcttctattatttcaatagtatgaaacttcctaatgtggtggttttccctgtgttccgcgaagttcatggcgcgtccgaaatggtttggaaagcaatgaggaagctgaggcttgctgccagctcgctgttctatactgattggtacaaggatttgcagtcgttttccaagatcattgtttttgattttacggtatggctggatccggcgttattgcgcaacattaatagacataaaaatcctgacgcgaaatgttatctatattcctggaatattgttcgcgacaagcaggttgtccttggtcatcttacggcgtgcaggaagtatggtttctcatattattcgtatgacgaaaatgactgcaagcaatatggattccgcttcaacaccatcatgtatgacgagaacttgcgtctcccggaacgtgctctgacgtcagatatcctgtttcttggttttctcaaggatcgcaaggcaaaaatgcttgctttgcatcaaatcatctccgatgctggcatgaaaccggaattcgtaattgttgaaaacggtaatcagcatgaagatttgccattcaccattaggcactcatatgttaattatgcggattatctcgatatggtttcgcaaagcaaggcgattttggatatcacgcagcaaggtcagaacggattctctatgcgcgtgatggaatccattttcctcaacaagaaactcgtttcgactaacatggctctattgtcagcgaatttttatgatcccaataatattctggtcattgatttgcagaaccctgatgaagaagagcttaccgtgttcctgcgttccgagtttcacccatattctcaagagacaagacactactattccgtcggctcatggatcaatcgtttccaacaa

SEQ ID NO: 106 - DNA, 1392 bp, Bifidobacterium longum
atgaaatcggcggtagcatacacattcgcatcgctgttttctaaaggtttggcctttgttactgtgccaatttttacccgaatcatgtcaacttctgagatgggcacagtcaatctgtacaattcttggcagtcgatactgacggttgtggcgacgctctcgttgacttacggcggatatatggtcgcgttgaaggaatatgagcatgagcgcgataggtacgaatcttcagtgctgacgctcacgacgttcacatcaatcgtattctttgccgtatattccgttgctcccaatttttggagtcgcatacttggcctagacaaatcgctgttgctgctgatgctagttggtttcctattgctgccggctacggagttctggctggcaagacagcgttacgagtataagtacaaggcagcaacactggtgacgattggctccgcaattgtggcatcagcactttccattgtcgctgtattgtatatgcgaggaagcggaaaagcggccgaaggacgattgttcgcgaattatgccgtgctatatgctgttgctcttgtgctatgggtatacatcatggtgcgagggcgcaagttcatttccatgcggtattggaaattctcacttgctctgagtgtgcctcttattgcgaatcagttcgccacgcagattctgaataattccggtcgcgtgatgattggttggttcgttgataattccgctgtgggcatttatggcacactttcctcggtgagtaccgtttccgcaatcgtatggtcggcaattaattcttcgtttatcccattcctctatcggaatattgatgattccgaaggcaagaaaagagttcggagcctcgcttcgattctgctgctcacctatgctgcggtatgcgtattgatgactttcctagctcctgaggtggtcaagataatcgcaactgatgaatatatggcagcgatttacatcatgccgccaatttctgcagccattttccagaacgctatttccaatatgtatgcaaacgtgttgttgtatcacaaaaaatcttcatacataatgattgcctctatttgtggcgcagtactgaatattgtactgaatgcagtactgattcctctatttggataccaggcagcggcctattcgatgttgattgcattcgtattcttgtcgtatgtgcaaatgcgtgtgtccaaaaaactgcacttcactatcacgggaaccaaggaaaccgtatatgatgacaaagtcattatcggtatacaatggctggtaattgtgctttccgccattgcgattcctctatatcacttcacgattattcgttatatagcagcatttgtcctgatggttgcctccttgttcctatacaaaaagagcaaaatatctgtc

SEQ ID NO: 107 - DNA, 492 bp, Bifidobacterium longum
atgaatcatttccgtaatgctgagaaaaatgctgctcattaccgaaagctgggtttaaagctgggggggggcttcgagattctcaatggctgggattttggaagtgaaccgtggttgattgagatcggcgataatgtcaggattacatctggtgttagatttgtgactcatgacggtggcgtgtgggtattgcgtcataagtatcctgagttatccgatatcgatctctttgggaaaattcgaatcggcaataacgtgcatattggttttaatgccattattatgccgggggtaacaatcggagataattgcattatcggatgcggcactattgttacgcatgatattcctgcaaattccatcgtagtgggtgtgccgggtagggtgatcgagtccgttggtgaatatgcggctaaacatgatgatgattttatgcatactaaaaagatggctactgatgagaaaaaagctttcgtacttggccatctaaga

SEQ ID NO: 108 - DNA, 1149 bp, Bifidobacterium longum
atgacagcgaagattctggtaacaggcggcgcaggttttattggtagcgagatcgtaaaacaactgagcgctcatgatgaatacgaaattcgcgttctagatgcattgaccaaacaaattcatggcaacaatcctgaaaagtcatatcttttccaatccataaaagattgttgtgatttcatccgtggagacgtgcgtgatttcacaacagtccagaaagcccttgaaggggtagatgttgttttgcatcttgcggcagaaaccggtaccgggcaatccatgtacatgatcaaccagtacaacgaggtcaatgtcatgggtttgtcaaatatttttcaagcactatcgctcaagggggaaagcaacactatacgcaaagtcatcctgtcgtcatcgcgttctgtgtatggcgaaggcgagtatcaatgcccaaactgtggcgtagtctacccccgtggacgcaaaactaaagatatgatgcaaggcgatttcactatgcattgcgacaagtgcaataccgccttgaccttaatgcccaccaccgaagacagcaaaaccaccccaaattctctttatgcgttcaccaagctttcacaagagatgatgattcagacaatgtgccctgcgatggatattgattacaccatcttccgtttccaaaatgtgtacggagcaggccaatcattgaagaatccttacactggcattctttccatcttctcctcattgcttttggacaataaagacatcaatatctttgaagacggcaaggaaagccgcgacttcatccacgtaaaggatgttgcttccgcggtcatcaaatctatcaatacggccgcatcgaacggagaaatcatcaacctgggcagcggaatcggaacaagtgtcatcgaaatagctgagacattgaaacgaatctatggcagtaccagcaatctgaacgttaccggtgatttccgtatcggagacatcgcacataatgtcgctgatacccaaaaggcacgaaagctgcttgatttcactccgtcgatttccctgcaggaaggtttgaccgagttttgcgaatgggtgctgggacaagaaaccgacaacagtcgttacgaacaatcccttacagagatggaacgttcaggaatgtttattcgaaag

SEQ ID NO: 109 - DNA, 579 bp, Bifidobacterium longum
atggccggctcctgttccaaggccgcctataggccacgcccggccaggccggacgacgacccggctcccgacatcctcgcccgcgagttcaatggctatgcgccgcgcacccatctggcctccgacccggcctacgtgagggtcggcagttcgtgggcgtacgtctgcctgcccggcgacctggccaaccggcagatcgccggccattcggtcggcgtcgggcacgacgccgatctcgtgttggccgcgttcgccgcgctgcgcttcccgctggatgagatcgaggtgttccacacggaccgcggcggcgggttcgccggggaacgcgtcgaacgcgtgctcgacgtgttcggcgtcacgcgttccctttccaggccgggcaacccgtacgacagcgcggtggtcgaatccaccaaccggctcgtcaggaaggaactcatccacaggaacgtctacacgaacgtggagcaaccacgctcggacgtcaaccggtacgtgtggtggtacaaccaccaacggctccactcgaccctcgggtacctgagccccgtggagttcacacaacaaggaaaaaccctc

SEQ ID NO: 110 - DNA, 156 bp, Bifidobacterium longum
gtgcaggggatacgtaacagcggctccacgaaagcggccgacaaccgcactcccgaggagaacgagctgatcgaattgcggaaacgcgacaggcagctggagatggaggtcgatgtttcagaacaagcggcgccggtattcgcacgaaagcaggcg

SEQ ID NO: 111 - DNA, 1020 bp, Bifidobacterium longum
atggctgatgaagttttctctccgaagaacgttattgtgaccggtggctgtggttttatcggttcaaatttcgtgcattacgtgtatgaccatcatcctgatgtgcatgtgacggtcctggatgcgttgacgtatgcgggcaacctggagaacatcaggggcatcctgggcgaccgcgtggagttcgtgcacggcaacatctgcgacgcggaactgctcgacaagttggttcctggtcatgatgcgatcgtgcattacgcggcggagtcgcataacgacaactcgatcgcgaatccggagccgttcctgaagaccaacgtggagggcacgttccgcctgttggaggcggcccgcaagtacgatgtgcgctaccatcacgtgagcacggacgaggtgtacggcgacctggccctggacgatccggccaagttcacggaggagaccccgtatcatccctcgagcccgtacagctcgacgaaggcgagctcggacctgctggtgcgtgcctggcaccgcacgttcggcatccgcgccacgatctcgaactgctcgaacaactacggcccgtaccagcatgtggagaagttcattccccgtcagatcacgaacatcctcgaggggctgaagccgaagctgtacggcaacggggagaacgtgcgtgactggatccacacggacgaccattcgacgggcgtgtgggcgatcctgacgaagggccgtatcggcgagacgtacctgatcggcgcggacggcgaacgcaacaacatcaccgtgctgcgtgacatcctgaccgtgatgggcaagtcacccgatgatttcgattgggtgaaggaccgtccgggtcatgaccgccgttacgcgatcgattcgacgaagctcaggaccgaactgggttgggagccgacgcatacggacttccagaagggcctggagcgcacgatcgagtggtatacggagaaccgcgcgtggtgggagcccgcgaaggccgccaccgaggccaagtacaagcagcagggacag

SEQ ID NO: 112 - DNA, 957 bp, Bifidobacterium longum
atgggtctgggtctgccggatttcggcccggtgcagaacaacatcagcttcaacgcgacgaagggcgtgacgcgcggcatccacgcggagccatgggacaagtacatcagcatcgcgaccggtgagatattcggcgcgtgggtcgatttgcgtccgggcgagagcttcggccaggtgtacacgacccgtttggacccgtccaaggcaatctacgtgcctcgcggcgtgggcaacagcttccaggccttgcaggacgggaccgtgtacacgtatctggtgaacgcgcactggagtctggaacagaagaagacgtacacgttcgtgaacctcgcggacccggagctgggcatcgagtggccgattccgttggaggagtccgaacgctccgaggcggacctgcatcacccgatgctcaaggacgccaagccgatggagccgaagcgcacgctggtgacgggctgcaacggccagttgggccgtgcggtccgcgcgtacgcggaggcgcatggtctgcgtggtttcgaatacacggacatcaacgagttcgacttctccgatccggccgcgtacgacgagtacgattggagcctgtacggcacgatcatcaacgccgaggaactatccgcggacaagtgcgaaatcggggagaaccatgctcgggcatggaccatcaacgcccaagggcccgcgctgttgtctcgtgcggcgaaggatcatcacgtcacattggtgcatgcgagcaccgataaggtttacggagccgattcggaagccaaagcgatcgccccggagagcgtctacgggcagacgaaggctgcgggcgacatcgcggtggcgaatgcgccggaacactacatcctgcgacgctcggaatccgccgattcccggaacatcgtggacacgctgttccagctgctcgattctcacgccgaatacggcgtctatgccgtcggtgac

SEQ ID NO: 113 - DNA, 897 bp, Bifidobacterium longum
atgaagggcatcattctcgccggaggttccggcacccgcctttacccgctgaccaccgtcacgtcgaagcagttgctgccggtgtatgacaagccgatgatctactatccgctcagcgtgctcatgcttgcgggcatccgtgacatcctgatcatctccacgccgaaggacctgccgaacttcgaaaagctcctcggcgacggttcgcattacggcgtgcatttttcctataaggtgcagcccagcccggatggtttggcgcaggcattcctcttgggagaggagttcatcgacggcgagccgtgcgcgctcgtgctgggcgacaacatcttctacggtaacggtctgggcgccacattgcgcaaggccgtcgctaaggccgaaggcggcgagggcgcaagtgtgttcggctactatgtcgacgatccggaacgctatggtgtggtcgagttcgacgagcataaaaaggccgtctccatcgaggagaagccgaaggagccgaagtcgcattacgcggtgacgggtctgtacttctatgacgagcgtgtggtcgagttcgccaagcgggtcaggccgtcggctcgtggcgaactggagatcacggacctgaacaagatgtatttggaggacggctccctgaacgtgcgaacgctgggtcgtggttacgcatggctggatacgggtaccatggattccctgtacgaggcgggcgagttcgtgcgcaccgtgcagcgcgcccagggcctgcccatcgccatcgtggaggaaatcgcctacgaaaatgggtggatttccaaggaggagctcctcgaatcggccgaacgttacggcaagagcccctacggcaagcatctcaaggatgtggccgaaggcaaagtcgtgattgttcctaacgac

SEQ ID NO: 114 - DNA, 1245 bp, Bifidobacterium longum
atggcatgttcttacatttctgcgtctttgcccggacccgttcgccgccacaaagacagagcgcagaacaacgcaaccaccaatataagcccccgcactcaggcaaacctcaggttacgattggtagatatgagcaattccgaacaggccctcgactcaaccaacgaagcagtcaacaaagcatccaacgaagcaaccaacccatcattcgcgccgcaacacattctggtcaccggtggcgcagggttcatcggcgcaaacttcgtgcactgggtggcgcgcaaccatccgcaggcccacatgactgttctggatgcgctcacgtatgccggcaaacgcgagaatctcgatggcgtgccggccgcgaacctgacctttgtgcatggcaatatttgcgatgccgagcttgtggaatccctgttttctgggctgaaccaacgctctgcagccgcagtacccccgattgacgccattgtgcacttcgccgccgaatcgcataacgataattcgattctcgacgcctccccattcctcaatacgaacgtgaccggcacgtacgtgttgctcgaggccgcccgccgccacgatattcgattccaccacatcagcaccgacgaagtgtatggcgatctggctctggacgaacagcgcaaattcaccgagctcagcccttacaaaccgtccagcccatattcggcgtccaaagccgccagcgaccacttggtgcgcgcctggcaccgcacgcacggactcaaaaccaccatcagcaattgcagcaataactacggcccctatcagcacgtggagaagttcattccccgccagatcacgaacattcttgccggcattcgcccgaaactctacgggcaaggtctggctgtgcgcgactggatcagcgtggaagatcactgcagtgccatctggactattctcacccgaggccgcatcggggaaacctacctcgtgggagccaatggcgaatacaacaacattgatgtgctgcacatgattctgaagctcatgggtcgtgacgccaatgacttcgaccatgtgaacgaccgccccggtggcgataagcgctatgccatcgacgccaccaaacttcagaccgagctcggctgggtgccaaagtacaccgatttcaaggaaggtctggccgcgaccatcgactggtaccgtgcgcacgaaagctggtggatgccggataaggccgggactgaggaaaagtaccggaagcagggtcat

SEQ ID NO: 115 - DNA, 1485 bp, Bifidobacterium longum
atgattcgtttacaaagacttgttctagacaacatgaggaacatatcgcacggcgtcttggattttgacgatctgcccgctggcggcagcgtaacgggtatctatggacagaatggatcaggcaagaccaccgttatcgatgccatcgggatactgcgcgcgctgctatccgggaatatgctgccggacaccgccggcgatgccattagcgtcagcaccggtcttgcaaccttgacggcgacgctcctcatcggaggaaaacagaagcccagctaccttgaatacaaggtgtccctgcgtagagcgaacccggattcgacgcgagcgcgcgtcgtttccgagtcggttcgcatcggcgacgatctctcacgcctaggcagggaggcgttggggcatcggatggaggattctgagaccgatggtttcgtgtcaactccggtatatgtgtggcgctccatcgaggcggtcacctcggtgaaaaccgtggtctcacgcaccgctgatcgtgcgtacatggaggggcgctcattcctgttctcgcggtgtgccgcgcttgaagaccgacccgatgccgagttcctcatcgactgggtggtctcccgcgtgcgggaagcgaatggtgtgtccgccagatcactgacatacatcaacgaacgtttcgatgagttcgtacgcctacgcaagaccttatgcgattacgcgaccaatgatgtcttcgtatccactacccgtcgtggctcctatgccgcatatgcgttcatccccatcatggaggaggattccgcaggtcgcaacacagagtttctgttcgacctgttgcaaccgaacccgctgaccccgggccaggcgaaacgacttggacagaccgtggagtccttcgaccgcatcctgcccaccctcgtgcctggtctgcatgtcctgctgaagatcggaaccgcgccttccggcaaagatggcgaggaccgggtcaccgcggagctgttctcgcgtcgtggcgatatcacggtcccattccgctgtgagagcgaaggcatcatacgcatcaccgcgctgcttggctatctcaagcacgcgtataacgacgagaacgcgctggttgccgtggatgagttcgactccggcgtgttcgagttgctgctcggtgacatgctgtaccagttggcggacgggtgcgcagggcagctggtgttcaccgcccataacctgcgtgcgttggaagtgctgccgaacggctgcattcgcactacagtgaccgatcccaataaccggttcgcgatcatcccccgcaagtcctccacgaacaaccagcgccgacggtacctgacggccagcgagctcggctggagcggccccgacatctatgattcgcccataccacgcatgttcggcaacagtctctatgccgccggccatcccgatgaggacgatgacatcgacgacgatctggcagcactcaacacctccggaacgaaggtgaaccgtggc

SEQ ID NO: 116 - DNA, 702 bp, Bifidobacterium longum
gtgccggcattctcgtcgttaatcgagaaccgcctattccaagggcaggaattccactgcgacgtgttgactgcgccaaaccaccgtgaggagttccggcgtcgtaacgggttctatccagcggacaatcctgtccagacggtgcgcgaactcgtggagtactacctcagagaccacgaccgcacctggggccagctcggccatgtcatccagatctgcgacctagacggggcgttcacatctgacgatcgagtgcgggaagacccattggtggatggaacgcaatattcaacgaccgacatcatcacgccaaaccgcactatcctgattgcggatcgcacgaccaagcgaaacggcgtggatgccttgctgaaactcgatgggttcaggaagaagaacggccgcgccacgctcatggtcccgtaccgcctgttctacgtcagccgcaacctcgaacacgcatttcgcggtaggattgacaatctagacgcacagcacaagcagagcagcgccatcaaactagcagaccgctttacccgcaacccgaacctgttctctacaacccttcaatctcttcggcgaatacacggcaatccgacaacgtgggaggaatcttggcaatatgccatgcaagacctccactcactcgaacgcggtagcaacctcgcattcgtggagccatacttggcaggcgaactgcgg

SEQ ID NO: 117 - DNA, 306 bp, Bifidobacterium longum
gtgcaacgcctgtctatggttggaagtgttcaagtccacaaccgaagagaaagcgttgcactcgatatgaaagcctattcccacctgtcggcacaggaacgcatccggatcgacgagctgaggaaccgcgaggggctcggcgtgtgccagatcgcgttgaggatcggccgcgacaagtccaccgtcagccgcgagccgggacgcggcccgtggttcgcgtccgacgagaacgagtcctaccggccctacaggccgaaacggctgaaggctgtatttcgtcaaattgaggtggacgtgttcggcact

SEQ ID NO: 118 - DNA, 768 bp, Bifidobacterium longum
atgagccagcaaaaaccgcggcagcgcggcggccgcgttcttgacaaggccacgccggaacaggtcatgggcctcgcccgcaacctgccgttgacacacagcgtgctcgagaaggccctggcggacgccacgcccggccagctcggcttcctggccaacctgttcgagaaggagaacgcgagccgggccgaatccaaacggcggcggctgctcaaacaggccgggttcccccagagcaagaccctggagggatacgaccggggcatggcctcgttccccgccgaccggggccgcgaacagctggaaagcctggaattcgtcgaccgggccgaggacctcgtgttctacggcgacgtcggctgcggcaagacccacctggccatcgcgatcggcatgctcgcatgccaacgcatgatacccgtgaggttcttcaccgcctccagcctggtcatgcgcttgaggaaggccaaggacgacaacagattggacgccgagctcaagtcgataggcagggccgggctggtcatcatcgacgagctcggctacctgcccatcgacatcgacggggccaggcttctgttccaggtcatcgcggacagctacgagacccgcagcgtcatcttcacctcgaacctcgagtccggcagatggggcgacgtgttcggcgacggggacatggccgccgcggtcatcgaccgcatcgtccaccacggcagtatcctccgcttccacggcgaatcctaccggaacagacactccctcatgaaa

SEQ ID NO: 119 - DNA, 1458 bp, Bifidobacterium longum
atgacgacaccggtgtgtgtccgacggcgtatcaggcagctcgaccgccagggcttgagccacagggagatatcgcggaaactcggcgtatcgcgcacgaccgtggtcaagtacgccaaccacggggattgctctcccaagccccttggctcggggcatgcgggcaggtcgctggtcgacgcggggtattcggccgtcgtggacgggtggccggccgcggatctgcgcatgcccgtcaagcagcgccacaccgcgacgcgcgtgtacgagcggctcgtggcggagtgcgggttcacgggctcgtattcgtcggtgcggcgctgggtcaagcgttggaggcgggagcatcgcgtggagtcggacggcttcgccgagttggagtgggcgccgggaagcgcgcaggtcgatttcggccaggccagggccgtggtcgccggagtcgaacgcgtggtgcatttcctggtggtgtcgttcccgtattcgaacatgcgctgggtggtcgcccttcccggcgagacctcggagtgcgtgtgccagggtttgctgtggatcttcgagcgcatgggcatggcgcctagggtggtggtgttcgacaacgccaccggtgtgggccatcgcaggccggacggcacggccgcccggacccgcttgttctccctgttccgcgcgcattacgggttcgggccgcggttccgcgacccgtattccggccacgggaagggcagtgtggagaacgccgtcggcttcgtcaggcgcaacctgatggtgccgatgccgtcggccgagagcttccaaacgctgacgcgcgtgtggcttgacgagtgcggacgcgtcgccggatcggaccactgccggcatgatgttccggtgatcgaactgttcgaggcggagaaggaccacatgcttccattgcctggcgtgcggttcgacccgtgcgactggaggagcgtgaaaaccgacaagaccggcgccgccgcgatcgacgcgaaccggtatccggccggaccgaaatggcgttccatgcgcctgcaggccggggtgcgcgtcttcgagatcgaaccgcggggccccggcggcgaaacgatcaccacgccggagaggatttggggccattcggcgaaaacccaggtggatccggcgagcctgctcgcgatcatcgcgcgaaagccccgcatatggggcgaaagcccgatcaggaacgatttccccgaaaccgtgcgagccctgctcgaccgcatggacgcacgcacgcgctccaatctgctcgacgacatccgagccgttgccgccgactgcgggttcgccgccacggtcaaagcggtggaaaccgtcatcaacgcgggacggaccgtcgaccgcgcggcgatcggcacatgtgccaaacgcatcctcgagggtgcgggaaccgaaggcgggcaggatttgaagcgttacgacaaatacatgaaggaggccgaa

SEQ ID NO: 120 - DNA, 972 bp, Bifidobacterium longum
atgcagaccagtacaagagatatagtggagtgcatgcctgagaattcgaacgtttccgttgcggtacttcttccttgctacaacgaagaagtcaccatcggcaaggtcgtgcgtgattttaaaatcgcgctgccgcaggcggacatctacgtgtacgacaacaactcctccgaccgcaccgccgagatcgcggcggcggaaggggccatcgtccgcaaggagccacgccaaggcaaaggcaacgtgatccgagccatgttcgaagacatcgacgccgatgtgtacgtcatggccgacggcgatgacacctacccagccgacgcggcacccgccatggtcgagaagatcgccgaaggatacgacatggtaatcggcgaccgcttgagctccacctacttccaagagaacaagcgcccgttccacaacttcggtaaccgtctggtgcgcggttcgatcaacggcctgttccatgcgaacgtcaccgacatcatgaccggctaccgtgccttctcattcaccttcgtcaaaacctaccccgtgttgtcgcgcggcttcgaggtcgaaaccgaaatgaccatccactcgttgaacaacaacctgcgtctgttcgagatgccaattcagtaccgcgaccgtcctgccggatccgtcagcaagcttgacaccgtgggcgacggcatcaaggtgatgggcaccattttccgcatgatccgcgaatacaagccgctcccgttcttcggcggcatcggctgtgtcctcggcgtccttggcgtcgtgctgtgcggcacggtgacggtggacttctggaacaccggcatggtggcccgattccccacgctgatcggagcggtcatgcttgtcatcgccgggctgctgctgttcgtgacgggtgtcgtccttgacgtcatggccaagaacgaccgcaaggcgttcatcgtcgagtccaacagtttcgccatgttgagacgcaga

SEQ ID NO: 121 - DNA, 354 bp, Bifidobacterium longum
atggttctgcaacagaacaaaaccaccaccttaagcggctcagctcagaaatcctcatcggggaaaacgatttccgttactttacgagaaggaaaacataagtacgccagttcttcaacaatcgataaagcaggaaaaaattcaatcaagttgcctagaatcaaagggtcacttgcccaatacaccatggaatttgccatagctaccactgtgatgaaaacagtacatgatgcatgcgtgggcgaactttttatagccgctggccaatcgaacatggagatcaactataacgattatttcaaaagcgattcggcattcaagacgaacacttcgtcacgctacactcgtgataat

SEQ ID NO: 122 - DNA, 1125 bp, Bifidobacterium longum
atgtggcaaggctctgtcgacaggcgggaaagcagatgtcacggtactcactatgtatttgtggacgtgctgaacattgtttcctgctttgccgtggtatgtctgcatacgtctttaggtgtgttctctctgcaacatacttttctatgggcattccaagagctcatgcaggcgatgtttattttcgccgtgcctattttcttcatggtcagcggaatgaatcttttggactaccggaagaaatattctacgaaagtgtttttcaaaaaacgattcgtacgagtgggacgtgcgttgattctgggcagcatcgcttgctatttattgttcggtttgctccccggcctgttttatggagcgcaatcaatcgccgatggtttcggtcctgtcgatttttgcaagagattcctcaccaactccatcatcgatatttattggttcctgtattccatcatttatttgtacttattgactccattgctttcaaaaatcgtccatgaccgtcgtttgttggaatatgccattgcgctgacgttgttctgttcaatcctgattcctgcagcaaaagccattggaattaacgagaaatatttcagcccattgttgagctggccgctatttgcttccagtgccctgctgtatttcctgctgggatattatttagaaaactacggcttgccgttgcattggaatgcgcctgcatgggccgcaactttcctcggatctgtgacgttgatgttcctcggcggtttatgttggaacggtttcttccagaattcgatgggagtggaataccagaattatcttgtcggcatttcctctccgttatgtgtgatatccgcggtatcactgttcatgctctgcaaagcgctggagccatcccttcagcgtggatctgacagaatgaagtcgataattcgcaaagtgtccagcgtctcgctcggtgtatatatgttccacctactgctggtgaaccttacgcttggtgggcctttcgagcgcatcctgacgtttgggcaataccacccattcattaaggccattgcggtctatctgcttactggcattgccgtatatgccggcaagtggtgcatctcaaaggtgaaacgagccctactatcgaag

SEQ ID NO: 123 - DNA, 1713 bp, Bifidobacterium longum
ttgaaacaggccacaaaaagttttagaattaccgaacataactttgcttatctcgtccccattcttctgggtacgttgttcggcatgtgttcttttattggccagcatgagggcaaaatcgacactcgaaatgcgctgctttatgtgaacactctcttttatattgccctgttcacattactgtttttcgctgcgacaaaaatagttccgcgcataaatcaccataacgaatcactgagtaaaccgtttgaagcgttccgcaaactcacaatggactggtctcctcgatccattatcacgttatggtgtctcgtaacggcattctggattccgtattttgtagcttatttcccgggcgtctactggtacgatacttcctggcagctgatggaatattatgacccttcagtgccgttcaccgatcatcatcccttcatgatgacgtatttgtatgtcggattcgcacatattggcaaagcattgttcaataacgctatctatggattgtacctgctagtgctcgtgcagtcgctactgtccacattggccatcgcttgtacagtctgctatacaggcaaatacaatacaccttggaaatgccgtttctttatcgctgcatttcttacccttttccccatcatccccatgatgtcgatgtctcttgcgaaagatactttcaatacgccatttttcgtattcttctctatcgcattctgtgaactttggagaacacagggggaaattttaaaatccgtttcatttaatgttttctttatcttagatgtattggccgtatccttaacaaaaaaaacaggcatgtatatcattgttctggctctgcttcttttggcatgcttcgttgtcaaacattggtcctgtaaaatagctactattgttttaggtagcgttccttatttggttgttggtataatcgtgccgacttttattttgccagcattgcacattgccccaggggaaagtaacgagattcttgctgtgcccatgcaacaagtcgccaatgtggtgcatgaccataaggatgatttgagcgcagccgaaatcgacaaaatccaacaaacttaccatatggatattgatcaactccaaggtgcttactgttggtataaagctgatccgataaaaggacaggaattatcttctaaagatgtccatgccttaatcacgacatggatgaaacagctggttaaacatcccggcgacatgatagcaggatggggtggactctccgtcgcatggttctcattcaatgtcgcatcaggagaagaacgagatctcagcatgatgcttccaatcaacaattccaaacatcattatcaaaacatcgaacaatatattccttggacagataacaccaaagctggtaatgcgattggacgattctacgcagacacattatcagcgacgcctatattcaatatcatatggcaaaaagccttttgggctacaatacttccttgtgccatcatgtttctcatactgagatccaagaagaacaaacttaatctgttgatgcttaatctgccaatgttcatcacaatgcttgttctatttgctggaccgatttccacgcacacggaggcaacacgctatgtgttgcctatgctgtatatcattccactgtttctatcacttacgctgaagcatttaagcctgaagaatcctaaatcgtctctccggacgcgagtcctacgc

SEQ ID NO: 124 - DNA, 2910 bp, Bifidobacterium longum
gtggtcaatgatgcaagtacagacaattctcacgacgtggcctctcgcttcgcttcacaggatagtagaatccgtcttctcgataaagagaacaacgagggactccatctcgccaggaaaagtggaaccgctctgagcacaggagaatacatcctcttcctggattccgatgatgctttcgcggaggggacactcgataaaattcagtcggaaatccaaaaatatacgcctgatattttgcgcttcggtctgctttgcaaagaacagaatggcatgagcagccatgccgctcgtgattttgagacttgggcaaatgcaaattcgtctgcctccaatcagaaacaattgctttccgaagttttcatttcaacaaatgaatatggaagagactggcatgtgacccataaggccttccgaggcagcatatgtcgtaaggccttcgatgcaatgacgggttcacgtcttgaacgagcggaagacagctatgagtttcttgtgcttgccagcatgtccaacttggaagtgaccaataccgacattcgaggatatgtgtacaacatcggccgaggcgtgaccacggacaacatgctctcccctgataaattcctcatgtcggcgagccagatcaagtcttgctgggaagaagccaagcattttgctgactccacagagtcggtattggtgaaggaatcagctactcgactgaaggaacgacttaccttcacattgatgaatgaatggaaagaccgagtatctgataatgacaaaatcgaagcggcaaaatccgtcgccccgattatcggagaggtggaaaccgcaactgcgttaatgagatttgcgcgagatggcgcatacgcttcaatcgaatatctcaatccatcaacgtcggcttttctggattgggccgctctggcagaagaattaacccaggatgttcatgtgctaccggtttcctatactcagatgaaagatgccgcatcgcgtcatatccaggaattcaaggaaacccaagatttgcataagcgtcaaaagaagcagaccgttaaaatcttcgtttccgcgcataagctggtttcgaccttttccagtgacattttccagcccgttcatgttggatcggcaaaaaaccccacccgtttcccctattattggagcgatgccgacggagagaacatctccgatcgcaatccacgctattgcgaactgaccacgcaatactgggcttggaagaacgttgatgccgactactacggattctgccattatcgccgctatttcgatttttccgaaaccgtgcatgaagaaaacgcgttcggcgaaatcatggatgattatatcgacaccaaggctgagaaggagtacggtctggacgatgagaacatcgcccgcgtggttaaacagtatgacgtcatcaccacaccgttcggcaatctggacgaaatcatcaacaagtatggaagcccacgcgctctgtgggaggcctctcccctgctgcacgatgacgatttgaagagctgttatcagattctgtgcgccatgtatcctgattataaggaggatgcgcaggatttcttcaatggcaacaaggcgtgcttctgcaatatgttcatcatgaagaaggaaatcttcttcgattattgtgaatggatgttcccaatccttgaggaattcgacaaggaaaccagttatagcacgtacagcaaggaagcactgcgtacgccgggacatctttccgaacgcctgctgaatatctatctcatgcaccacaagcgcatcggatccaattggaaattcaaggagctgcagtgcgtgcacttcaccaatccggaaccagccgagcagctcaaaccacttgacgtcactgataagccgatcattccagtggtgttcgcagcggacgacaattacgtgccgcagctaaccactaccgtgtactcagccatgaagaacgctgatccgagctatttctacgatgtcaccgtactgcagcgcaacatctcttgggacaagcaggaacgtatgcgcgggttcttcaaacagttcccgaacatgaatctgcgattcaccaacgtggaccgcgaacttgccggatatgagctttccaccaacaacgcccatatcagcgtggaaacatactatcgtttcctgattcaaaagctcctgccgttctatgacaaggtgctgtaccttgattccgatatcatcatcaatggtgatatcgcaaagctctacaacatcgatttgcagggcaagctacttggcgcagtgcgcgatatcgatttccttggcaatttgaacgtaaagcatggtaagcgtatgaattacgcgaagaccgtgctgaagatgcagaacccctacgattacttccaggctggcgtgctggtgctcaataccaaggcgatgcgtgagcattacaccatcgagcaatggctcgcttacgcatcgaatgacgagttcatctacaacgaccaggatgtgctcaacgcgcactgcgaaggtaacgtgctgtatctgccatgggaatggaacgtggtgcacgattgtggcggacgtgtcggcaacctcttcgtacaggcgccaaacgacatctacgatgcatacatgaagtcgcgtaacaatccgaagatcatccattacgctggttttcaaaagccatggaccgatccagattgcgatttcgcctccatctattggaaatacgcacgtgaaaccccgttctatgagcgtctgctcaagcgcgtggtcaaggcgaacgaaccgaaaatccctgaagaagcgcttcgtccaaagcacgaacgcgccgttggagaggataacccaattcgcaagattgtcgatccactcatgccaataggttcccgccgtcgtgccatggcgaaggccatcggtcgcgcggttcgaggaagggaa

SEQ ID NO: 125 - DNA, 1236 bp, Bifidobacterium longum
atgacgaataaacaatcggcagaaaattcttcgagtccttttttctcaatcatcatcccttcctacaacaatggtggttatcttcgaaagtgcattcagtctttgcaaaaacaatcttttgaggattgggaagcaatcatcgtcatcgacgcgagtccagatgacgcatttcatattgccagtcagctgtccgaagaagacgaccgaatcataatcatcaacaaaagccaaaatgagggaacccatctcgcgagaaaaagcggcgtggaatgtgcgcgggggaaatacgcccttttcctggatgcggatgatgagctcgcaaataacgcattgccctctttaaggacgttcgcttcgcaacaatcattcgatgttctccatttcggtaccgaacttttcggagaggatatgcctgaatcagcatgctccgatattcttcggctcagcaatcgagatttacccacactgcatggtccggaaatcgccttctcttctttcaccgattccgaagatcaccgtcaagactggcgtatcctgcaacgtctgtatcggaccgaacttctcaaagaagctttcagccgtatgtccagctctcgtctcggcagaggacaggatagctacgaatggctcgttattgccagcctcgcgaatacggaaaccttccataatgagctaatcggatatcgctattacctaggccgaggtatcaccactttcaaaccaatgtccaagcagaaattcatttcgctctcttcgaattatggaactctgataagcacagcttctgaatacgcaaacggcttcaccgatttcgatcttcttccttgtgccgtggaactccgccgacgattgttggagatgctgtttggcgactggtatgtacggctatccgacgaagataaattgtctgttcttcccgcgatgcaggcaaacttcactcacatggagatcgcaacggaattgatgcgtctcacacgagatgacgcttattcccattgggatgcgggagacgcctttgataaaaaatcccgatacgtgcagtggaaggagactgcagaaacaatcgccggcaacgattcatctccgcagtacaacaagtaccgggaacaagcgctcagacactttgcagatttgcagacacgtcttcccgtaccgaaggagacgccgcattctacgaaaatcatccgtatcctatcgcaaatcaaatctcttttccccactatccgaagaaagaaa

SEQ ID NO: 126 - DNA, 1251 bp, Bifidobacterium longum
atggctgaaattgcattgactgaaaagacacaggaagaagccaaggacgagcgcccggtagtgctcaaggtcgaccatgtggccaaaatgttccgtctgcccactgagcaggcgaccggcctgaagatggcgttcttaaactggacgaagggcatcaaaggctacaccgagcagcatgtgctccgcgacatcaatttcgaagtacgccaaggcgactttttcggtattgttggccgtaacggttccggcaagtccacattactgaagatcatctcccagatctataccccggagcaaggctcggtcactgtcaagggcaaactggtgccattcatcgaacttggcgtcggcttcaacccggaactgaccggccgtgagaatgtgtacttgaacggcgctctgcttggattcactcgtacgcagattgacgcgatgtatgatgacatcgtggagttcgctgagcttgaggacttcatggaccagaagctcaagaactattcctccggtatgcaggttcgtcttgctttctctgtagcgattaaagcccaaggcgacattttggtgcttgacgaagtgctcgctgttggagatgaggcgttccagcgtaaatgcgacaacttctttgctgaaatcaagaaagacccaactaaaacggtcattcttgtcactcattccatggatgctgtgaagaagtactgtaataaggccatcctcatcaaggacggcgagatcatcgccagcggcgacaagaacgatgtcgcagaccgttacacgcttgaaaatctcaagcagactgattccccggataccgataaggccgaaaagcaagataatgaagcatggcttaaggttcttgcggcctccaagccggtttgcggcaaagatgatgttttcgaattcgacatcgagtacttctttgatcaggatgtcgatttctatttcaccatgaccttgattgataagaaacgaggaggtatgaccttcgaccctggccccaatctgtataagttccataatccaggccaccacaaggtacgattcgcgctgcctgtcaacatcttcaacaatggtgatttccagattgtggcgtcattgcgtgtcgatgatcccgacaatccgaagaagcctaaagccatcgccttcgcgaatggagatgacgcctgcatcttcgcgattcgcgattccaggaatggagattacgcactgctcaacaacgatgttctttcgatcaaatgcgaaggcgtagtcggc

SEQ ID NO: 127 - DNA, 837 bp, Bifidobacterium longum
atgcttgtgaaagacttttttgagagcctcaagaagaggtaccactacgcgatggtggtgttcaaggaactggtgaagaccgatttccagctgcgctaccaaggttcgttcctaggtatggtgtggtccgtattgaagccgttgatgctgttcgcggtgatgtacgtggtgttcgtgaaattcctgaagttctccgacggcaccccgaccttcccgatttcgctgctgtgcggtacctgtttgtggagcttcttctccgagtccaccagcatgggcatgcaatccatcgtgggacgcggtgatttgctacgcaaagtgcatttcccgaattacatcatcgtggcctccaccacgatgggttccatgatttcattaggtattaacttgtgcgtggtgattttgttcggtttcttcgcccatgcacactacacttggcgcgtgctgctcgtaccgttcagcataatccagttgtactgtctagggctgggcgtggcattgctgctcgcctcgctgttcgtatacttccgtgatgtggcgcatatttgggaagtcgtgctgcaagccatgttctatgccacacctatcatctatccgatttcgatggtggctaacaacccagatttctcttgggcggctaaattgcttatgctgaatccttccactcaggtaatcatggatattcgccataacctgctttccccagaatatgtgccgaccgtgtggagcatggtcgataacaaactgctatgccttctgccgtacgtgctgtccgcgttcattctgtggctgggcattcatgtgttccgtaaatacagctccaagttcgcggaggtgctc

SEQ ID NO: 128 - DNA, 1788 bp, Bifidobacterium longum
atgcaggtaggcgccgctcacgccacaacccgtttcccgaacaccttgcatgacgatgaaggcgagaacatctctgccgaaaatccgcggtattgcgagctgaccgcgcaatactgggcttggaagaacgaagatgccgattattacggtttctgccactatcgtagatatttcgatttcacggataccccacataaggaaaacgattacggcgaaatcattgactcatatattgacagtcgcacgattgccgaatatggcatcaacgacaaggcgatcgcacatgcagtggacggatgggacatcatcaccacaccattgaacgatgttcgtcgtatcggcggattttcaaaccttaaacagcattgggacgccgacgaacatctgcggctgaatgacttacgccatatgtacgacattctgtgcgagcggcatcccgattacaagatggatgccgatgccgtactcaacggccgcaccgcagcattctgcaatatgttcatcatgaggaaagaaatcttcttcgaatacaacgagtggctattcccattgctggacgaattcgcaatgaccaccgacttcagcaagatggacatgcaggccacgcgcaccgtcggccatctctccgaacggcttttgaacatctttatcgcacacaagcagcgcaccggcgcagactggaaaatcaaacgactgcaatgcgtgcattttctgcatccagagccgaacgcgatactggaaccggtagggcaggagcgtggacgtgtggtgccggtggtgttcgccgcggacaacaattacgtcccgatgctcaccaccaccatctattcaatgctgaagaacgcttccacgaatcgtatgtatgacgtgatcgtactagaacgaaacataaccgacgagaacaagcgctacatgcggcagttctttgcaaggttctcaaatgccctgattcgtttcttcgacgtgaaccgctatctcgccggattcaatctcactaccagcaatgcgcacatcagcattgaaacatattatcgtttcatcattcaagaagcattgccattctactcgaagctgctgtatctggattgtgacctggtggtcaatggcgatatcaccgaactattcgataccaaactcggaagcaacgctatcgctgcagtaccagatattgatttcattggaaatctcaacatgaagaacggtgagcgtgctgaatacgttcataagcagttgcacatgcgtgacgcatatggctacttccaagccggtgtattggtaatgaatctcgaccgcatgcgcaagattcacacagtgcacgaatggttagaaatcgcttccagaccgggatacatatacaatgatcaagacattcttaacgtagagtgtgaaggtcttgtcacatatttggattattcgtggaacgtgatgcacaattgtgcaggccgcattgctggagtgttcgatttcgcacctgcctccatgtacaaggcgtatatgcaatcacgtaatatgccaaaaattgtacactacgcgggctttgataaaccatgggaaaatccatggtgcgatttcgcaccgctgtactggagctatgcgtgtgaaacgccattcgcggcacaaatggttgccacaatgagcggcgtggaacgccctgccccaccagaacaccacgaacgcgcaattgccgaagacagccctatgcgcaagtatgcggacgtgctggctccggtcggctccaaacaacgagaactgctgaaagtgatagcgcgcaaggcgcagggcaaacgg

SEQ ID NO: 129 - DNA, 1242 bp, Bifidobacterium longum
atgaagattgcggttgcagggactggctacgttggattgtctgtcgctttgctgctcgctcagcacaatgaagttcatgcactcgacatcattcccgagaaagtcgagcagttaaacaatgggaaaagtcctattgtcgattctgtaattactgatttcttggaaaaaagcactcttggcgaaagaatacttgactttcatgccacgctagatccgcaggaggcatatagagatgctgatttcgcggtgatcgccacgccgacaaactatgacgaaaagaaaaattacttcgatacgtccagtgtcgaagcggcgattacatcggtcagacgatatgcgccgaatgcttggattgtcatcaaatccaccataccggttggatatacgcaacagttacgtaagaaccttccggatgatcgtattctcttttcccccgaatttttacgtgaaggacacgcgttatacgacaatctgcatccaagccgcatcgtcgtcggcgccccgcagaatgatactgagtctgtcgaagcggcacgtcgattcgcgtccctgctcgttgaaggcgctgattccgctgagacgtctcgcgttaatcatgatggcagcaccggaattcccacattggtggtgggcgtcaccgaggctgaggccatcaaactatttgccaacacatatctagcgttacgtgtggcgtatttcaatgaactggatacttatgcggaaagccgtggactcaacacgcgtgcaatcatcgatggtgtttgcctcgatccccgcatcggtgacggctataataaccccagcttcggctatggcggatactgcctaccgaaggataccaaacagctgttagccaattacagtcaggttccgcagaacctcatcgaggccattgtagacgcaaatcgtacccgcaaggaattcgtagcctctgaggtgatggaacttgtcaggaatgttcagaaccctatcatcggtatctaccgattgaccatgaagtccggttccgataatttccgtcagtccgccatccaagacgttatgaagcagttcaaagcgaacggcatccctgtactcatctacgagcccacattgcgcgaatctaatttccatggcagtgaggttacccatgatctcgctgatttcaagacccgctcgtctgccatcgtagccaaccgttggaatgacgatttgctggacgtgagcgacaaggtctacacccgcgatctgtttcgcagggac

SEQ ID NO: 130 - DNA, 663 bp, Bifidobacterium longum
atggcgtccgcacccggacccgaacccccagccgttggcatgcgacggtatgctggaatggtgaacagcatggcgtgcggcggcgtattcgagccgcgtaatatcctggtgaccggcggatgcggcttcactggcgcgaacttcgtgcgatacgtggcgcggaaccatccgcacgtgcacatcaccgtgctcgacaagctgacgtacgccggcaatccggagaacatcgccggcctgccaccgtcgcaggtcgatcttgtcgtaggggacatctgcgacgtcgcgctgttggagcgtatcgtgcccggtcacgacgccatcatccacttcgccgaggaatcgcacaaagataattccatcgccaattcggaaccgttcatccgcacgaacgtggaaggcacgatgcggctgttggaggccgcccggaaacacgacgtgcgcttccaccacatcagcaccggcgagaacgtgcgggacaggcccgggcacgacaggcgatacgcgatcgacgcatccaaactgcgcgccgaactgggctggtcgccgatgcacaccgacttcgccggcggactgcgcaacgtcatcgattggtatgcggaacaccgcgattggtgggtgccggccaaggaggccaccgaggcccgctaccgcgcgcaagggcag

SEQ ID NO: 131 - DNA, 1191 bp, Bifidobacterium longum
atgaccatgcccgattccgtttccggcgtcgccggcaagccgcgcgacgtgaactacgatctgctgcgcgtggtggcgatgtgtctggtcatcggcgtccacgtgatcaacaactacatgcccgtcaagatgaccctcgccggcagcgcggaagtgacgcgatccgtgctgttcgcgctgttcatggtctgcaatccgctgttcattatggtatcgggccggttcaacctgacattcgatgccgaccggccggtgagcacccactcagcgggccgtctgccgggctctggctctgatgcccgggcaggcggcggtgcgggccaagccgatcccggtagcctcgcgccgtacgcgcgctactactacaaacgctttgtctcgctgattgtgccgtatctgctgtatgcgggtggcatgggattcgttgcctacctggtgattgatcatcgttcggttggcggcgctgtgtctggaacgttgttcgatctgttctccgggtatgacgattccgtctattggttcgtgttcatgcttgccgggtttgtgctggcaacgccgttcctggccgcgatgatgcgtacgataggccgatcgggagcctggttgctggtcgggctggccgcagccgtagccgctgccgagcatatatgcgatcttgtcggatatccgttgacgttcctgcagtcattcccttggcgtggactgctgatctactacctgttgggattcgtgttggaatactatccgccgtccgcgcgtatacggcgcggcgtgtatgcgttggcaccattcgccctggcctggacagtcgccacgccatatctgttcgccggccagcagatgcaggttggtcgcacggtcacggttgcgttcgcgatggtggtaatggcgacgttcctgttcttccggtacgacgtgcacattacgtcggcgcgggtgcgtaaggcgattatctggctggctggatattcctacacgatttatttggtgcactcgccactgtccaaggtgctgattggcccgaggattcccgtgcctacggacggatggtcgtatgcgggtatcagcgtgctgatgtttggcgctacgttgctggcggcgctgctatttgcggtgattgccgataccgtggtgcttaagcccgtgcagcgtctgctgcgcaacgtcgctctgccgcggaagggccgcctg

SEQ ID NO: 132 - DNA, 2253 bp, Bifidobacterium longum
atgcgattcacttcagggcattcgagccataaggctgtggggcgtaggagaagccgccatgccggtaacgggaaatccaatcgctccgcatctacgaatagcgctgcaaatcagcagacgggtcccgtaaacctgaagactccccagcacgtgggtggcaacggccgttcgctggtcagccgtacaccgatatgggcgcgagtggtggttgtactgctgctgacgttgctggccagcgtcacctgtgtgggcacgctctacgcggcatccgtctcgagaatggccgcggatgcgcagcgtgtgctgacatccgccgaaagtctggccaattcggcacttggctgtggcagcgataagagtctgtcggacatctcccaagagctggtcaatgccaccaatgatctcaatgcggagctgaacggcccacagtgggacttcttccgcgaccattcgcgattcggaagcgacatcaccgccgcccgcgaaatgctggcttccgtggatacgctggtcaacggtccgttcactgatctgctgaacctgtccaaacgattgcagggcttctccctgaagaatggctcggtggacgtcagcgccctgatggatatgccggatatcgtcaagcaggcgcataaggatatctcgcagcagctcaccaagctcaacaaggtgccgactccgagcgtcgccaaggtggccaccgtgctcgaaaccgaaaaggctgcgctcaagaccgtggattcgatgctcggcgaatacgatggcctcattaacttgctaccgcaactgcttggcgaggacggcaagcgcacgtatttggtgatggtgcagaacccggccgagctacgttcggcgggcggcatggtaggcaccatcgccgcaatcacggcagataagggcacgattaccatcggtgatttcgccaccacttctggttgggacattcctgaggagccaatggatgatacggtgctgaaggagcgccaggtatttggtggcacttttgaccagtacccggccaccacgaccatcgaccccgaattccagcgtgtggcacagatgaacaaatacatgtggctgtatcagaaaggcaacgaagacgagaacgtagcgggtgtattgtcactcgatcccgtatttctccaggcattgctgggagccacaggcgaggtcaagctttcggacggccgagtgctggatagcaccaccacggtgccgttcttcgcttcagacctgtacacggattacccggacttcgagcagcagaacaacttcgtttccgaagcggctcaagcaattatgaaccatgtgcttggcaacgcgaatgcctctaccgcatccccgctgttgaaggcaattagagataccagcgctagcggtcatttcaagctatggatggctgatccggatgagcaggaggcgctgattgccaccggacttatcgacgataaggccagtggcgagttgtctgctgacagtcaggtgcccgaagccggcatctatctttcggagctgcagcaaggcaagcaggattggtatctgaagacctccaccacggtcacaaaaacctgcggcgacgcctcagccagccagaacgccctgtattctggcgtgctggataagcgcatcacgacagccgtgcgtaacacgcatctgggtcagtttacggaagatcagctcggtgacgaatacacggtcaccttcaccatgaagaacacgctgactaaggctaaggccgaatcgttgcctgatttcgttaatggcggctcggagaatccagtgctcggcggcatgttgtaccgcgtggtgcttaccgctccgtacggtggcgagatcaccgctgtgcaggctgatatagattcatggggtaccaacaccgcgagcctgtatgaccgtcagtacattatgttcaaccagcagtggatcgagcccggaaaagaattgacgattgcttataccgttcgggtcagcagcgatgccacacatccactgaacgtggtaaccacgccggtggtgaatgcggatggcgtcgagacgggctccaacggtaatgtgaccgatgagtgcacggcggatacgaacggcgccgatggtgcgaacggtgccgatggtgcgaacggcggcgcggacggcggcaagaacgacgcgcataaggacgcgtcctccgatccctcggccggcctggacgccttggacaagttgaagagccagatcagctgcccggtcgatctgaagtccctggcgggatccatg

SEQ ID NO: 133 - protein, 528 aa, Bifidobacterium longum
MSSLSSNGQPSTRSRQANSGDRTTAQLSDIRQKQLSHVLYWRFFVNLALMLIDAAMYIIAGATVLNLRHEATPLYSSRFNFTIDSTVYLIIMACFWVWSLYVAGIYHRHVMGDGYQLNVLLVKGMVVCWVVQCAFNYFFNLGLTLTSLCLVVIAGWLLTMVERIASRAFITRSRRKGAYAYGTVIIGSPHGIGRTLQFLGQRRQLNYRPVAVCPIHLNPDTGLIEQSADHETLREEMQKNKGCQLPVLEYSDHNLAEQIIDMNAQTVMVADELRRYSDNYDIFSVRMESFGLEIAMLASAADTSNHEIQVRSIQGTTVITQRLAQYTPARRLTKRLFDLVISSLAIICSLIITIPVAIAIKVTDGGPVFYKQTRMGLRGKPFQMYKFRSMVVNADALKKELAKETGQTDRFIFKMKNDPRITKVGHFIRRFSIDELPQFLNVWMGDMSVVGPRPPLPEEYARYNRLYATRMLVKPGITGPWQVSGRSDLSAEESEALDVAYVQNWSIMGDIVLLFRTVGAVLSHKGAY

SEQ ID NO: 134 - protein, 576 aa, Bifidobacterium longum
MVLIVIGALLLIIAALAAWLGLSALKAKNEVEAAIQAASRIQSQVQAGDTDKAQASIEAFSQHIDATYAQTKQPVWKLATLVPYYGSDVKAARDMVHILEDVSNNALPKLAKAAQALDFNSIGIKDGTIQLGDMASVTQDLAAANGVVADASVDMGKIGDTHIPQITEAVQQGRSKFKELASLTDTASRLTDVLPKMFDLDSSDGGGSGRGPRTYLVLAQNNAELRATGGIPTAWATLTVDTGKISMSTFGDPPRNGLFSQDEAASVLTAEERNLFSTKMATDYPDINFTPDFPRVADIASQIWHRAGHDDVDGVISVDPVFLQRLLKVAGPVTLSDGTVMSGDNAEQRILNQIYIDTDTQAEQTDFFTMAASEIFTHVLKNVDGKNQQLVQTFQESVSDGHLYVWSAHEDEQRRILGTTIAGELQSKPAHSVTGVYFNDATMGKMDWYLKREVTSTYDKTYPSGAKQYTVHIKLTNTADAAEVNAAPDLLRGYDHNGNPRTGEIETVLYVYAPDEGRIVDWTQDFDQFAVHDGLTVGVKTVTLRPGESFETTVHVLASPAADENEMILRQTPLVD

SEQ ID NO: 135 - protein, 501 aa, Bifidobacterium longum
VNKEERSIAVDEAEQVQDGNGVTILDLFNAVRKHVITAVVTLVIVMVAICAYTFTRTPQYTATSELLATYRSSAAASGASSNASELSSGANYINSQIQTYPQLVKTESVLQPVIDDLGLDTTVKELAEGVTASNPDGTMLVDISVNDPDPKQASSIANSVAENLRKQVTSTIYSDEGDKIISPVNLTVVQQAYAPASPSSPNVKLNLAAGLAVGVILGIVVAFIKDLLDTRVRRDSDVTAVIDAPVLGSLSRNEAYAGTSPVIISRPASREAEEIRRLRTNVMFVLPDEPLSNVIVVTSTGPSEGKTTLSVNLATAFAENGSKVLLIDADVRNPSVSKALGIEGAVGLTHLITNRVSSHDAIQRYWKPNFHVLPAGKQTMNPSILLNSRAMKALVEQVSGAYDYVIIDTAPMQVANDAAVFAKEGPELLLVAGLGVTEKKLLRQTGHELSTLSIDPVGLAMNYGETEKPQKGGYYYYGDESDDNGKKRQIQHKKSEKTKKD

SEQ ID NO: 136 - protein, 322 aa, Bifidobacterium longum
MYRGVKVIPVTTIDAKGLAALTSSFFATLKAIKARPDVIHYHAEGPCVPLRLAHWFGIRTVATIHGLDWQRAKWGRFASTYLKLGERTAAKCADEVIVLSRGVQQYFKDTYGRETRFIPNGIAPVESVSPDVIADKWSLEKDSYILFLGRIVPEKGVHYLIEAFKRLDTDKKLVIAGGASDSAEYYESIKQAATGDQRIILTGFIEGRELEELYSNAYIYVLPSDLEGMPMSLLEALAYGCCCLTSNIAECADVLCDESGMMHGVTFRHGDVNDLADKLGELLVDVGKVRKIKTGAAGYITGRYSWDKVVQATLKLYRGADK

SEQ ID NO: 137 - protein, 447 aa, Bifidobacterium longum
MRILLVNKYFYRKGGAETYFFALAEGLKALGHEVAFFSMQHPNNEPSYWSKYFVSEKDYVGKISAFKKVKEAATLVYSFEAKRKFEALLEEFQPDIIHINNVHRQLTLSILDAPYLKKHRVPVVYTAHDYILLCPAYTMVDGSGKVCDDCLDCHFFHAVKKTCVKGSKAKSGLAFLEAEFLKNHHSYDKIDKIIAPSEFMKHKLDEGGYAGRTVAMQNFLTTSQMDMAHKVANTNKFNTVEPYFLFFGRLSKEKGILTLVRAFLRAAGLMNSGVAGSKLLPANWTLHIVGDGPERQAIENLIKSAGPEAERRIKLLGYKTGEDLQREVGNARFSVLCSEWRENMPYSGLESLAAQTPIIGANIGGIPELVVEGKTGFRFESGQLDDLANHLLQASALNGDEYAVMQQECGDYINRRAQQSLYIRSLGELYMRCLQIPTQQRDVEEEK

SEQ ID NO: 138 - protein, 354 aa, Bifidobacterium longum
MKNTIDLHNAAVLVTGAAGFIGSNLAKQLLDSIEGIHVIGFDNVNDYYDVRLKEYRLNQLSHYEGFTFIKADLADKDAVNDVFEQYRPTVVVNLAAQAGVRYSITHPDAYIQSNLIGFYNILEACRHHPVDHLVYASSSSVYGSNKKVPYSTDDKVDNPVSLYAATKKSDELLAHAYSKLYDIPSTGLRFFTVYGPAGRPDMAYFGFTNKLRAGETIKIFNYGNCRRDFTYVDDIVEGILRVMQGAPSKQTGEDGLPVPPYAVYNIGNGHPENLLEFVTILQEELLRAKVLPADYDFESHKELVPMQPGDVPVTYADTAALERDFGYRPSTPLREGLRRFAEWYKTFYLDDSDK

SEQ ID NO: 139 - protein, 416 aa, Bifidobacterium longum
MKDFDSLKIAVAGTGYVGLSLATLLAQHHQVTAVDIVPAKVDMINARKSPIQDDYIEKYFAEKELDLTATLDGESAYRDADFVIIATPTNYDSTKNFFDTSAVEAVINLVMKVNPGAIMVIKSTIPVGYTKSIREKTGSRNIIFSPEFLRESKALYDNLYPSRIVVGTDPEDRHLVEAAETFAKLLQQGAIEENIHTLLMGFTEAEAVKLFANTYLALRVSYFNELDTYAESKGLNTREIIDGVCLDPRIGTHYNNPSFGYGGYCLPKDTKQLLANYQDVPENLIQAIVDSNTTRKDFIADRVLELAGAYGPNSEWDASKEHETVVGVYRLTMKSNSDNFRQSSIQGVMKRIKAKGATVIIYEPTLENGSTFFGSEVVNDLDEFKKRSHSIVANRYDSCLDDVKDKVYTRDLFRRD

SEQ ID NO: 140 - protein, 354 aa, Bifidobacterium longum
MGESICFIMPTMDGGGAERVVSILSGEFARSGCDVTLFLTNSTHTAYALDKRVHVDTSCAESNPNSLDQIKAIRAKMRAMPNTVFISFMDSQNLFTLIAGIGMRNRIIISQRNDPHRAFGKRRLVRAIHPWLYALADCVVFQTQDALEYYPKYAAGKYRVILNPLNNSMLPRYEGERSKRVVTVCRLNEQKNLPLAIDAFAEFRTRFCDYTFEIYGEGALENDLKRYAVSRGVGDSVHFCGFRKDVHACIFDAAMFVISSDFEGLSNSMIEAIALGIPTIATDCPIGGARMVIDNGVNGYLVPVRNKERMVTAMCSIAGDTGVQERFSKAGVRLRERLSVDSISKQWLSAIKEK

SEQ ID NO: 141 - protein, 276 aa, Bifidobacterium longum
MKILVTGANGYLGRGVVDELLKRGNEVIATDFACDHVNSAAHCVPGDIFSIEDPYTYFGEPDVVLHLAWRDGFVHNSNAHFEDLPKHVAFLKKLCESGIQQVACMGSMHEIGFHEGSINAHTPCWPMSMYGIAKDALRNALQTIALQNKVKFQWLRGYYIVSDTQYGSSIFSKIVAAEIEGKKEFPFTTGQNQYDFLDYPDFCHQVAAAVNQDEVLGIINICSGKPEKLADRVERFIAENGFSIKLKYGAFPDRPYDSKAAWGDALKITRILDTEH

SEQ ID NO: 142 - protein, 169 aa, Bifidobacterium longum
MGTLLEQDKYRYAVEKMPRFQRLFRCCQECRFKPMQLVYRLLFRWCRQRNFIELSHQTVIGGGLYIGHPYCITINPQAVIGRNVNIHRGVVIGQENRGKRKGALTLGDDIWIGINASIVGGVKVGNDVMIAPGAFVNRDVPSHSVVIGNPCIIKHKDHATEGYINHKSQ

SEQ ID NO: 143 - protein, 338 aa, Bifidobacterium longum
MGAHNSIRRYLHRIGEEIRSTAEIAKLTSWPAAVETLIAKADIQIMCRNGYAEPPNARRRLIRKHETLLKYFEKRYGDFASGYRYKVNLPAVPEELKGCIWLCWWQGLDHAPRIVQRCVESIREYAGDRRVIVITEDNYRDYVTFPDWMMRKYHEGTIARTHLSDLLRLSLLAQYGGLWLDATFYCAGDIEDCFGQPLFSIKRPEYLHASVAQGYFANYSFGCDADHRWIFAVIRDFLLEYWRTNDFMVDYLFLDYLIVLVQRHCTAVKEAFAAITPNNPQCDDLFKCLGDVFNERHWESLIADTSLFKLTWKQEFPTEINGVETYYGRLLNGNLRRN

SEQ ID NO: 144 - protein, 447 aa, Bifidobacterium longum
MIRITKTKTLQYAWLYLMLLIPGSCAMSRYLNTTLVYGVIIAIYALLALLSAKYRNVYVLSFCLLLALATIVIRLKTGGVGPLSFLSNAAMLVVTYIAMTIDRRMFLTRFVRIVCFFGIISVLFWAAFCINPSLVNAWPATSFWTQNLGTGQWATVLHGKGLWLYSYLEIHATRNCGFYTEPGVYQIVLNAVLFVLLFWKKKLYFDNEKQYRTATVIVLLTLITCQSTTGYLSMMVILLCFFFMRGRERGIRTLKQKLAVLVVAITAVLITDYLLRGEESLLYVQVLNKLFGGGIGGGVNLEDSTGQYRWITVMASLKALSMDPFGIGFDAFYAIRDSFDPAAVAASIATYAAVYGMIFWLTMMIMIFYPMIRREPKKILIAVFAFMFINSTVSETYLFYPGLMMFPIYLSSYFTHKQSSVVGHAIATCNPRHSLMVSNLMNAKEVM

SEQ ID NO: 145 - protein, 310 aa, Bifidobacterium longum
MERTLLLVPSGSFYYFNSMKLPNVVVFPVFREVHGASEMVWKAMRKLRLAASSLFYTDWYKDLQSFSKIIVFDFTVWLDPALLRNINRHKNPDAKCYLYSWNIVRDKQVVLGHLTACRKYGFSYYSYDENDCKQYGFRFNTIMYDENLRLPERALTSDILFLGFLKDRKAKMLALHQIISDAGMKPEFVIVENGNQHEDLPFTIRHSYVNYADYLDMVSQSKAILDITQQGQNGFSMRVMESIFLNKKLVSTNMALLSANFYDPNNILVIDLQNPDEEELTVFLRSEFHPYSQETRHYYSVGSWINRFQQ

SEQ ID NO: 146 - protein, 464 aa, Bifidobacterium longum
MKSAVAYTFASLFSKGLAFVTVPIFTRIMSTSEMGTVNLYNSWQSILTVVATLSLTYGGYMVALKEYEHERDRYESSVLTLTTFTSIVFFAVYSVAPNFWSRILGLDKSLLLLMLVGFLLLPATEFWLARQRYEYKYKAATLVTIGSAIVASALSIVAVLYMRGSGKAAEGRLFANYAVLYAVALVLWVYIMVRGRKFISMRYWKFSLALSVPLIANQFATQILNNSGRVMIGWFVDNSAVGIYGTLSSVSTVSAIVWSAINSSFIPFLYRNIDDSEGKKRVRSLASILLLTYAAVCVLMTFLAPEVVKIIATDEYMAAIYIMPPISAAIFQNAISNMYANVLLYHKKSSYIMIASICGAVLNIVLNAVLIPLFGYQAAAYSMLIAFVFLSYVQMRVSKKLHFTITGTKETVYDDKVIIGIQWLVIVLSAIAIPLYHFTIIRYIAAFVLMVASLFLYKKSKISV

SEQ ID NO: 147 - protein, 164 aa, Bifidobacterium longum
MNHFRNAEKNAAHYRKLGLKLGGGFEILNGWDFGSEPWLIEIGDNVRITSGVRFVTHDGGVWVLRHKYPELSDIDLFGKIRIGNNVHIGFNAIIMPGVTIGDNCIIGCGTIVTHDIPANSIVVGVPGRVIESVGEYAAKHDDDFMHTKKMATDEKKAFVLGHLR

SEQ ID NO: 148 - protein, 383 aa, Bifidobacterium longum
MTAKILVTGGAGFIGSEIVKQLSAHDEYEIRVLDALTKQIHGNNPEKSYLFQSIKDCCDFIRGDVRDFTTVQKALEGVDVVLHLAAETGTGQSMYMINQYNEVNVMGLSNIFQALSLKGESNTIRKVILSSSRSVYGEGEYQCPNCGVVYPRGRKTKDMMQGDFTMHCDKCNTALTLMPTTEDSKTTPNSLYAFTKLSQEMMIQTMCPAMDIDYTIFRFQNVYGAGQSLKNPYTGILSIFSSLLLDNKDINIFEDGKESRDFIHVKDVASAVIKSINTAASNGEIINLGSGIGTSVIEIAETLKRIYGSTSNLNVTGDFRIGDIAHNVADTQKARKLLDFTPSISLQEGLTEFCEWVLGQETDNSRYEQSLTEMERSGMFIRK

SEQ ID NO: 149 - protein, 193 aa, Bifidobacterium longum
MAGSCSKAAYRPRPARPDDDPAPDILAREFNGYAPRTHLASDPAYVRVGSSWAYVCLPGDLANRQIAGHSVGVGHDADLVLAAFAALRFPLDEIEVFHTDRGGGFAGERVERVLDVFGVTRSLSRPGNPYDSAVVESTNRLVRKELIHRNVYTNVEQPRSDVNRYVWWYNHQRLHSTLGYLSPVEFTQQGKTL

SEQ ID NO: 150 - protein, 52 aa, Bifidobacterium longum
VQGIRNSGSTKAADNRTPEENELIELRKRDRQLEMEVDVSEQAAPVFARKQA

SEQ ID NO: 151 - protein, 340 aa, Bifidobacterium longum
MADEVFSPKNVIVTGGCGFIGSNFVHYVYDHHPDVHVTVLDALTYAGNLENIRGILGDRVEFVHGNICDAELLDKLVPGHDAIVHYAAESHNDNSIANPEPFLKTNVEGTFRLLEAARKYDVRYHHVSTDEVYGDLALDDPAKFTEETPYHPSSPYSSTKASSDLLVRAWHRTFGIRATISNCSNNYGPYQHVEKFIPRQITNILEGLKPKLYGNGENVRDWIHTDDHSTGVWAILTKGRIGETYLIGADGERNNITVLRDILTVMGKSPDDFDWVKDRPGHDRRYAIDSTKLRTELGWEPTHTDFQKGLERTIEWYTENRAWWEPAKAATEAKYKQQGQ

SEQ ID NO: 152 - protein, 319 aa, Bifidobacterium longum
MGLGLPDFGPVQNNISFNATKGVTRGIHAEPWDKYISIATGEIFGAWVDLRPGESFGQVYTTRLDPSKAIYVPRGVGNSFQALQDGTVYTYLVNAHWSLEQKKTYTFVNLADPELGIEWPIPLEESERSEADLHHPMLKDAKPMEPKRTLVTGCNGQLGRAVRAYAEAHGLRGFEYTDINEFDFSDPAAYDEYDWSLYGTIINAEELSADKCEIGENHARAWTINAQGPALLSRAAKDHHVTLVHASTDKVYGADSEAKAIAPESVYGQTKAAGDIAVANAPEHYILRRSESADSRNIVDTLFQLLDSHAEYGVYAVGD

SEQ ID NO: 153 - protein, 299 aa, Bifidobacterium longum
MKGIILAGGSGTRLYPLTTVTSKQLLPVYDKPMIYYPLSVLMLAGIRDILIISTPKDLPNFEKLLGDGSHYGVHFSYKVQPSPDGLAQAFLLGEEFIDGEPCALVLGDNIFYGNGLGATLRKAVAKAEGGEGASVFGYYVDDPERYGVVEFDEHKKAVSIEEKPKEPKSHYAVTGLYFYDERVVEFAKRVRPSARGELEITDLNKMYLEDGSLNVRTLGRGYAWLDTGTMDSLYEAGEFVRTVQRAQGLPIAIVEEIAYENGWISKEELLESAERYGKSPYGKHLKDVAEGKVVIVPND

SEQ ID NO: 154 - protein, 415 aa, Bifidobacterium longum
MACSYISASLPGPVRRHKDRAQNNATTNISPRTQANLRLRLVDMSNSEQALDSTNEAVNKASNEATNPSFAPQHILVTGGAGFIGANFVHWVARNHPQAHMTVLDALTYAGKRENLDGVPAANLTFVHGNICDAELVESLFSGLNQRSAAAVPPIDAIVHFAAESHNDNSILDASPFLNTNVTGTYVLLEAARRHDIRFHHISTDEVYGDLALDEQRKFTELSPYKPSSPYSASKAASDHLVRAWHRTHGLKTTISNCSNNYGPYQHVEKFIPRQITNILAGIRPKLYGQGLAVRDWISVEDHCSAIWTILTRGRIGETYLVGANGEYNNIDVLHMILKLMGRDANDFDHVNDRPGGDKRYAIDATKLQTELGWVPKYTDFKEGLAATIDWYRAHESWWMPDKAGTEEKYRKQGH

SEQ ID NO: 155 - protein, 495 aa, Bifidobacterium longum
MIRLQRLVLDNMRNISHGVLDFDDLPAGGSVTGIYGQNGSGKTTVIDAIGILRALLSGNMLPDTAGDAISVSTGLATLTATLLIGGKQKPSYLEYKVSLRRANPDSTRARVVSESVRIGDDLSRLGREALGHRMEDSETDGFVSTPVYVWRSIEAVTSVKTVVSRTADRAYMEGRSFLFSRCAALEDRPDAEFLIDWVVSRVREANGVSARSLTYINERFDEFVRLRKTLCDYATNDVFVSTTRRGSYAAYAFIPIMEEDSAGRNTEFLFDLLQPNPLTPGQAKRLGQTVESFDRILPTLVPGLHVLLKIGTAPSGKDGEDRVTAELFSRRGDITVPFRCESEGIIRITALLGYLKHAYNDENALVAVDEFDSGVFELLLGDMLYQLADGCAGQLVFTAHNLRALEVLPNGCIRTTVTDPNNRFAIIPRKSSTNNQRRRYLTASELGWSGPDIYDSPIPRMFGNSLYAAGHPDEDDDIDDDLAALNTSGTKVNRG

SEQ ID NO: 156 - protein, 234 aa, Bifidobacterium longum
VPAFSSLIENRLFQGQEFHCDVLTAPNHREEFRRRNGFYPADNPVQTVRELVEYYLRDHDRTWGQLGHVIQICDLDGAFTSDDRVREDPLVDGTQYSTTDIITPNRTILIADRTTKRNGVDALLKLDGFRKKNGRATLMVPYRLFYVSRNLEHAFRGRIDNLDAQHKQSSAIKLADRFTRNPNLFSTTLQSLRRIHGNPTTWEESWQYAMQDLHSLERGSNLAFVEPYLAGELR

SEQ ID NO: 157 - protein, 102 aa, Bifidobacterium longum
VQRLSMVGSVQVHNRRESVALDMKAYSHLSAQERIRIDELRNREGLGVCQIALRIGRDKSTVSREPGRGPWFASDENESYRPYRPKRLKAVFRQIEVDVFGT

SEQ ID NO: 158 - protein, 256 aa, Bifidobacterium longum
MSQQKPRQRGGRVLDKATPEQVMGLARNLPLTHSVLEKALADATPGQLGFLANLFEKENASRAESKRRRLLKQAGFPQSKTLEGYDRGMASFPADRGREQLESLEFVDRAEDLVFYGDVGCGKTHLAIAIGMLACQRMIPVRFFTASSLVMRLRKAKDDNRLDAELKSIGRAGLVIIDELGYLPIDIDGARLLFQVIADSYETRSVIFTSNLESGRWGDVFGDGDMAAAVIDRIVHHGSILRFHGESYRNRHSLMK

SEQ ID NO: 159 - protein, 486 aa, Bifidobacterium longum
MTTPVCVRRRIRQLDRQGLSHREISRKLGVSRTTVVKYANHGDCSPKPLGSGHAGRSLVDAGYSAVVDGWPAADLRMPVKQRHTATRVYERLVAECGFTGSYSSVRRWVKRWRREHRVESDGFAELEWAPGSAQVDFGQARAVVAGVERVVHFLVVSFPYSNMRWVVALPGETSECVCQGLLWIFERMGMAPRVVVFDNATGVGHRRPDGTAARTRLFSLFRAHYGFGPRFRDPYSGHGKGSVENAVGFVRRNLMVPMPSAESFQTLTRVWLDECGRVAGSDHCRHDVPVIELFEAEKDHMLPLPGVRFDPCDWRSVKTDKTGAAAIDANRYPAGPKWRSMRLQAGVRVFEIEPRGPGGETITTPERIWGHSAKTQVDPASLLAIIARKPRIWGESPIRNDFPETVRALLDRMDARTRSNLLDDIRAVAADCGFAATVKAVETVINAGRTVDRAAIGTCAKRILEGAGTEGGQDLKRYDKYMKEAE

SEQ ID NO: 160 - protein, 324 aa, Bifidobacterium longum
MQTSTRDIVECMPENSNVSVAVLLPCYNEEVTIGKVVRDFKIALPQADIYVYDNNSSDRTAEIAAAEGAIVRKEPRQGKGNVIRAMFEDIDADVYVMADGDDTYPADAAPAMVEKIAEGYDMVIGDRLSSTYFQENKRPFHNFGNRLVRGSINGLFHANVTDIMTGYRAFSFTFVKTYPVLSRGFEVETEMTIHSLNNNLRLFEMPIQYRDRPAGSVSKLDTVGDGIKVMGTIFRMIREYKPLPFFGGIGCVLGVLGVVLCGTVTVDFWNTGMVARFPTLIGAVMLVIAGLLLFVTGVVLDVMAKNDRKAFIVESNSFAMLRRR

SEQ ID NO: 161 - protein, 118 aa, Bifidobacterium longum
MVLQQNKTTTLSGSAQKSSSGKTISVTLREGKHKYASSSTIDKAGKNSIKLPRIKGSLAQYTMEFAIATTVMKTVHDACVGELFIAAGQSNMEINYNDYFKSDSAFKTNTSSRYTRDN

SEQ ID NO: 162 - protein, 375 aa, Bifidobacterium longum
MWQGSVDRRESRCHGTHYVFVDVLNIVSCFAVVCLHTSLGVFSLQHTFLWAFQELMQAMFIFAVPIFFMVSGMNLLDYRKKYSTKVFFKKRFVRVGRALILGSIACYLLFGLLPGLFYGAQSIADGFGPVDFCKRFLTNSIIDIYWFLYSIIYLYLLTPLLSKIVHDRRLLEYAIALTLFCSILIPAAKAIGINEKYFSPLLSWPLFASSALLYFLLGYYLENYGLPLHWNAPAWAATFLGSVTLMFLGGLCWNGFFQNSMGVEYQNYLVGISSPLCVISAVSLFMLCKALEPSLQRGSDRMKSIIRKVSSVSLGVYMFHLLLVNLTLGGPFERILTFGQYHPFIKAIAVYLLTGIAVYAGKWCISKVKRALLSK

SEQ ID NO: 163 - protein, 571 aa, Bifidobacterium longum
LKQATKSFRITEHNFAYLVPILLGTLFGMCSFIGQHEGKIDTRNALLYVNTLFYIALFTLLFFAATKIVPRINHHNESLSKPFEAFRKLTMDWSPRSIITLWCLVTAFWIPYFVAYFPGVYWYDTSWQLMEYYDPSVPFTDHHPFMMTYLYVGFAHIGKALFNNAIYGLYLLVLVQSLLSTLAIACTVCYTGKYNTPWKCRFFIAAFLTLFPIIPMMSMSLAKDTFNTPFFVFFSIAFCELWRTQGEILKSVSFNVFFILDVLAVSLTKKTGMYIIVLALLLLACFVVKHWSCKIATIVLGSVPYLVVGIIVPTFILPALHIAPGESNEILAVPMQQVANVVHDHKDDLSAAEIDKIQQTYHMDIDQLQGAYCWYKADPIKGQELSSKDVHALITTWMKQLVKHPGDMIAGWGGLSVAWFSFNVASGEERDLSMMLPINNSKHHYQNIEQYIPWTDNTKAGNAIGRFYADTLSATPIFNIIWQKAFWATILPCAIMFLILRSKKNKLNLLMLNLPMFITMLVLFAGPISTHTEATRYVLPMLYIIPLFLSLTLKHLSLKNPKSSLRTRVLR

SEQ ID NO: 164 - protein, 970 aa, Bifidobacterium longum
VVNDASTDNSHDVASRFASQDSRIRLLDKENNEGLHLARKSGTALSTGEYILFLDSDDAFAEGTLDKIQSEIQKYTPDILRFGLLCKEQNGMSSHAARDFETWANANSSASNQKQLLSEVFISTNEYGRDWHVTHKAFRGSICRKAFDAMTGSRLERAEDSYEFLVLASMSNLEVTNTDIRGYVYNIGRGVTTDNMLSPDKFLMSASQIKSCWEEAKHFADSTESVLVKESATRLKERLTFTLMNEWKDRVSDNDKIEAAKSVAPIIGEVETATALMRFARDGAYASIEYLNPSTSAFLDWAALAEELTQDVHVLPVSYTQMKDAASRHIQEFKETQDLHKRQKKQTVKIFVSAHKLVSTFSSDIFQPVHVGSAKNPTRFPYYWSDADGENISDRNPRYCELTTQYWAWKNVDADYYGFCHYRRYFDFSETVHEENAFGEIMDDYIDTKAEKEYGLDDENIARVVKQYDVITTPFGNLDEIINKYGSPRALWEASPLLHDDDLKSCYQILCAMYPDYKEDAQDFFNGNKACFCNMFIMKKEIFFDYCEWMFPILEEFDKETSYSTYSKEALRTPGHLSERLLNIYLMHHKRIGSNWKFKELQCVHFTNPEPAEQLKPLDVTDKPIIPVVFAADDNYVPQLTTTVYSAMKNADPSYFYDVTVLQRNISWDKQERMRGFFKQFPNMNLRFTNVDRELAGYELSTNNAHISVETYYRFLIQKLLPFYDKVLYLDSDIIINGDIAKLYNIDLQGKLLGAVRDIDFLGNLNVKHGKRMNYAKTVLKMQNPYDYFQAGVLVLNTKAMREHYTIEQWLAYASNDEFIYNDQDVLNAHCEGNVLYLPWEWNVVHDCGGRVGNLFVQAPNDIYDAYMKSRNNPKIIHYAGFQKPWTDPDCDFASIYWKYARETPFYERLLKRVVKANEPKIPEEALRPKHERAVGEDNPIRKIVDPLMPIGSRRRAMAKAIGRAVRGRE

SEQ ID NO: 165 - protein, 412 aa, Bifidobacterium longum
MTNKQSAENSSSPFFSIIIPSYNNGGYLRKCIQSLQKQSFEDWEAIIVIDASPDDAFHIASQLSEEDDRIIIINKSQNEGTHLARKSGVECARGKYALFLDADDELANNALPSLRTFASQQSFDVLHFGTELFGEDMPESACSDILRLSNRDLPTLHGPEIAFSSFTDSEDHRQDWRILQRLYRTELLKEAFSRMSSSRLGRGQDSYEWLVIASLANTETFHNELIGYRYYLGRGITTFKPMSKQKFISLSSNYGTLISTASEYANGFTDFDLLPCAVELRRRLLEMLFGDWYVRLSDEDKLSVLPAMQANFTHMEIATELMRLTRDDAYSHWDAGDAFDKKSRYVQWKETAETIAGNDSSPQYNKYREQALRHFADLQTRLPVPKETPHSTKIIRILSQIKSLFPTIRRKK

SEQ ID NO: 166 - protein, 417 aa, Bifidobacterium longum
MAEIALTEKTQEEAKDERPVVLKVDHVAKMFRLPTEQATGLKMAFLNWTKGIKGYTEQHVLRDINFEVRQGDFFGIVGRNGSGKSTLLKIISQIYTPEQGSVTVKGKLVPFIELGVGFNPELTGRENVYLNGALLGFTRTQIDAMYDDIVEFAELEDFMDQKLKNYSSGMQVRLAFSVAIKAQGDILVLDEVLAVGDEAFQRKCDNFFAEIKKDPTKTVILVTHSMDAVKKYCNKAILIKDGEIIASGDKNDVADRYTLENLKQTDSPDTDKAEKQDNEAWLKVLAASKPVCGKDDVFEFDIEYFFDQDVDFYFTMTLIDKKRGGMTFDPGPNLYKFHNPGHHKVRFALPVNIFNNGDFQIVASLRVDDPDNPKKPKAIAFANGDDACIFAIRDSRNGDYALLNNDVLSIKCEGVVG

SEQ ID NO: 167 - protein, 279 aa, Bifidobacterium longum
MLVKDFFESLKKRYHYAMVVFKELVKTDFQLRYQGSFLGMVWSVLKPLMLFAVMYVVFVKFLKFSDGTPTFPISLLCGTCLWSFFSESTSMGMQSIVGRGDLLRKVHFPNYIIVASTTMGSMISLGINLCVVILFGFFAHAHYTWRVLLVPFSIIQLYCLGLGVALLLASLFVYFRDVAHIWEVVLQAMFYATPIIYPISMVANNPDFSWAAKLLMLNPSTQVIMDIRHNLLSPEYVPTVWSMVDNKLLCLLPYVLSAFILWLGIHVFRKYSSKFAEVL

SEQ ID NO: 168 - protein, 596 aa, Bifidobacterium longum
MQVGAAHATTRFPNTLHDDEGENISAENPRYCELTAQYWAWKNEDADYYGFCHYRRYFDFTDTPHKENDYGEIIDSYIDSRTIAEYGINDKAIAHAVDGWDIITTPLNDVRRIGGFSNLKQHWDADEHLRLNDLRHMYDILCERHPDYKMDADAVLNGRTAAFCNMFIMRKEIFFEYNEWLFPLLDEFAMTTDFSKMDMQATRTVGHLSERLLNIFIAHKQRTGADWKIKRLQCVHFLHPEPNAILEPVGQERGRVVPVVFAADNNYVPMLTTTIYSMLKNASTNRMYDVIVLERNITDENKRYMRQFFARFSNALIRFFDVNRYLAGFNLTTSNAHISIETYYRFIIQEALPFYSKLLYLDCDLVVNGDITELFDTKLGSNAIAAVPDIDFIGNLNMKNGERAEYVHKQLHMRDAYGYFQAGVLVMNLDRMRKIHTVHEWLEIASRPGYIYNDQDILNVECEGLVTYLDYSWNVMHNCAGRIAGVFDFAPASMYKAYMQSRNMPKIVHYAGFDKPWENPWCDFAPLYWSYACETPFAAQMVATMSGVERPAPPEHHERAIAEDSPMRKYADVLAPVGSKQRELLKVIARKAQGKR

SEQ ID NO: 169 - protein, 414 aa, Bifidobacterium longum
MKIAVAGTGYVGLSVALLLAQHNEVHALDIIPEKVEQLNNGKSPIVDSVITDFLEKSTLGERILDFHATLDPQEAYRDADFAVIATPTNYDEKKNYFDTSSVEAAITSVRRYAPNAWIVIKSTIPVGYTQQLRKNLPDDRILFSPEFLREGHALYDNLHPSRIVVGAPQNDTESVEAARRFASLLVEGADSAETSRVNHDGSTGIPTLVVGVTEAEAIKLFANTYLALRVAYFNELDTYAESRGLNTRAIIDGVCLDPRIGDGYNNPSFGYGGYCLPKDTKQLLANYSQVPQNLIEAIVDANRTRKEFVASEVMELVRNVQNPIIGIYRLTMKSGSDNFRQSAIQDVMKQFKANGIPVLIYEPTLRESNFHGSEVTHDLADFKTRSSAIVANRWNDDLLDVSDKVYTRDLFRRD

SEQ ID NO: 170 - protein, 221 aa, Bifidobacterium longum
MASAPGPEPPAVGMRRYAGMVNSMACGGVFEPRNILVTGGCGFTGANFVRYVARNHPHVHITVLDKLTYAGNPENIAGLPPSQVDLVVGDICDVALLERIVPGHDAIIHFAEESHKDNSIANSEPFIRTNVEGTMRLLEAARKHDVRFHHISTGENVRDRPGHDRRYAIDASKLRAELGWSPMHTDFAGGLRNVIDWYAEHRDWWVPAKEATEARYRAQGQ

SEQ ID NO: 171 - protein, 397 aa, Bifidobacterium longum
MTMPDSVSGVAGKPRDVNYDLLRVVAMCLVIGVHVINNYMPVKMTLAGSAEVTRSVLFALFMVCNPLFIMVSGRFNLTFDADRPVSTHSAGRLPGSGSDARAGGGAGQADPGSLAPYARYYYKRFVSLIVPYLLYAGGMGFVAYLVIDHRSVGGAVSGTLFDLFSGYDDSVYWFVFMLAGFVLATPFLAAMMRTIGRSGAWLLVGLAAAVAAAEHICDLVGYPLTFLQSFPWRGLLIYYLLGFVLEYYPPSARIRRGVYALAPFALAWTVATPYLFAGQQMQVGRTVTVAFAMVVMATFLFFRYDVHITSARVRKAIIWLAGYSYTIYLVHSPLSKVLIGPRIPVPTDGWSYAGISVLMFGATLLAALLFAVIADTVVLKPVQRLLRNVALPRKGRL

SEQ ID NO: 172 - protein, 751 aa, Bifidobacterium longum
MRFTSGHSSHKAVGRRRSRHAGNGKSNRSASTNSAANQQTGPVNLKTPQHVGGNGRSLVSRTPIWARVVVVLLLTLLASVTCVGTLYAASVSRMAADAQRVLTSAESLANSALGCGSDKSLSDISQELVNATNDLNAELNGPQWDFFRDHSRFGSDITAAREMLASVDTLVNGPFTDLLNLSKRLQGFSLKNGSVDVSALMDMPDIVKQAHKDISQQLTKLNKVPTPSVAKVATVLETEKAALKTVDSMLGEYDGLINLLPQLLGEDGKRTYLVMVQNPAELRSAGGMVGTIAAITADKGTITIGDFATTSGWDIPEEPMDDTVLKERQVFGGTFDQYPATTTIDPEFQRVAQMNKYMWLYQKGNEDENVAGVLSLDPVFLQALLGATGEVKLSDGRVLDSTTTVPFFASDLYTDYPDFEQQNNFVSEAAQAIMNHVLGNANASTASPLLKAIRDTSASGHFKLWMADPDEQEALIATGLIDDKASGELSADSQVPEAGIYLSELQQGKQDWYLKTSTTVTKTCGDASASQNALYSGVLDKRITTAVRNTHLGQFTEDQLGDEYTVTFTMKNTLTKAKAESLPDFVNGGSENPVLGGMLYRVVLTAPYGGEITAVQADIDSWGTNTASLYDRQYIMFNQQWIEPGKELTIAYTVRVSSDATHPLNVVTTPVVNADGVETGSNGNVTDECTADTNGADGANGADGANGGADGGKNDAHKDASSDPSAGLDALDKLKSQISCPVDLKSLAGSM

The invention claimed is:

1. A pharmaceutical ingestable carrier comprising more than $10^6$ cfu per gram of the ingestable carrier of an isolated strain of *Bifidobacterium longum* BL1207 deposited at ATCC with accession number PTA-9608, wherein the pharmaceutical ingestable carrier is a tablet, and wherein the strain induces a ratio of interleukin-10 to interleukin-12 of at least 10 in a peripheral blood mononuclear cell co-incubation assay.

2. A pharmaceutical ingestable carrier comprising more than $10^6$ cfu per gram of the ingestable carrier of an isolated strain of *Bifidobacterium longum* AH121A deposited at NCIMB with accession number NCIMB 41675, wherein the pharmaceutical ingestable carrier is a tablet, and wherein the strain induces a ratio of interleukin-10 to interleukin-12 of at least 10 in a peripheral blood mononuclear cell co-incubation assay.

3. A pharmaceutical ingestable carrier comprising more than $10^6$ cfu per gram of the ingestable carrier of an isolated strain of *Bifidobacterium longum* AH1714 deposited at NCIMB with accession number NCIMB 41676, wherein the pharmaceutical ingestable carrier is a tablet, and wherein the strain induces a ratio of interleukin-10 to interleukin-12 of at least 10 in a peripheral blood mononuclear cell co-incubation assay.

4. A method of improving gastrointestinal health in a subject, the method comprising administering a composition comprising a therapeutically effective amount of the pharmaceutical ingestable carrier of claim 1.

5. A method of improving gastrointestinal health in a subject, the method comprising administering a composition comprising a therapeutically effective amount of the pharmaceutical ingestable carrier of claim 2.

6. A method of improving gastrointestinal health in a subject, the method comprising administering a composition comprising a therapeutically effective amount of the pharmaceutical ingestable carrier of claim 3.

7. A method for providing a probiotic to a subject, the method comprising administering a composition comprising a therapeutically effective amount of the pharmaceutical ingestable carrier of claim 1.

8. A method for providing a probiotic to a subject, the method comprising administering a composition comprising a therapeutically effective amount of the pharmaceutical ingestable carrier of claim 2.

9. A method for providing a probiotic to a subject, the method comprising administering a composition comprising a therapeutically effective amount of the pharmaceutical ingestable carrier of claim 3.

* * * * *

UNITED STATES PATENT AND TRADEMARK OFFICE
CERTIFICATE OF CORRECTION

PATENT NO. : 9,771,624 B2
APPLICATION NO. : 12/616752
DATED : September 26, 2017
INVENTOR(S) : Douwe Van Sinderen et al.

It is certified that error appears in the above-identified patent and that said Letters Patent is hereby corrected as shown below:

On the Title Page

Below Abstract delete "9 Claims and 8 Drawing Sheets" insert --3 Claims and 8 Drawing Sheets--

In the Claims

Please delete the following Claims:
"1. A pharmaceutical ingestable carrier comprising more than $10.\sup.6$ cfu per gram of the ingestable carrier of an isolated strain of Bifidobacterium longum BL1207 deposited at ATCC with accession number PTA-9608, wherein the pharmaceutical ingestable carrier is a tablet, and wherein the strain induces a ratio of interleukin-10 to interleukin-12 of at least 10 in a peripheral blood mononuclear cell co-incubation assay.

2. A pharmaceutical ingestable carrier comprising more than $10.\sup.6$ cfu per gram of the ingestable carrier of an isolated strain of Bifidobacterium longum AH121A deposited at NCIMB with accession number NCIMB 41675, wherein the pharmaceutical ingestable carrier is a tablet, and wherein the strain induces a ratio of interleukin-10 to interleukin-12 of at least 10 in a peripheral blood mononuclear cell co-incubation assay.

3. A pharmaceutical ingestable carrier comprising more than $10.\sup.6$ cfu per gram of the ingestable carrier of an isolated strain of Bifidobacterium longum AH1714 deposited at NCIMB with accession number NCIMB 41676, wherein the pharmaceutical ingestable carrier is a tablet, and wherein the strain induces a ratio of interleukin-10 to interleukin-12 of at least 10 in a peripheral blood mononuclear cell co-incubation assay.

4. A method of improving gastrointestinal health in a subject, the method comprising administering a composition comprising a therapeutically effective amount of the pharmaceutical ingestable carrier of claim 1.

Signed and Sealed this
Twenty-sixth Day of June, 2018

Andrei Iancu
*Director of the United States Patent and Trademark Office*

5. A method of improving gastrointestinal health in a subject, the method comprising administering a composition comprising a therapeutically effective amount of the pharmaceutical ingestable carrier of claim 2

6. A method of improving gastrointestinal health in a subject, the method comprising administering a composition comprising a therapeutically effective amount of the pharmaceutical ingestable carrier of claim 3

7. A method for providing a probiotic to a subject, the method comprising administering a composition comprising a therapeutically effective amount of the pharmaceutical ingestable carrier of claim 1.

8. A method for providing a probiotic to a subject, the method comprising administering a composition comprising a therapeutically effective amount of the pharmaceutical ingestable carrier of claim 2.

9. A method for providing a probiotic to a subject, the method comprising administering a composition comprising a therapeutically effective amount of the pharmaceutical ingestable carrier of claim 3."

Please insert the following Claims:
--1. A pharmaceutical ingestable carrier comprising more than $10^6$ cfu per gram of the ingestible carrier of an isolated strain of Bifidobacterium longum BL1207 deposited at ATCC with accession number PTA-9608, wherein the pharmaceutical ingestable carrier is a tablet, and wherein the strain induces a ratio of interleukin-10 to interleukin-12 of at least 10 in a peripheral blood mononuclear cell co-incubation assay.

2. A method for providing a probiotic to a subject, the method comprising administering a composition comprising a therapeutically effective amount of the pharmaceutical ingestable carrier of claim 1.

3. A method of improving gastrointestinal health in a subject, the method comprising administering a composition comprising a therapeutically effective amount of the pharmaceutical ingestable carrier of claim 1.--